United States Patent 10,233,495 (METHODS AND COMPOSITIONS FOR SCREENING AND TREATING DEVELOPMENTAL DISORDERS) - sequence listing, part 185

SEQ ID NO: 1224 - DNA, 249401 bp, Homo sapiens
gcttttgctgcttcctcattttctcttgcagccgccatgattctgaggccttcccagctatgtggaactgtgagtccggttaagtctctttttcttccccgtctcgggtatgtctttatcagcagcatggaaacggactaaaacaggggccagttgctacaggagttattatttggcttcttgcactggttgcttcagacagaagtctggcttcctggactggctcctgtagatagtagtttggcttcctgggctagttgctacaggttctgttttttgcatgcagactggccatttgccatttgtgtattcagtctctcgttgggcaggaaacagaggtacatcaggtactgggttgtgtgtcatggtagggcgaggagacaagacgccacctgggatcctgaaatgaacctgaaatttgtagcagtagcccagactgggtttatggttacagtacaatgtcattgtcaaaatttctgaatgaaatcttgactaacaagtaatattttttgatatatgcaaacataattccatactttcttaaatatgttgatgatttctaattttaactggatggaaattgtaatatagattggaataaaatgttttgttcaggaaaatagatgtcttgaagggaaggccattccttaatcctgtatctgtcaatggactatttggaataggtctaaataaactattttctgatgggaacgagactccaatctttccaaagcttcctgtcaaaggtctcaccctgcctctggtgtatgaggatttttgatgatttaaactatgtttgctacctattctatttattctagtctgttctgtaatggatatttttatgggacatacgattcattagcaggcatgcaactaattttggcatgtcttccaaataactgagaagatgactactcagtggcaactaagctgaatactgctgaaaatcagccctattttttttttttgaaaagtatattttaggtcaccagtgcttgtttcaacaaagtactggttcagaatagaagatctggcaccagattgcctgaatttaaatacactttctaccacctattagtcatgggtccttaggtaaattgtttaattttcctaatttaattatttaattcttgtgctcttttttcctcaagtgtccctagagttaataatatcaaatatattgggtgtttatcaggatcagttgagttaatgcatgtaaagcactgagaacgtagcacctaataatatatacctattatcttagtacaggtaatattacacacagattaagaaaattgaattacttttattaaaaactgaacagcttttatttgcttatgagaattatgcattaaagccatttgtaaaataaaattttcattaattgagctatattaaaatattttcagtataccttgcatcaattaagatgcaagctatagtgaaggaggctattgagtttttttgtatatacaatctgccagagatctaatttaccatttactttttaatgacaatggtaagtttttctgtcatgtaaagagtaaatggtgacttttctgagatattgaacggaaagccatagatttgtatgtatatggtgtatctatatgaaaatgactcagcatatttttttctaatgtggatatttaacagaattcattaaaacatattgtagatgtaactagtatatatacattttttaatgaaaagactaaagctatcgttttactacttccaactgatatcaaggtctatgtggaaattctaatatgactgagaaaagtcaaataaaatgtaatacaatgttggataagcatggagtaatgagagtgatgttcatttcttctctaattgaaagaaacaatgatgaactcaacatacccagctgcatttttaattgtacagacgtccatgaaatgtttggttactcgattactaaatttcactagtgaatgcagacgtccatggtctcctgtgcccttttttaccaagaatcttgtctgtggctcagcagtaaagggaccaggatgatgtgccaatctgatatagcacttaattttttaaaaatgcaattatgttttaggctgaaatagctaaaatgttatttccaatttgaaaagccccctacttaaatgcctgtatactcacgtgcagtgaataatctttatttgcatctgaaaattagctgtaaattagagctaataatcattgaaagttctagctgtgagattactccaggagaagactagttttctgagttgctttaccagattctagaatattgtttctcaaccttggcactattgacatttgagaccagaccattctttgtggtggaaggctaccctgtgttttgtcaaatgtttaacagcacccctggattcaacccagtagatgccagaagtatcctctcttagttgtgatgacaaaagtgtcttcagatattgctgatatttcttggaagtggggagcagtagggtgaaattacctctggttgagaacctctgaattggaatgtggtccttagctttgcaagtctagatcctgtgttttattggtgcagtcagagaaaactggttttctggaattaaactcaggagactcatgcttaatccacaattccaaatttaatttatatgtagagaaaaatatcatgtttactccacactgattattactgtttgaggttctcttcctctcttgtcaagactgttgaagatcaaatgggaaataaaaaaatagcatggcaaacctggaactggagtacacactccttgagagaatttgttcatgctattatggtgtctgatggaactcctacacttcaaacctaaagaaataataattatagtcatggtattcttacatagtggattctggaccgcaactcacgttatagatacggttctatcacaatgagaagagcaaattaatcgaactgtgttcaatgatctcatctgcaagagagtaacattaatatatcaacaaggaggggtaaagattagttactatgtgtggcaggattataacttcctagcacagagtgctctctaaatgtgtcttagttattattagttctgtaagaataactacaatatatcattgtaaaataaacatacaacagattgtaggggcaggtgtatgcccatggtaaagaataataatgccatgtaaccaccaaggccaacaaccaaaacttgaccaaatatcacaagcctcctgtgtgcccttctgttttccatattacatgtctttctccccacgaatgtaaaaagttccccttcttttgttttaattccactcttttaaagctagaggtagaacaatattgattcttaatttatagttggcaaaaacaaatgaacaataaatatatgttccctagagtggttgtaccagagaggcattacatccaaaacatcgatctgaatctacataattgattttgtattgcaattaaacacccttttcaccacacttacacctgcatgctgaaaatgattttaaaaattcctagttctagtaaacacacacccacatgtgcgccctccttccatatacataatgcactctcttgtgtgtgtaaacatacatgccacagtttccagagcatactaaaacatttttgttgttgcctgtaattggcaataatcagaatttccttcaccactccatgggttgtatatctttttatgtctgtattccttattcttgaattacaactggattggctggctttagtacttaagctagtcagtagacatgcaggaactgtctgtcataatggtgaaagaatttaaggtaagaataagaaaaagtagactttgaatgaaaacgagacaatcttgaaaagtaaaatgctacctcaggtaagctcttgggaaaggcattcaagaacaaattaggttcatgtataataaacttaataaaatttcaggtgaatctagataattcttagatttatttaaataattgcttaccattaatgaaaacatttgggacaataaccctgtataattttaaattatagaatgtatatgttaaaaactaaatagagaaatatttttctgattaatgcaaaaatgggaacaacttaagagtataaaataaaaggcaaatgctttaaagatgacatcgaatgaagaattggctgaataaattaaacatgtatggatttcatgatacacatgagattatactttccctcgctctttgtgctttatcttttaatattagaagcaatatatgtgatacacataaaagggtagatagacgataaatatgtatatgcattaatatgtatgtatacacattgatacatatgtaaatgtatgtgcatgtgtaatatattttatatgaaacatcataattataagcctttgactatgccactattaccacaaagggatcccaatccagagcccaagaaagggttcttgaatcttgcgaaagaaagctttcagagcgagtccgcagtgcaaagcaaaagcaagtttattaagaaagtaaagtggtgaaagttcagtgactcgatagacagagtagggcattcacgaaagtaggaggaataatgcggtcacccttggtacaaatacttgtgtgtatatgtgtatacacacatatgtataggattagaaaagatcatggggagatgagctctgctacaagggtttgtgataaaggattaattttcttaactactacattttgcaagaatcaatgaatatctttaaagcaaaattagggatgcttttgttctcaaattattgggacatcaggacacgcccaagtctgggtctgttaagtaaacgttatcaatcggttcccttaaccataagcatctggaggctaggaatacctcactttctgggaatgcagcccagcaagtctcagcctcattttcctagccctcactcaagatggtgtcactctggttctaacacctctgagaccacctatccccaaattagagcattccatcacattaaaactgtatacatgtgtgttgattctgcttttttctcaaggtaaccaagatcctgaattttataattttcatttttttttgtaaaagtagttttttaaactcatatatgtccctaaacaacatacagtattacttagctttgctttttaagattctcaaaacgatcaacatattacatattattttataacttgattttgttttcctcaaaaatgtcgcttctaagattcaactattttgttttgtgttgttgttgtttcttttactggcgtgtattatactgttgtgaaaagcactgttttatttgttctttggccattgggtatctggtcgttaattttttgtttgtttgtttgctattatgagcaacgttgctagaaatcatacatgtctcctggtgcacaaatgcaagctcctctgagtacatttttatttccataggacacaaaattactaatatttatatatcacctttgggtaaaaagacaaaactccttgaggctgggggttcatcataggaggacctacgtatatcaaagggactggtggaacatagggtatgggaaagttcaaatatacgtctaatgacaagttgtttttataaaagtagttgctcaagtttatactcccacgagcaatgtgtcagagtttctcttggcctacattttgctagtctaatgtccataaactagtatccttttgtagtcccagtttacatctctttttgctgatatatttgaggatcaatttatataggatctgtgctgtgaagtctgttttttgagacagcgtcttactccgtcacccaggctggagtgcagtggtgtgatctcggctcactgcaacctctgcctctcaggttaaagcgattctcctgcctcagcctccctagcagctgagactacaggcgtgtgccaccacaccctgctaatttttttatttctggtagagatggggtttcaccatgttggctaggcttgtcttgaactcctgacatccagtaatgcacctgcctcagcctcccaaagtgctgggaccacaggtgtgagccaccacgccaggctgtgctgtgaagtctgatcgtgccttgtgttatttttgttaatgtgtgtcatgatttaaaggtggtttttgttttactttattttgtgttttattttcctttatttggaatactaattgtatactgggttataggttttgcaagtactttctccattttgtgatttttctttttaatttctttacagtgtcttttggaaaccttaagtatttaattttcatacagttaaatttgtgaatcttttataatgaggtataatcttttctaccttaagatattgttttattatataattttatgatttttaaagtattttcatattctcctgtctttaagttttttcttttctcattgaacttactagacttctagtaagccctggaagtagtaggcatatttttagagatcttagatcctagtttttgatgttgttgttttacttgttggttgttttgtctattgattccacgaaagcctcagcactaactaaccctaacgtggcattgttcctcctggcagatgactgtgatgatcctcttgtgtctgccttgcctcaggcatccttcagcagttcttccgagctctccagcagtcatggtcctggatttgcaaggctgaatagaagagatggtaagtctgcttttctcctctgactggcccatagaaaatctcactagtttttcattatctttgcatacagtcattatgaatgatacatggtaaaagaaagtaaatttcgaaataagcaaatggttaaaactcatgagatgtatatgacatctagcttctgttctggaatgtgaaagggatacatcctatattacgaagaattgagttccttccatctgacaagctttttatatatcttactaaatattttctacaataatatacaatccttatggacacattagtgatgaaaccttaattggccttcagtttcaagttaaagaagtaattttcaaaaacgctaattatttaaaaataacaatccctcagtgttttggattctcaatgtggttgacatgattttcttatcagctgaagaataggaacataataagattttcatggtcctttaggagtactcagccaggtgtggtggttcatgcctataatgccaacactttaggaggctgaggtgggaagatcacttgaagtgaggagttcaagaccagcctgggcaacacagcaagaccttgtctctacaaaataataaaaataaattcacctgtgatgcatgcctgtagtcccagctatggctgaagcaggagtatcactgaactcagaagttggagacagtgagctatgattgtgccactgaactagagcctgggcgacaaagtgagaccctgtctcaaaaaaaaaaaacaaaaaaaaaaaccaaaaaaaaaaaaacccaaaaaaccccccaaaaaaaaaaactcagttcatcttagtttgtgtttgatcacttgaatatgttaaaaggaaactgaagataattaaatggcaccttgctgtagaaataagacagaatttcaaaaacactgtgtacttagagacagagtgtcactgtgatctcttttcataacatactaaggtaaaattcatctgcacatgcattggaggaaaacacgcttggcaatactaatacataaaacgttttaacaatcataaaaagttttaatgcatgatgtttttggttctcccatttattatcctcctctcgtggcaacatcagtcagtcacttctaattttactctttgatgttatccttaatatgtgcttaatgcttgagcacactgaacattggacatgacaaataggtaagagtgtgtgtgtgtgtgtgtatgtgtgtgtgtattttgccatctggtatacataatatatatcacacatagttctaattacaatatagatataacactttaacatgattttaagcttaagtttattttaaaatttcatttcatattattggagatacctacttttgtgtgcttctgaatgtgaaggtatcagtggagagtgagaactgagatccttctgtcaaatgggaaactggggggtgtttgaatatatttgtgtagataatgctagcgttttctttttgagtgacttgcagtaagagttactggtcacatgggactgtctcttcctctttgcaattctgagtccctgacccatcaggggactttcctagcctctctgatggccattccaggccctgtacctatggacccaccagcaggaatgctgttattgcaatgctaatcctagaataaggtctccattctgtgcttctttatagagaaaaacagagtttgacatttaccaccacttcatttgagtcataaaagctttcacagaatgtgggccagtgaaaggaacacaacattttaatctacctatttatcttgatttcctttgttgaggttcaatacatcacaaaatatatgttattaattagatcaaatcatatttttcattaatttatatactcatcaggagtctccatcagtgggactcattttcattcttaattcatttctatggctcttggtaaaacacaatatcaaacttcatgaatctcatttacatgttaatgaaaccgagacacaaaacaggatcattttaattatcttttgctggttgtaaacctacttgattacatttttctttttgatttaggttttctttttttcccctgttaattacatgaagttttcacaaaggaacatcagattttcagtgatttattaaaggctatattttatttctagtattgaaatactagaaatttctcataatatttctcataatgatttatttattagagagaataaattaattatttttattaataataatcataataatattcataataataatcataatcataataattaataattatgagaaattattctcataatttctcataacatttctcataatatttcagtcaggctaggaaaaagtgttcagccaagtctgcagtcatatgtaaataaattaaaccagcaaataaaggtcctagtatcttagatacacagaatgacttctttcctacagaattatgaaaacttagagccaaagaatagagcaaaaaaatgagaaagttacccacttattttccatctgtgggataagaagtgtcaagggtaatactgtgaaaatgagtagggccctagtaatgagggaaggggatcaaaaaaaggctaccattgctactaaaagtggctcacacctgtaatcctagcactttgaaagtctgaggcaggaggattacttgagctcaggagtttgagatcagcctgggcaacatggcaaaactctgtctctactacagatacaaaaaagttagccaggcatggtggtgtacacccgcggtcctagctatccaggaggctgaggcatgagaatcgtttgaacccagggggtgcaggtaacgtgagccaagattgtgctgttgcactccagggtgacagagtgagactctgtctcaaaagagagagagggaggggaggagaggggaggattaccattaaacatactttccattcgaagtatgctaatttaattttgccacgtatgtgctgttttgggttgaattgtgtcctcctaaaagattgaaatcctaacccaaataccgatgaaggtgaccttatttggacatagggtcttatcagatatcatcaagttaagatgaggccatactggattaaggggtggggggctaaatccaatgactggtgtccttataaggagtgtgagatttggagacatacagagacaggaaagacagagtagaccagatgaagatggaagcagagattggagtgatacagctgcaaaccaagaaatgcgaaggattgccagcaaccatcagaagttagaaagaaagaaagaggggttcttctctaagcccacagagggagtatggccctgcctgtggacatcttgatttcagactgctagtttccagaactgtgagagaataaacttgcattcttttaagatgccctgtttgtagtactttgctactgcagcccttgaaaacaaatacagattttggtactagaagtttagtgccactggaataaataccttaaaatatggaagtggctttggaattgagtaatgagcaaaggttggaagaattttgaggcacttgatagaaaaaactcagattgccttgaaaagaccgttggtgtaaatacaaaggtttaaagtgtatctggcaagggttcagaaagaaaagagggtcatgttattggacataggagggaaagcaatccttgttaaaaagtggtagaaaatttggtcgaattgtgttctaatgctgggtaaagattagatcttgtaaacaatgaacttagataattacctgaggagctttccaagcaaaatagaaaaggtatacctttgtttctccttgaagcttatagcaaaatgtgtgagggaagaaatacattgagaaagaaactgataagcaaaaaaggcaatcagacttgatggtttggaacattcttggcctattcatattgcagaagatgggaaattttgcatgctctgaagagaacattaaggatgggtaggacagattttgctaaagagattagttatgtgactcttgaatccaatcaaccatccaacaggaatccaggaatagagagaaggttatctagaaaagatagctgcatagtattgtcattgttggagtttcagtatagcttaaattttaatgggcaatttaaagttaagtgtacattgactcttagtgttgtcaatgtagagttcaaacaggttctagtgtcccatttggttgtctaaatgtgtccttagtacatttagaatccagaatatggagaaaccacatcttttatagtgttataatctgaacgtaagtctttattttaatgtacttggacaaccttggaaatgagtgattgcaaattgataaatttgtgtacaggaaaaataatacaatagtaaataaaatgattgtccaaagcaaaaataatatatttacaagtgtgagtagaaaaatacatatgtacacctctttaagtatataaaagatggtttccatagctgacaaatactgtgagtttccactcacatcttctgtaagataagaatgttttctgatgttaaaaaattggatatttgtctatcataatatttcctgatgttaaaaattggatatttgtctatatttttccattttctattttttaaaccacaactacacccttctattctaaatggttgttaagcaatgttttcccaatacctatagaatttgatattaaaatcaagcacttatctgtagaggaattagcttacttggttaattgacagagataactcccattcttggatggatctctataagaataattatagcaatctatatagcgttgtttggcaattttgactgccctaaattgttatgcttctttgcaaacaactattatgcttcattaaatcttccaagatatgcatgttgcatgtcagtgcttaagaggatagatccctaaagataaaaaaaaagtaggtgcttttttatgagttggatatttcctggtgttaaacgtattatattttttaaaaacctctataggccgggtgcagtggctcatgcttgtaatcccagcactttgggaggccaaagcgggtggatcacgaggtcaggagatcgagaccatcctggctaacatggtgaaaccccatctctactaaaaatacaaaaaattagccgggcgtggtggcgggtccctgtaaccccagctactcaggaggctggggcaggagaatggcatgaacccgggaggtggaggttgtagtgagctgagatcacaccactgcactccagcctggtgacagagcgtgactcagtctcaaaaaaaaaaaaaaaaaaaactttataataattaaatttttaaaatgatagtattaatatatttaataaccaatactttctgtatgaaaaaagagtaagatataacttttgtacaggattgaaaaatctcaagcctagagaaaggggaacctggctggcacaactggtatgagtctgaaatttgcctgagaggtcccatgaccaggctggggcaggtgaacttcactgactgagtttgttgcactggagatgccctgtacttgtggagtttgttggaaaacagaacatgccagcaatttatttgcttctagaccaactcatgatatccagaatccgatgtgctgagagtatgcctttggcaactgaagaattacgtgaattgcaagagtcccctgccttcctgctgattcaggctgtggcatgtgatttgttagcactgcctgatatttctgtcttgagccctaattttttctgggtttgggccttgtcttaaatccataggtgtacagctcttgatattgagatgggggtgctaatatggctgaaactctgaatactcatccctaacagtcacagaacttgagcctcccagacacacttgaacttcagctcttccactctccttcttctctttcgtattctttcctgcagatcataaaagtttagttgaagagcgacttctttggtgttagacatatctggaattaattcactattcttgggtcttaatcactactacattttactcccttaaggattggcaagatatttcaccaccaaactttaatttcctacgggaagagcagggataacagtgagatggtattgtccttctgaaaatgattgtggcactgtgatggggccacataaattacaaaaacacagtgctgtacacattttaaccagtttcaaagtgtgtcctgccagttaaccccattttagcaaactaaatatatatactcatttatataaaggtaatctcagagaattctgacctccacagaactgtgctggaaagagtcaatttattcctttttattttattttttattttttgttttttttttgagacagtcttactttgtcacctacgctacagtgcagtggcacaatcccagctcactgcaacctctgccttgtgggttcaagcgagtctcgtgccttggtctgctgagtatctgggtgtacaggcacgcaccaccacacccacctaattttttttgttgttgttgtattattagtagagatggggtttcaccatgttggcaaggctgatttcgaactcctgacctcacgtgatctgcctgcctcggcctccctaagtgctgaggttacacgcctgagccactgtatctggcaatattcctgattaattacaaagcaaaacagagtcaaataattagttttttaatgtttgttattagattgaagtaaagctaaaacagtctgatatatccttagtcaaaatctgtgaattagggtgataggatggttttatttaatatttttaccttttttttttcctcagcagtctggatttagtttgtgaagtttaaaaaaaacttactaaaacattaacattttgataaaggttggaaaataaagttccagattaattttatgatcagtgatgtatcacttgttctaataaattatattttgtataccagccttgagaaggtgaaataaaaataagtgaagggttacacatttatttctaaatatgctgatatcttctattaaagtagtggagagtttgctaccacttctgagattaatatagaatcacttctatttttgtgtcgatttatttgatttaacaccatagatgactgtccacctgcctggctggttccctcttggctttcgatattgccctccctccttggccccttccttagaacatgctgcaccttctctgatctccctgccagcgtcttggtgcgttttccatcttaccctttatcgtccttgtctgctctatggcccacagtcttcagctctaaatcaatctgatggtgtcatccgtgggaatgcgccaagtagctaatcctaagtaatgtgtagttctgaaatcagggaaactagattataatactaaattgtgaatggccttaaggaaatgacattacctctctttttttaccccctgggtagaggattgaatttgaggatctctaaattctatgacaacgtactcttcttatgtgtaatattctactggcaatgtagctatcttctgtttctaactcttagaaatctttaaagcatgtgagtaagagaaattggtagtccctcaataagaaggtgaggggagtaccttaaggcagattatccttctaagttttcctcaaacaagatgacacaggatgctcccgccttaggagatgtcttcagctttcataagatacaggaattcaaaatataaatgtggcccaactgaaatcgatacagtggctcaaatttggtcaattaaaatatattcacaaaattaaacattatcactaatacataaacatttcttttagtatccatctgatattttcagtgctgagtaggaaaattttacatgcaggtgcaatgaataaaccatgagttaagtaatcaagggtgtctttggttgggttctcctagaagcacacctggagcaatgtctgaggtacaagtgatttatgagggcatagctgccaggagaaaacagagcatgggggaagcaggttaaggaagaagaaaccaaataatttcagaaatctcaggcacagcataatctctcaggaaactctgagggataaattttaccttggactttgccttacctcaaggtgacggtagagtctagcatggtgtctggctatatgaataattaatttagaaatgttagctgccatgtcatacaactggcagcagatttgatgtcttgttagggcccttttgctggcttactgatagctctctcctgaatttatgcttaagtgacctttcctggtacttactcatgaaaagagatctctctctctgtttcctcttcttataaaagcattaatcatatcatgagtggcccaccctcgtgacaatgtaaacctaattacctcccaaaggccccctctccaaatgccatcacactggggattagggcttcagcctgtgaattttgttgggacacaaacattcagcccatagtagttagctacatttccagaaactagtaaactaactacttgacatacctgagagaaaccaagacagccagccctcgggggcaaagatccccccaaaaaggaaatatcatgtagtgagcctgacattttctgcaccaaataacagagttttaaaaatatgtaaaggaaaatggacagaaataatagaggtagacagtacatacagaaatacaaaattgttaatgtatatcattctgtagcttattgaacaagtaggcaaaaaaatgaaaataaagatttgaacaaaaaattaaaatatgtaatgtatatttatatactgtgtgtaatgtatatttatatactctgtgtagttatttatatactctgtgtagtatatctccaactgcagaatacacattcttattaagtatacttagaatatttacctaaatttatgctggaccataaattgtttcaatatatctcaaaggattgaaatcatacagagtaagtgccctagctatagtggaattcagctagaaatcattaattagagaatacttgaaaagccagaaaggcgtggaatttaatacattcctccaaaagaaatctcaatggaaatgagaaaacattttaactgaatgataagaaaatactgcaaatcagaattgtgagatgcagattagaccataattcatggccttaattacaaatatgacaaaagaaaaaaggttaaatatgaatgatttttccatgcattcatcccaaaaaactacaaaaagaacaacaaattaagccaaaaataagcaaaaggaaggaaaaaacccaaagtgcattaattaataaaatggaaaacaagcatgtaatacaatcaagaagacaaaaatgtaaggatactttaagaaactttctgctaattttgagaatttaaatgaattgaaaaaatgtttcaaaaacaaacctgcaaaactgcactcaataaataaaaaaaattaaaatatttctctacctgtaagagagaaatttataattaaaaatgtttcaacaaagaaaactacaagttaatatgccttcaaatatgacttcttgcaaacatatttaaggaagatatgactgtaaacttacacattctctcccagagaacagaaaaaaagtcaaaatactccctaactcattcaaggaggccagcataaccttgataccaaacagtgtcaaggacaaacaagaaaggaaaattaaaagccactctgttgcatgaatataaatgcagaatgctctaaacaaaatactagcgtacatgtgtgaagggccccagactctgcctcagaatgagaatgcctcccctcagctggaatgtacatgtgctctgaaagtgtggtgggtggcacaaccacagaaatatcaaaagccaggactcctagctttcttgcctgatgccagttcatgtgtgtcctgagcatcttgcccagcaggggatggacggatcttgctaagagatgggaaaagctagcaaaaggattataaattatgctgctataaagacacatgcacatgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggataaagctggaaaccatcattctcagcaaactatcacaaggacaaaaaaaccaaacactgcatgttctcactcataggtgggaattgaacaatgagaacacttggacacaggaaggggaacatcacacaccggggcctgttgtggggtgggggtgggggagagggaaagcattaggagatatacctaatgctaaatgacgagttaatgtgtgcagcacaccaacatggcacatgtatacatatgtaacaaacctgcacgttgtgcacatgtaccctaaaacttaaagtaagaataaaatttaaaaaatacaaaaaaaaaagaaaaccaaaaaagctcattcacccatatgagagatggttaaaattaagatgtgtcatgtggattggacatgtcttcttttccaacatttatcttaaaatcagaggtacatgtgcaggtttgttacaaaggtatattgcataatgctcaggttttgggtatgactgaattcgtcacccaggtagtgagcatagtatccgtaggtaggtttcaacccctgccccatcactgcctctcctgtcttgtattcctcagtgtcttttgttcccaactttaggtccatacgctcccaatattttagctcccacttacaagataacatgtggtattaggttttctatttctgtataaattcttttaggataacggtttctagctgtatccatgttgctgcaaaggaaatggttttgttgtttttttatggctatgtagtattccatggtgtgtatatacgacattttctttattcagtccatcattgatgggtacctgggttgataccatgtctttgctgttgtgaccagctctgtgatatggacaatttttgtatgacacttacatcctctaaaccctgtctctctctcagccagaattgcagtgaccaaatccagctttccacaggtgtgatagggtctcatctagggctgtatcatttccctgtagcttcttgccctatggctcctctgatattgatggatggccttcccctgggagtccactggactcattctagtagtgagggatgaggaggagtgcctgcctgtgaggctaaacgtgccaaagaggatgagagctgatggacagaaactttctgcttttgttctcagaatggaaattctgagatgcatctgataaggctgctcagaagtgtgtgtggcattggataccagtagcttgtagtttcatccaagtcaataacacatttcctttggccttccgtcattgtttcaccccttcctgcgtgccacatctgtcctgtggggtcacttcttcaatgtgagtgatcaaacttttgcctcaaagtcatgcttctcatcacccagtgaagtggaacgaaatgcttcctgattcctgctcagaagaattccaaataatttatatagattttctccgttcaaggaagtagatcataattctctacctctgaagtgtaagatgtgtataacaacttcaacactgtacattattggactttacagtggagaaatctgacaaacaccacctcatcttggtgatcaaagttaatcagtgataaattatattgatagtatgtacccttgatttgatgcagtgaaaatggcattttacctctgtggtcctgctctcaaaaacctctgtggaaaacattagacctacctgaagtatagaatcttctacacaatacctgaccagccattctcagaaatgttaaggttgtcaaaaaacaaggaaagcctgaaacggtcataaccaaaaggagtctgagacgtgatcactaaatgtaacatgattcacatgactaaacgcaacaacatgaaatgaacatgatgtaacctttatgggatcgtggaacgcagaaaggacatttagtaaaaactaaggagatccaaataaagcatggaccttagttaataataataatgtatcaatagtgatgcattagttgtgacaaatgtaccatatgcctgtaaggtgtgtttttttttttgagatggaggtttgctcttgtttcccatgctggagtgcattagcgcaatcttggctcactgcaacctccgcctcccaggttcaagtgattctcctgcctcagcctcctgagtagctgggactacaggcgcctgccaccgcacctggctaattttgtatttttagtagagacggggtttctccattttggtcaggctggtctcaaactcctgacctcaggtgatccacctgcctcagccgcccaaagtgctgggcgtgagccactgtgcctggcacctgtaaggtattaataggacaggggactgggcaaagggtgttttgggaaccctctgtaatattcttgcaacttttctgtaactctaaaagtattttaaaataaaaagtttgttaaaaacacatgtaaatacttcagctttgttagtacgaaatgcaaaatgtcaatatgaaaagaatatttgtgtgtgcctgtataataaaacatggtaaaaactcatttgagaaggagggaaaggaatgtaaaaatgcaatgcaaaaattaatatggactgaatgtcacttaacagttagtgtgatgggtgtttaggcatccataattatccaaaatgtcaggaggcttgtgaaataaacatcaaagcctcagtggagcttgctttgtctctctggttttcccatttaattagattctgagtatgatgacattggaaagagttgtttgctctggcagtagtaatactttctatttgtttatagctttactatttatagttttataatttaaaatctgttcccgtgcactatctcctttgatttttaactgtagcccttccaaaggctactctatagatgtggttccatgagaaaagccatagaaaaaattgtgtgatttttataaagtctttctttcgattctcaaataagacattttatcaaagattttcttcctcagtgggaattattagccttatatatgtaataatttaaatagaaagctagcttaaaaccacatttaagtgacgtaaggattatttgttattttctgctacttttttctttgatctctttttaaaaagattgatatataattaatagtaacagtataaaataaaagggacacataaaatagattatataattggctgtataaaatataactgacttttataataggctataaaaatatctgactgtattaaaatgaaaaataaggtcagagactgtgtgccagaaagagaacgtttatgtgggtttttccaaagtctcaccattgaccttgactttgtacatgtcctccttaaatgtgcctgtccttcgccagagcctcgggagaagtgctgtgcagacacttcccacacctgtgctaaaggaaaaacacatctcaacaatcttctttctggaatttttaattgcctgcttgaattttccagctgcctgcaaggtgttttttctcactttatcaacttaagttaaatacatcacctccaaaccagctgctgcttgtaattatttttctttctggttcctggtggttttttaaatcaccatagtttcaaattcttagaatctccttttatttctcccttgatccctccttctgaaaaaggtgataaattctgtgtattcatggcctgtaatctctgtctcttaaactccttttatatttccattgctgctactgtaatgcagttctttgatttctatgcaaggttatttaggaccataatgggccatgcagttttgaggctttcttcaataaataaaatttaaagcatcattgtggccttgttgtgtgcctgcttatgactttcaaccccatctccattgcctatactggtgtttatgaatgcacttgccaatatccagctaatattctgcagtggttgaacagataatttggtagtttcaaagaaaaaggtgtaaaaattcacaaacattttacaaattaaactggaagataatttatgaattggctaccattcactaacagtatagtttctcttagctagcccgtctttgcttaatttgtgtgctatttcttatacttattagatttgctcttttgctcttagcactacatgacatcaattctatgattagtaaaaatacagaaagagcttactgatgcagaaaagcataagtgaaaaacagtaagaaatagaaattcagaaaaatgtcataaatataaggaatgactataattttagggcaaataaaacatatgaaccgggatatttgaatatttgaatgtggcaatttttaaaagcatctaaatagtgctggatagatctgtaaaaattggactttatttgatgagtgattattttactaaagtttttaaaaattgtggtgaaattcacataacatacaattaaccattgtaaagtataaaatttggtggcatttcacaattttgtgaaatcactatattcatcaggttccaaaatatgttctaaataggtttagttgatttttttttttgtggtctaccattttgattccattctcattcttttttgttgttttctgttttttctttttctttttttttagacagagtctcgctctgttgcccaggctggagtgcagtggcgcgatctcggctcactgtaagctccgcctcccgggttcacaccattgtcctgtctcagcctcccgagtagctgggactgcaggcgcccgccaccatgctcggctaattttttgtattttttagtagaggcagggtttcacagtgttagccaggatggtctcgatctcctgacctcgtgatccacctgcctcagcatcccaaagtgctgagattacaggcgtgagctaccacggccggcctgttttttctttcaagtttttttttttttcttagtgattactttgggaattagaaataatctctcaaatttgtaatgatctattttgaattaatattccttagctttaatggtatacaaaaacctctacttttgtatcgctttgtctctcctcttttgtatgattttcacaaattatatccttatgcattgtatgcactaacatagacacatagttataattattgttttatgcatttgtcttttaaattatataggaagaaaaggggaattacaaacctccaataaaataaaactttcttttgtgtttatgtagtttccatacagtgttctttacgtggctttgcatactgtctagtgcccttttctttctgtccaaaggactccctttgacatttcctgttggacaggcctacaggcaataaactccttcagttttgcttattcgggaatgtcacttcttcatttaaaaaaggtagttttactagatttagaatgtttggcaaatagttttatttttctttcagcactttaaatatatcatcccactgccttttggccgccctggtttctgcccagaaatctgctgttgaggaccctttataggtgacatcttctgacttgatgcttttaagattttttctttgtctttgacttacaacggtttgattgtaatgtgtctcagtgtagaactctttgggtttatctggctttgtgtttcaccttattggatgtggtgattcatgtcttttatcaaatttggaaagtttggggccaatattattattttgtgagacaggatgtcattctgttgcccaggctggagtgcagtggtgcaattataactcactgcagcctccacctcttaggctcaagtgatcctcctgccttagtctcctgagtagctgggaccacacaggcacgcaccaccacgccagactaatttttgtctttttttgtagagatgggattttgccatgttgcctaggctggtcttgaactcttgggctcaagcaatctggccacctcaacctcccaaagtgccattattatttttttttataattcactttttatactatttttattgatacataatcaactgacataacattatttatttaaatattctttcagccattctctctctcctatccttctgagattcccattatgcatacattgataaacttgatggttttccataggtctcttagattctgttcatttttttctttttatcatattttttcctttttatcatattcagggatcttgggtgatcctagccaaccagctttcccagggatgaattttccacttcagttcagtttgggccaaaggtgagtcttagataccgtctgatgttcaagcagtttattctggcagcgcttgtacataatggaaagtgggagcaggttagtggtacgggccagatacagtcaaggggtcaggtgacggactgaccaggaaggtctgtgtctggagaccattcccagagttttgggaattactcccctttcttacacatgtattcactttacactcattaacagatgtttctttcataaaggaagttaaactattcttgtaaggataaggtttgttttaaggtttatgagggttacatctgtgctgaggtggtcttgtcacctagaaatctctgggctagggttagtagtccccaggtcaggtcgtgccataccactaagtgacacatgatgtaggccccatgagatgtttgagtggaccttagagctatcattaatcttatagccatgatgtgtctcttgtatgtactacgctttctgtttcttgaatacatatgctcaatctatctctacattcactgaatatttcttctctctgctcaaatctgctgttgaagtcctctagtgaattcatttcagttgttgtactttgcaactccagaatgtttatttcattccttttaataatttatatctctttattgatgacctctatttgttgagacatcattctcctatttttcattaattgtttgtacattgtttcctttagctctttgagcgtattaaagatagctgatttaaaatccatgtttagttgatccaatatcattgcttcctcaggggcagtttctattaatttctcctgtgaatggactctacattcctttttttgcatgcatcatattttttggttgttgccgaaaactagacattttgaatattacagtgtactaactcaaaaatcagatgatctcttcctccataaagggtctgtttttgttgcttgtgtgggttataggtttttttttttttttttttttttttggtgacttttctagtactttaaaaaagcctattcttccacaatggttgaactagtttacagtcccaccaacagcgtaaaagtgttcctatttctccacatcctctacagcacctgttgtttcctgacttttgaatgatcgccattctaactggtgtgagatggtatctcattgtggttttgatttgcatttctctgatggccaatgatgatgagcattttttcatgcagccataaaaaatgatgagttcatgtcctttgtagatatacctaacactaaatgacgagttaatggatgcagcacaccaacatggcacatgtatacatgtgtaacaaacctgcacgttgtgcacatgtaccctaaaacttaaagtataataataataataataataataataaacagcctattctttgtcatgtatagtctttgaggtttatttttttttcagcttgtgggcaggtagtgttttgacaaagatttccttagaaactagtggaaaaaaagccaaaatgaaacaaaagcccttcccagtttttgcagattgggtctgtgttggggcaccacttagccaggccatataaaactctgccttatcttcgacttgctgctcacagacataatcctgtaagttacgttcactcttaatccccaaactgtgtctctgatgaaaaagtagaatgaaccttacaagacttttaattatccttcaaacaaaactctaatactacagttaaacttttctagataaaacacaaaatgtgctttttaataaggattttatactttttttctataatgggagtagaactacatatgtacaaagttgtatttctaatagcaaaaacacatctcattattaatgttatcctttgggaaaaagtacagtatgctatttgcaaaatccatctatcaaaagacactgtcaaaacccatgtattttttagtggctttggacgtgcaggaaacaatattctgagtaagtgttagtgactcctgctttattcaatatgagagctacttattttctgagttttaattctgctcctgcctagataagagcaaaacactcaacctttccatctggttaaccttgatagctcatactgtaggagccatcaaggctaaccagatggaaaggttgaatttttctagtatttgtgatcatttggtgtattgtgttgtagattggaaaatgctgtggatcagaatgaggcaagcactcgatagacaccagaagctttattcacagaagagagttgggagacggttatcaaactgaggtcacaggggaatggggtggggtgaggtgggttattttcattgtaatgtgtgaagtgatcagtagattctgcttttctgcatgacagtttgctggttgatcttgtaaaaggtgagcacatacatttctgcaaggaaggatgagataaaaacacattcagtgacaataataattccctcagaggctatttctatgtgtgagatgatgtagaaatagacacaatatctctgcaaacccttcatctcccacctagctcagacaggcatgagtcactcaatgcttaagagaaagcagatgactgcacagcttgggaacaaagctcattgttcccttaaggcttaaaacataaaggatttgaaagggaagatgagcaggcagaaggcatcccttttatccctttcctactgagaggaaggagagtttggaaaggaaggatgagggtaagacatgagcaagcaagtataaagaatcactttctctgaagccctgtcctcaaactaagtccagagtgagaggctgtatggaatcctcctttcacattcagttatctgaatgtgaaagatgtgcttagggtacgagcttggagaaaagactgcctgaacaaagaaaagtcacgaagtcattctgttgctgccatgtggagattgccatgtgacaagaaccccttatcagccccagagggcatgtgaggagaactaaaagctgctgggggtgccgagaagcacaggaggtagaggcagtgctgttggcaaggtctcacacctgggatgggtgtgagatatcagaatgtcatgaccaagtacatccttaacctgaaacagaccaacacagagcagaatggaagctgcttgattatcataggattgttcactgtccaggcagaagaccaagaagtgtgacccttcccccaccacaactgctcctaggactaactccagggttgatggaaaggtagacaaatccctgtaggcatgttaaatttgaaggtggcataaatataatcctgaattgactgagtaatctgtgaactggactgacttcctctgggatgattaggttgattttctacatgagaaagaataggaactaaaaatagaaaattagattgggttgggaaaaaaaatgcagattttcacacttgaggctgtaactgagaaattcataactgcaatattattctaactgctttgcttaagtagcttatctcagagatatgtacagtaatctgctggcttgtgggagcctactgtgaacatctcttcccagctcagcattatcaagttgttagcttgaaatcttccacagaaggagcatttacaccacgggaattgacaaatactacaaagcaagacttttcccccaaaagaaaaagttattaaacacttaccagcataccactgatcagaacttatcactcatgagccaaaatataatgatgttggataaaagatttaggctttattttaaaaattgaactgtgatgtaaaagacctgaaccaggttgccaggacttcattatttgttgctttaaaaagtaaagttaggaatttgttactgtgtatattcacaatgcacatataagttctttagcatagcttaaataacttgtttccagatggtgtacagcaactaggtgtggtaagaatatatattccaagttaacacatttaaacctccagcttttgagttgacatgttggttgataagttgtttgcttttttgcttaaagaaggacatttcttcattcaatgtctacctttgatcaaaatatccagaaatctctgttagggccacagaatttctgtttttctcagtgacctctactcatgaattaaatttttttatttaattaataccaagaataagaagttaaatcaacttgctttggaagccacccatgcagatcaaactaaccgctgtcaagctggttatagcttggtaggagattgcaaatactaaactatcttctcataaaacaacctgaaatattcatgaatattagtagtgatcttaaaatattatttattctgtacactttaaatgttggatggattctttttatttatctaaagttggtgatgaacatgtgtaccaaacacacactaagcggtttttggatgctgaaagactgagagttaggtttccttagccttgaatgaaagactttccactatctggtattcggggaaccagcccccagtatttcagtgtaggttcttttctattttccctaaatgtcagccggtctgagaaataaagagaaagagtacaaatagagaaattttacagctggacctccaggggtgacatcacatatcgacaggttctgtgatgcctacctgagctgcaaaaccagcaagtttttattagggatttcaaaaggggaggggtgtacgaatagggagtaggtcacagggatcacatgcttcagagggcaatagaagatcacaaggcagagggtgaaattagaattattgatgaggttccatgtcccactgggcatgcattgtattgataaacatcttaacaggaaacagggttcgagagcagacaactgatctgactagaattcaccaggctggaatttcccaatcctggtaagcctgagggtactgcaggagaccagggtgtatttcatcccttatcttcaactgcataagacagacactcccagagcagccgtccatagacctacccctgggaatgcattccttccccagggttcttccttgctgggaaaagaattcagtgatatttctcctacttgctttctgcaagaagaaaaatatggctctattctgcctgaccccgcaggcagtcagaccttaaggttatcttcccttgttccctgaagatcgctgttgttctattctttttcagggtgccctgatttcatattgttcaaacacacatgttttacaaacagtttgtacagttaacacaatcatcacaggatcctgaggtgacatacatcctaagcttacaaagatgacgggattaagagattaaagtaaagacagacataagaaattataagagtatcgattggggaagcgataaatgtccatgaaatcttcacaatttatgttcagagattgcagtaaggacaggcataagaaattataaaagtattaattttgggagctgatagatgtccgtgaaatcttcacaatttatgttcttctgctgctgcttcagctggtccctccattcggggtccccgacttcccataacaatctggctccattctcctttcttgccttgatgacaactgccctcctgttgccccctctattccctttgctcccttcactcccttcagtccaattactgctgtgctgaaagatgtgcctcacattggtttgccctcatgtcattcctctgcttggaaggctccaatccttcactgtggccttccagtgtcccaccctggaacccaagtgaaatgtttctgcttccctaaccattcagccagcagtgctctccacaccctgaacttctcaagtgctcattccatttcagtccctcttgtaatctgcatcacctgctgatgtgctgtcttactcttttataaaagatgaactccaggaggaaatgacatcatctgagatgaagaacagaccctggagacagactgttttcagggtttgcctgactttaccagatctttgtaacctttcataagtgactttacaaccttttggctcagtctcttcatgtttaaggtggggaaaaaaaatttccattgtgtaagattattgtgaaaatcaaacaaattaggacagtgaagcccttagtacactgtagaatacagaagtgatctctgtttatagccagcagatccagagtcattcccagcatttcttttgattatgtgctgataaatatattgatcacattttggtttggcttctaggatgaaaattgagggtagtagtagtgattagaatgatattaataagcccttcgacacagtagtttctgtgtttgaaattctgtgtgtgatctagtcctaaaagctgtaatcagaatatgcgattagggagatacattctatatgctttgctatgaaaggtggcatttagagatttttaaaagagtggtctttttaactgtctaatgtcttgtgctgccagagatcactgagcttctataatgtttattaacaattggaaatgtcttaaagtgcatagtcagcccctccccattcaacatataacatctcatttctgcctccttcctagcttaaaaagctactacgataggttatacatagtgtttagattgttgaaaaatataaactttaaacacttaatctaaacaccacattaatttaaattttaagatatttatgttaagatactagatgacattaatattcagcaaatactcatttattcattggaattcaaaacacatttcagacactctagagaagattgatgggaattaatcaaaactatttcttagaaaagaaatgacacaaagagaatttaagatcgtttgaaatgtcgcctttgctcattacaaaggtctgtcattttacttttgttatgggaaagacaaagctcttacagccctttgaccttctgaagttatctcagaatctatctaatttatttccatttctctgaatttggccatattagaacaataacagctcaactaatgagaagcctcgcttttatgtttgagcagttcacaagttttggtaaaagttccattcaaatatgtccatggctttctaatacgagatttgattcttagctattaatttaacaaacaaaagcaaactgtattcttttatattacaaagctcttatataacaagctaaatcatgggaaagttgatattttaactgcagctgggaggtggagggaaggaagtcctggctgagtgagaggcataagaacatgtataattcaaataaaattgtggagaacaagaacaggtttcatagaaaaatgcacggttttcttaggctccactgtcagattgggcttgtgttacatgctgcatcaagaggatgccttttgctaccaggaaaaataccatccaacctgcttttaccaaaacaactctggaaacaacagtgagaagggactggttatttaagaggcacgtattaaagatctctaggaagggaaggccatgaagcaggaacatagctgcccaagttcccccccaaatcctatatgcttacccaaatcccacaggccttgcttccttcattctcatcacccaaggagagctgtccctgtattctaaattaaatcactccaggttatcctaaatcttttgtagtggctcaggtttcctgttgcttcaatttacatttttcaaatttcccttgtactaatgactcttgactctgagcaccaccacccagaatgttttcaaacgaccaccctggactttgccctatccctctccaacatctgattgcgctcccaatgcctactatttatgggttacccacatcaccaagtcctgccaattctacctcactaaactttctccgatgctttcatgtcttcattcaatacatatttatagggagtttcctatgtgccaacacctattctagcatgcaaacatcaggaaggcagagacttacttctgttttgctcactttcgtggcgtttgcctgctagtagaacattatatttattcaagcgtgagaactcctaactctgattaatacaacaaccccaagattactctttttctctctgctaaaatttgatcaaggagatatgtctgcactgccaatcagcaatgtactccttagaatcctccagtggtgctaattttcccttctccactgtttagtatatcctttatagcccttaagattggctcctgctcaccatttcagtcccatctttcaacagtcagtccaatttctgacactttatattttttgctccaactatttcggacaaattgaagctccttaatgtgctacagcctctcacacttctggagtttgcctctgctctttttatgggaaagccattattcgttcttcacctcctaggtcattcctgttagtccttcagtataagtgtagatgccagctctccctgacatcttcctcaactttttcattgagagtctttacctcttttctgtgcctcttaacttaggatcttaaacctgtccttccacctagcacaaatgcatttttctcagacaaatacaatatattttatgtctagatggtgttccattgaaatgtacaaattctgccccccacccagtgacaagctgataaacagtgaaattattttttaattgagttgttgaactaataaggactcaaactaaggtagggacaaagccaaggaaagggctgtaatggaaatgactttgaaggttaaactgaccagatttggcaacttctatacagtattactgaaagggagtaattagaaatgatttttaacattttcagtccgaatgaatggaaggctagaattatgtggccatctggttttgacaggaggtaaaacatccatttttgaaatgttaagtttaacaaatctatagggcatccatgaatagatatatgggaggcattcaggatttgggatatggctttcaaaggaaagatcagagctagaaaaatagatttagtcttcagcatccaaaaaaaaaatcattgtagccacaagcatgagatgtgtagttcagtgaggatgtaaagcaagagaaaatgagagttgtgttagctttttagcgaaagtaaagaaaaatggctccatgaaagatgctgaaaaaggctggtcagggaagtttagaaaaaaacccaagaagttgccatgtcctatcgagtcacagaaggaggagcttgcccgaagtgacagaattttggtcatgacttctgatctagatgtttttgctgatgagttttctctcagttcatttattgacgtagaaggatattctacagatgcagtatgtcagcatagcagaagcaaaaagctgctgttcctttgttttgaaagcatcatccctcaagaatcatgcaaatcagaaattcattatggaaactgtgtatgaagatcatctgggaattcccctaaatataatgcccctggctgtcatattgtccctcccatttttatataaaggagcataaaatgctagaaatattacatccaggcttgcatttaattttgcaaaagtgatggattttaaaaatttcacaaagggcaattatataacacaatattcttcttctcagttatgcatctgttgaaggaaaaactggcatcattaaatgaaaacaaagtttttgacatttatggttgtctattgagtttggctgactctacaaatattatatttcctaaaattataaattgctaatttctttttttttttttttttttttttttgagatggagtcttgctctgtcgcccaggttggagtgcagtggtgcaatctcggctcactgcaagctccacctccgaggttcacaccattctcctgtgtcagcctcccaagcagctgggactacaggcacccgccaccacgcttggctaatttgttgtatttttagtactggcggggtttcaccgtattagccaggatggtctagatctcctgacctcgtgatctgcccacctcggcataaattgctaatttcttaagtaaaattctgaactctgaacatatatttcaaacaatgacaaactgacctgttttatattcctaagtatctgtgggttacaaattttcagaaaacagatataataaaagcaataacaactgcaacgtaattcatgctagtaatagattctccattttgcttatcaaaagtatttgcttttcacaattactgtagctctcatcacgaatgtgcattgagctgcttctgctgggatgccgtgtttcagctgccacattctctgtggtaacagcgttcaggaaaatgcaagggtgtggataagattcatagtattgccagaagcaatttgaaattggctaggcagaagcataacctatttttttttttttttggtccaccttttctgatccagaaaatgttggcattaactctcattcccagctggaagcactgctttattatgactcagtggatcaatatacactgggaaccatgaactgtgataggtggcctgacaatccgatgaaaggcctcattggtttgagtgaaaatgaggttgcattgtgagactttctttttatcaaaaaggacaatttagaactttccattatacattacaaatagaaataagatggagataaacagagcaaaatgatatgttttttccctcttctgcctcacttgtgcatctttcacatcctgacagacttgatcatgctccctcaaaaccctgactgatctttttcttggcaaatccagggaaacattcgcctgctttttctaatatagaataactagtagcatgtaatctgagaagagttttaaatctcgggttaggagatacaacaacaaggataattacacgtttataaccacaggttaaaatcagattaataaataaaagtgcctagattggaaaaatcacccaccaatggtttgttacatttgcttacatttgctctcttccccattttaacacaatgtaatactgaaaaatcaaatatgttgaaacttcattttttttttgtctgatgaggtaaagaaatcatttaaaacacgtgtaataatcaagaataaggcaaacaaatctaaatgtgttagtccccggcaaaagtaatggtaatgtatcatgattttgacataaacctcataatagcaaatcttttctctacatttttcataaaatcatgacccttgtgcattcctctcatttgtttgtaggccaggagccagatggaactagccagggtgcacggatgttacaggaagcaattcattgtgtagtaaaagggtctgcaattgaaagcatttctagaattgaatgcatgcataggggaatattgtacctgctagcttcaaactctgaattctctttgcataccaccctatcagtctattgtagaacacatctgttaaagccagcatgtatgtatgtatatgtacactgggaacagtgaaaatacatacatacacacatatatatatatatatttgcttatgtctgtccagtttgtagaaaaaatcattgtgatgcccaatgaatgtgaagtgattctgccccagaatgtgaatgtgactgtaccaatgctatacatatggcaaaatgctttttgaattggatagatgcattaattcttctgaccacctatctatacaggcaaacagcattattcttgataatccacataccgttttataaagtcataatatgtaaatgtattagcagatttggggatgttaagcacccaaacaaaatactcatgcacatacagtgagatatcttacagtactactacggtgtattaatcattcagatctgaaattggttgatactgttttcttaggccagttctaaaccgctgagtctgaatattagattaatagttgaggaataacacaaaatactccatatttttcagtgttgtcaaaactttagcagttatgaatattgtcaagatgagagagattctatttgttgtttagtccagagactattttccgtgtatgatcgtatatgagatcatctcaaaatccctagcctctgctagataaagtcacctctttcggttgtgtcagttccttctaggtaaatactcagattttctgatttcctaaccttctactcttttccaaaatggcagtgggtatataatgtactcatatgatgtcatggcacggttagatgggggctcccctggctaatgttggttattttgctagtgactaccacaagattgttggttggatctctgtgccaaggacagtgacatctgagtctgattgagttgatcctaacactggatatttattgatatacactatgacatttagtgacccatctattcctttgaatggtctcttggcaaagacaccttttactgactgggccccatgatacttcttgttggctattcagagttcctgaagctggctgtgactttcttttggctaatggatgcagcagttgtgtaatagcctttgagtattgccacttatcaggaagaattcctctggctagctcccagccagacccacattcacttctaggcagtgctcttcagcttcttctcttaggctctgactgttgaatggttaggttactggggagtatgattcattaggcagaatcatggaaaacacattgttttaataaaaacaaaacagtgatttcctgtcaaagaaaaattgcactgaattgagtgaagcagtcaaggaaggctattcaaaagtattgtgacagaggtcaagagtattgggagagggattgaactcaattccattgaaacaattccgttgaagcgctgggctgagctagtggaaatacactggaggacattggggatgcgggggggatttggccaatgtgataaggccatctgtgtttgctaattggatcttatgtaagttaggctcctaccctcccacagagcctggaagatggaagtcctgtctttcttgatgattacatttcaaaggggtggctcccaggtccttgagaaagatatccctggattgtaaaactggcaagaggctggatgaagatttacacctcaaggggcagagacagaatttacaatattaagttttataaagtaaatgctgtatgaaaagggaggtcaggagcttaaagtcagaaagaaacttgtctacagttgagttgagggcaatgttaaagctgtcttcatcacatacatcactaataatgtcccttcttgcctgtgaaacaaaaattattacagttgtctacaagccagggaacaagcccttaccaggaactgaatctgccagccccttgatcttggacttctcagcctctagaactgtgaaaaataaatgtctgttgtttaaaataaataaataaagcatgtaattctataagatatgtgtattcaagaccgaattcaacaaatacttaagcccagaggtaaacaaatctcatgaattgggaacataatgctatacgaatgtgttctagcattttactaattggggaaatattaaatgatttaatcaaccgaatgtctgaaattggttttgcactttacctttttgatatactatgccctagtaatgccggcttttctaccattaagtggaaatgatgtctgttgggtacaggagagtgacttcagtttgttgacccagaaggagtgatatgagaatatttggctcatgacagcttatcatctcagtctggctagggaagataaaaaaaaaaaaaaaaaaagaaggtagagaagcaaaaaatggtttttaaatttctgggatattgccagtaggctctctccgatgcatgatgtcatttactgaaatgacctgccttcctgtaaaagatctaaatcaaaactttcagaaaggtattataatgggcttagaaagcaaaacatgggcagatcctgattatcatctgaatttccagacgttatgtgctaaaaatcatttttccaaaactactagtttgaatgaaataaacctatctgtggtaaaaacaaaattaaggcacagaatttggcatatttgtaactttattctagtcttccaggggaaacttggctgtcataaaatttgcaaatcaaatacacaaatcaaaatgcctgcatagataaagcttgtaaatatttacttttcaaagcactgcattattaaagatttcagaaatgtccagtctggcaatacaagaagtaagactgaaagtcagtctgccagtttgccatgagggaatattgattgacagcaaagaactaaaacagaagacaatttagtgaggtattattaattaagaaccttgctggggagttgaagtgaaaaagcatctctttttcatcgtatcaaaaattccaaaacaaagcaatacatacatctttgaaatgtagtttacaaatgattaagctgtgtaggtgtgaggcaattggttgtgtgtgtgtgtgtgtgtgtgtgtgtgtatctcagttgagtgcttaaacttctgtttgaaaacttcataaaaaataccgtgcatcaaagaacagtattctgtgccttcagtttgggtacagttccagctttttcagtaggttgtataaatttagaccatgttatacccacgtgactacaattttatttcaatcttatatgcagtaaatacttttttaagcacctactatgtgtccagcaatgtgctagacacttggggtctatcaatgaataaaacaggtgaagacccctggtctcatagagcttgtattctaataaatataatacataaacactaaagatactacataaaaatcatatgctatataaaaaagatggagatttctgtcaaaaatgaaaaagtggttcaggggaagacaaatgggagtaggactgcggagcagaaggaattttaaatgggaggacaggagatacaagcctctaagacagggtaatattcgagcaagagacttataggcagcaaaggtattagcccagagtatctcagagaagagcattcctggcagaaacaagagcttaatacagcttctgagatggaaaatgactgatgttcagtttattcaaagaacagcaaggaggccattgtaaatggagggcagtgaactgggaagaagaaaaagagagaaggtagagatgatatgggggtggtttaagggggcagatcattgaggacattgcaggtggcatagtgagaacttcgtctttcactctgtagagttgagagttcttgcagtattgcagtattttgtgcacaggtataatatttcacacctgttgtgtagagaatagaatctcagtgggcacaggaagaaagagagacttactaggtgactgttgcaagaatccagggttgaataatatggcctgaatcaaaggagcatccatgaaggcagaaaaacagcaggattcttaataataaagcagcaccaacagcatcttctggtggtttggtagtgtggtatgagagaaagaaaggggtcaagcgtgactcttttttttttttttgtactgagaaactggaaggataagattaccattatatggggctgggaaaggatgtgaatagagtaggattcagaaggagaatggaaaatcagttttggaaatgttaaagagatcaagtagaatagaattctccagtcttgggttcagggaaggagtgtaggcagatttatgaataagggaatttttgacacgtgggtaatgcttaaattcatcaggctaagagagatcaacggggagtgaatgcagagagaaaagaaggagagcaaaggtctgagacctggagagtctcaactttaaaagatcatgtgagataaaagaagaaaccagcaatgagagcgagaaggagcaaacaattaggtagcaagaaaattaagagaaggtgcttttgtggaagctaagtgagcaaagtctatttgggcattgagaatgatcactagtatcaaacgccacagattgtccatgtgaacaggagactgaagcctgaacgctggatttagcaacatggagttcttggtgactttgacaagagcagttgcagttgagtggcagggagtgaaaatctgattggagtcggcccaagaaggaatggggtgagaaaaattggagagtgatgtggacctatattatttgaagactgttaacattaaaagaagccaaaaaaaaaaatagaatggggtcaagagaagttttttttcttttaaaatgagaaaaataagagcatgctgatgtaacagtgtactgatgggaattatccattaaagagaatataaaaataatgaagcaggagagaggagaattgctaaagcggtgaccgtgagaaggatcagcacaagcaaggggcccaacgaatgtcttatgtaactagaaagcacggcaaacactctgcaggcacagcaggacctagcggtcctgatcttgttttcagaacttgatctcacttcatttctcaactctccttctctctcttttggcctcactcagacaggctttccacaacaatacctcctacagcttgatgcctgtatcttatcttctcagcattaatagcagaaaagagtctgttctccaaatgtcctcacaaaatcctgaaattgctccatggtcatggctcaaggtcacctgcccatccctgaaacaatcactgtggtcaaagtaggcaaggtcaagatggagaagtgaacatgagaacagaccgacagcaacatacacagcatcagtagagtcacgttctcttccagctgaaacaaacaacactggtaaaaatacaaagctattaaaaggctctaaatggtggcctggggacacggcacaccatttaagggagccaaacaaatattggtaccacgttctttccatttccttacattattataattttatgtcaagatgaaaatgatctgggcaaacttggactcttggggaaatctagatgaaatcgcatttgaaaaaaaagtaattatcttggagggaaactttcttatgacaattttaattaagccaattattttctaggaatttagatgtcctaatggtggctagaaccatcattcaattatgttcacttgtgttttgtgtccttgaacatctgtgtccttttacactttaaaatctcgaggaagaaatgtaattccttctgtctctgcagtctctacttgaataaagttgatacgtcgcctttactgatgaccaccaggaatgtctgtcatgccatttttaatattactacgggataaaggtgattcttatctatattttaaagctccaactaagagtattttttcttcactttttccttttacttccctgaaattttaagatgtgtctcccttaccagcactaaatattggtgatatttagtagatgggatatatgagtcttaaacatgattcagccagccaggtaatttataattaaatcacacagaataaattatttgaacatattcttgggataaaatatactactatgagtcaaagatagttgtaattactccaggggtaaagaatgaaaaatggggtgatatgtaaagtgacatcctcccactgattaaaatagtattaaaaataagtaatttctcacctgcactaaagtatttgcatagtattgggaaaatttacttagcctctgtaaatacttttgttttttttctttttaaaagagatgttaaagcatacttcatctcactagataattttaataattaagttaatacaacgtatacaatttctagtagcgtgcttagcatacaataggcactggataatttttagtttgcttttcttacaattcatagcaacacatgttacagaagcaagtccctcagaaatctgatgttgaaaagtggtaggcaacaaataaaagagatgctgtgttttgcggtcaatcagttacaaaattttttcaaagctcaactttgctgtgatcataactctctttggagctaatagcaataataatttttgtaattcaaaaagcactaactgccatatactctgatgtttgttgaatgtgggagaaatcaataggcacttaatatgcttttaaaatttaattctcataacaatactacagcatttaagagtcttgtgaatggggagaacttttatttttaaatgtgagttttcaggctgtaatatgaaaagttaagacatttttccatttgaatagatttatgacactattatgccaagtctcagtaacaaagttaaggtaggagaaagaggacggtggaacaggtaaaggaaacctgcagtatggggacaaataggaactggtgggggcaagactcttgtttttgttttgtgcgtaaattatcattaaccatggaagagatggggttgagaaaagatggtctttagtttcataagaattggtttcttaggatattgaatatattggcatactaaaatcacgaggtcaaataacacttaactagcagttaaaaggttttcttaataaaataaatacagtttatttgatagtaatacagagtttataatttgctggagttagtcatcactttctctgttaacaaagtaaatattacaatagtgtgtttccgagggctatgcggtttggcggtggccatacggctggtggtctaacctcagctgcagttacgtttgcatttcatgtcactagctgtcatcataggctggcccaaaaaaaaaaaaaattctgcaaagaataatcaatttatctctatcgctcagtctatctgtctagcttatgtcttccattttactatttagcatttgtcttaaaattagaacaagcctaacactctatcacacgctaataccatgtgcatctgcagagctgcgcagcttaaaacccggtagagatatttggattccctctggccaacttatctggctgaaattacttggtatagcctagaagcctctgaatttccattactttatcagtgtacctcattaatgatatagcttaatttgcataccagtagtaccttttcaccccaggtaaggaattgaaatgttcaaggtcaattaactgtgaatgtttcaagttggctggtgcagctgtaactgtgagcagcgctaggaagagggagcagtcagtgagggcttcctctttctcctgatgagaattgatgatccgattttaactcactagaatcacactgattcttttcttcttgctgcattgctgtcatgtgttcgctttttaaaatactggcctgtagaggcatggaaatgcaagagaaatactgtgaaattctggattttaggaaaacatattctcaattccagctttagaccattacaattaactagaaagggcaagaaggaaactaatcagtgttttctcaaaggtattagctgacacagatgcaattccaagtgtggaatttccaggctgagagggtgacattataggggcatttcattcaccctttcctaactttttcttgtaaacaaaaaaaatgacaaaaatacagagagatatgcagttgtagcaataagagaattcaagatgcttgattagtaccagaccctagaagtctttcaatttctaaagttttgacagggcctggagggaaagaataaaattagataggacagtggagagaaaaactcatccacacgccatgtccatcatgtgcctatacttcaaagacacggtccattgtaaactacagggagggaagttgaccctactgcctggtagcttaatcctgagcttccctgatctccaggagcaccagtgagtcttttctacatccactgggaaccactgattcccacctttgcatcctgacctatgagaggcactgcggtgtcctagttaggggcatggtgcctcttgcctgctccatggatgagggcaaagtgttcaaactctttgtatctgatgcaccatctactatgtagactgcactgagaattaatttacaaggccttcaacaaagtgcctgacacaaaggactcccttgctcagcaaatgtgaagtaatacagtattagaataagtagaggaggatggatggtgtttcatcacatcctgaaaaatgaaggatggaggaagcattgattcagattttaaaataatgccccaggagcagttcccgcagagttcaagaactccccgagctatttgtgggagggtgctatttaaagtgtgcttcagatcattcaagaacacattccgtataaataacagtctgcaagggtaggaagtacccttcacggacagcagggccatgctaaacaaatgaccccaagacaccaagggaccatgtctatgcaacaagccctcttgcttaaaagatgagaatattctgctttataagcataaaggtagataatattggtgtacaacgaaactgcaccccaaatcacaggttctttaagaacaaatacagagaaaattaaaagtcaaaacgcataaacaaaacttgtagcatgtaaaaaatttctggatccacaaaagaggaagagcattgtgcttttgacacatggagtggaatacagttttgaacaatgattcacttgaagaaagatggaaatttgatgatgtatctaattctaaagacagtatagtaagaaacagggattatacctgaatgcaagcagtcattagtgtgatgccatcaagagaggagcttcttgtaatataatgtttaaaaagaatttcaacttacttattttagattaaggagtacatgtgcagtttgttgtaatgcaattttttaaaatgctgctttgacacagttttgaccccggccaggactggtcactttcctttcttagcagctgattatgtccatactccaaccacttcctttattaggttctcaccctttgcggttgttaagcatcattgctgggacaggtaccagacaactaggggtgtcctagtgcctcctagataaattgttcagattagccaattcacaggaagcccaccaagcctagctagctagccctatcctgcttgtcatacagaagctgcctcctacagctccagtttacccttatgctgtcctctggtgcatccccatgtgtggtcctgcctggcgtcttctcttgttagtagttgtaagtagcagagttctgcccttcatctatcagagtatcattatgctgtgttccaccatcaaaataatcttgaagtcttataaagtacttgtcaacactggtgtgtgccttcaggtcctacaatggcatacgccctaccataacagcaaacatttattgagcatttctttgaattaggtcttgtactcaaggtttcataaaatgggtcatgtatgccaagaataatgcttgaatcaaaactatataaattaatggtaatctgtatctaaaattccagaccttattatcagagcctcaaggtgagcagcaaaagaatgggggaagaaaatgtgctaacattcttatttggggtgctatataattgatgtggcattttaataaacattaaatgttagataatatggattcaagaatgagtcaaaccctatttcgtaacttttacaatgattatatgttacttacataatcagcaatgttaaataattcttaaaataattccccaaattattatattaaactggaagaatgaagcatcttaacacgatatacaggagtcacatctacagtattttggtgtgtgttggatcaaatataacacagtaaattatgctgtgcacattacttctttgaacatacatcacaacttgtattctttacttctgagtgatcaagcacagcttgctctatgatttccttggttctcttttcccccatcctcttacccaccaccctgctcccatataggatagaaacagtggtgtgttggtaaactggctggggtgagggcaggtgcttatttgcagagtttgcagtttccgtggtttaaatactctcatcatggccaattgcaaagatggttatgtttaataactagcttgcaaaattgaaaatttaatgattgtctctcacaaactgttgggaacaagctccaacccaccactggatagagttgtgttattttctcctgcaaacacgccatcattaatgtgtgtttcaaatgtggttttcaacatctgtccctcccaaaagactgtaaacatcttgaggccaggaactatttcttgacttttgttttcccagacttaacaatgtcctcccttctctaagtctaaacatgatcacaagtagatttttagttccaccacagctttagttccttcatagcttgaagttacttccttacatccagtcctgggcaaaggggtagcagagcacaccattacatgtgtgcagtagacatgctagtaagttcccagtgttggcaggaatgttcacctatcatattaaacattttaaatattcagcaagacccctagttctcccagttttagaaggctataaaatctagaaatgaatacaattaattaacatagacatcatataattatactaaattcttacctctatatttttctacaattataagaagtttcatattttggatatttaagttccatagaggaatacagtcgtactggcatttctttacaaacatagatttttaactaactttcctttctcaattttctcctgtttctatttttaataaaaggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctgggtatgttctttaacaaaagacatagtctctcggggaaaaagtataatcagtactgcatcttgtttaccaatctcttaaattaagtagacatacagaatctgcagacttacattgaaaacattttccaagagaaaatatggtaaataatcattttccaatacattttatggtaaatttatgagaatactaagggtaaatttatattacagggttctcaaaaattgaaaaataaaccctattagtccattaaatagtgtgggagtctaagaaataaataagacttgtataaaaaaagttttgttcaaaaacataatagtcttgcattgtcttttatttatttatttatttatttatttatttatttatttatttatttatttttgaaacagagtctcactctgtcacccaggctggttgcagtggcgcgatcttggctcactgcaacctctgcctcccgggttcaagcgattctcctacttcagcctcccaagtagcttggattatagtcgcccacaaccacacccggctaatttttgtgtttttagtagagacgggctttcaccatgttggccaggctggactcgaactcctggcctcaagcagtccacctgtctcggcgtcccaaagtgctgggattataggcatgagccactgagcccagcctgcattgtctttatttacaattagtcaaaataatttgttccttttatttcttctgataactgagatttttgaaaccctgtttctttctctggtatatggggatttatatatataatatgtggagttgtatatgtatgtatatgcatacacatgtacgcatatatatgatttatctgtaaacccttctctagtctctgtaaagtgtataaatgtgtaaattgctgtgtgttgtaaacagtggtgcagctcctataagagggagactgggaaagaggcattttgtgataaagtgggtgatatttgtagttgattgataaataaacctggatatggcatataaacacctgatggaagaagaacctaaaggatgtttgtttgataacaaaggaaagacttctttcttagtgcagaaaaatatttgtttggatcttatgtgggctaagaacaatgtactgcaatcaaagaactattctcccctctctggctgagttgctggaactagagaaaatgggttacttaatgaagcgtcattcttagcacacagataatttggaagcctatttgggcacataatgataattttctttgaccagtcagttgcctgttttttgaaacttcatagaactccgttatacattataaactcattgaagaaatggactgtgatttactcacctttgtatgtttaaagctcttggtggccattcaatccatgcttattgatgtaaattgaattgagagaagtagccctgctctttctctagagggaacaacagtgggactagaagaagttgcctataagcagttttaagaaaagctgtttaaaatccaaagcaagttgaagctgtaagaggaaaaaaaaacaaacaaaacaacaaaacaaaacacacacacacacacacacacaccccaaactccaaacactgggtattacgttcaactaattccatgaaagccactcaaactagggataaaataaacagtaattatgaaccaataacaataaaaacttaatgagatatttatttaactagatgtttggattatcttctgctcttttttgaattaagcattggaatttaacctagataagtagtggctaatgcatgctaatatttaggtatgttaattaaaatgtatttttttaaaaagtgatcaatcaggaaaattgttgtacttctgttaagcaagcttggggaaagccaaacccaggcactgccatttaccttacttgcttactcttattaaagttgaggcgctcatggtgaaatggtggcatgaatgatatccttactagtccaaaccagtaaaagtaaaaacatggcgtctatcataatcctgttaaggtaacattgctttctagactctgctgtaatttgttgatttactcagtgtcttcccttcttgagtgtgagctctgtaaatactgtaccttgcgatcttttatctcaatatccccaaagtgtaagagcacctggcatgtcacagtcaaatattaaatgtttattgaagcaatgagtgaataaaatgcactttcttgtagaatactcttctgatcactctaaaagtgactctctcttgcctccatcagctcttctttttattatattctatttaataccaatttaatataccagttagaatggcacatttttcttttccctatagatattgaacttctttatgggcgagattttctttttctagtcttagcatttctggtatccaacatccagtgtggcacatgacttttgctgcttaaataggtgaaaggaccaataaatgaatggatgtgagtatgtcagtctgctaatctgtgcctatctttgtccaaatttctggaaggtatcaaaagtttatgttaactcactgaagaaggctgggcgttttggctcacatctgtaatcccagggctttgggaggccaaggtggaaggatcacttgaggccaggagttcgagaccagcctggccaacatggtgaaacctggtcgctactaaaaatacaaaaaagttagctgggcatggtgacatgtgcctataatcccagctacttgggaggctgagatgggaggattactggaacctgggaggcagaggttgcagtgagctgagattgcaccactgcactccagcctgggtgacagagcaagactccatttcaaaaacaaaacaaacagcaacaacaaaatcactgaagagataaggcatatcagagcaaaacaaagaaagattaagcggaacatgcaaatattagatacagattcctaagcatttggaaatggacagaatatggagatcattgtaagctgaatttgtcaaagtagtaaggcttacataggtcttgaagaaagcattatagtttagattatggaaggattaaggaggctattttatgaagctggaaaggtgtgaaaaaagcatggacattggggatatccagagttatggtttcctgtgtaataactagtgagattactggtcacattggactatcaagttttggaaagactggaagataatgttggatctggcaaagaaagttgacagataactttaaatgtcaagatcaaagttaagacttagtacaatagacaccattaccacacataacatagctaagttgtagtgtagataaaacaaccccaagtctctgaaagtatacgtatgtgtgtgtatatatatatatgtatgtgtatatgtatgtgtgtgtatatatatgtatgtatgtgtatgtatttcctgttaatcctaggtagcttcaaagttttattctattccatagttactctggtcccactctaaaggaagctctctgtgaatcgctaattgctgaagcaggaaaattgaaatatggtgaattgtgccctgtctcttgacttttctgcctggaagaacacagaccacttcaatttgcattttttaagcagaagaacaatttcaaattgatgtacatcataaaaaaacttaaccctttgttacattttacaaatgtgtatttcccaactttttgttttctggctcagtttttgtaggtattataggatgtataccaattatacaaaatatgccaatttcctttaagagcttcacaatctgctccacatgatgcaaataagtctacgaaagagagttaggaaacacataaggcattatacaagtatgtgatagaaaaacaaaagacaagtgttactggtttaggaacaaaagcaataaaaacaatcaacacggattgaaatgctgcagggaaaattcttcattctctcctcatttggtctcactttgaatgccaggcagtacaatgacttctacatacctgaaataattaaaaaaatgctctgccacttcttacaaataatccctaagaggaaagacagaatattttacagtctatacagatcatttaatagaaatgcaaacttgatagatatgtgatattttaaaatattacacattggaatatttcttcagtgaaaaatttatagtgcaatgttcataaaatataatttatacaaagtattctgctgaatggcaaacaaatattttatgaaaattcagaaaatgcaagctaaactttctcctctcagattgaacacaaaattcctcaacatctataataaaaaggttctcttcagtttattgtacatgattgaaaaagtaaacataaggtataattttcactcacttaagaacaattgctgagatatcgtgaaatcaacatcttagaaattattttaaatagataacatgtgcaggaactttacaggcaaattctccaaatcctttatggtaaatgcctaagattcttttatactgcagactacaagggcaatgaatgggttggtaccaatcttataaactgagtaaatatgattgttaaacccaagaatagtttgctttatttaaaatagacttcagttgtacttgatttttcaaacaaaaacctttattgcctatatgaagttagtatctctttgttttttgttctttaactagaagtgtctagtgtcatggttctgggtttggctggtgaaagacacagagaccctgtggcatggtgtagtcagtgaggcagaagcactacctgtcacaaaatattcaggccattattatcaccgtgaatgattgaggtgtcaactctgtaagccagacagggtagaaacactacctgcaaagatttccacatgcatttgttttaagtcaaataagggcctagggatagtttaatagaaaatctgaggaggcagaagtgcaaaagagatataagctgtagggtaggtgactctcctccttgtgagtggcatttttccttccttatgttgagcccttattctcttgacctaagcctacaagcagcatttgtggtgatagaagttgtagcaatactaacgccaagtgtgtgaacatgtcaagctgtcaaacttaatgcactgcagtacttgcttagtacttggcaaatgcctagagagtgcctgcagctgcttttatctttcaagagactgatccaaaacatattttaatgaaagtctacattattagtctaaatcttcaggaagtttcctgtttatatttctatttagctccacattctctagcttttgaaaatgattaacctgctaatgcctggttaaaacatggctgcatttttttttttttttttttgagatggagtctcgctctgttgcccaggctggagtgcagtggcacgatctcggctcactgcaagctccacctcctgggttcacaccattctcctgcctcagcctccctagtagctggaactacaggcgcctgcctccacacccggctaatttttttttttttgtatttttggtagatacggggtttcaccacgttagccaggatggcctcgatttgctgacctcgtggtccgcctgcctcaacctcccaaagtgctgggattacaggcatgaggcaccgcgcccggcccattttttataattgtgttaaaaaaaaacttaacatgaaatctaacgtcttgacaaatttttaagtgcacagtacaatactgttcactataagcacagtgttgtaaggcagatctgcaggactcaatcgttttgcttaactggaacatttaatctgttgaatgacacctcctcatttcacccttttcctatcccctggcaaccatcattcaactttctgcctctatagatttgactattttagatacatgtacctcatatgaaagtggcaacatgcattatttgttcttctgtgactggcttatttcacttagcgttatgtcgtcaaagtttgtttgtgctgaaagaattttgaggcagaatgtgctttctttttttttaaggctgaggaacattccatttcatgtaaataccacaattttaaaatctattcatttgcctatggacatttaggttgttgccacttcttcgctgttgtaaataatgatgcaatgagtatgagggtgcagatgtctctttgagatcctgatttcagttcttttggataaatacctgggatcaggattgctgaatcacatggaatttcagtttttaatttttgaggaaattccatactgcatgctgttttccatggtggttgtaccattttaaatttctaccaactatgtactagggttccgatttctccaatttcttgtcactgcttgttatcttttgttttccttgtttaaatgacagatatcctaacaggtgtgaggtgatatctcactgtggttttgatttgcatttccctgatgactggaaatgttgagtatcttttcaccaacctgctggttatgtgtatatcttctttggagaactgtctgctcaatgcttttgctcatgttaaaatcaggttttttcccctttttatgctattgagttggggaagttactgatatatttttactatactattattatatatttagtttatacatactaacgataaatgatccaaaaaggaaatttaaaacatagtctcatttagaatagtatcaaaaagaataacatacttaggaataaactttaccatgggaacaaaagagctgtacactgaaaactacaaaacattgctgaaagaagtgaaagaagaaccaaataaatgaaaaaatttctgtgttcatggattagaagacttaatattgttgaaatgtctatactactcaaagcaatctatagattcaatgcaatccctatcaaaatcccagtggcattttgttacagaaatagaaaaaatatcctaagatttatataaaaccagaaatttaggtagaaccacaaacatgttttttgaatatccaaaacaatcctgagaaagaacaaagctagagacatcacacatctgatttcaaaatatattacaaagctacaatatggtgctggcataaagacagacatatagaccaataaaacagcataaagtccagaaataaacccatacatctatggtctactgatctttcacaagggtgtcaagaacaaacaaaggaacagaaaaccaaatactgcatgttctcacttataaatgggaacatagagtgcatatggagataaagaagggaagagtacacaccagaacctaattgagggtggagggtgggaggagggtgaggatcaaaaaactacctgtgaggtactatgcttattacctaggtcacaaaataatctgtacataaaaccactgtgacatacaatttgcctatataacaaacctgcacatgtatgcctgaacctaaaatagaagttaataaaataaggaaaaaagaatacacaatgggggccaggcatggcagcttatacctgtaatcccagcattttgggaggaggaggaagtatcatttgaggccaggagttcaagaccagcctgggcaatatagcaagacccatgctctattaaaaaaaaaaaaatagacaatggggaatgtatagtctcttcaacaaatgctactgggtaaactggatatccacatgcaaaacaatgaaattaaacccttatcttttttttttttttttgggagttggagtctcactcttgcacccaggctggagtgcagtggcagtggatcccggctcattgcaacttctgcctcctgggttcaagtgattctcctgcctcagcctcctgagtggcagggattacaagtgtgtgccaccatacccagctaattttttattttcagtagagactgggcttcaccatgttagccaggctgacctcaaactccctaccttaggcaatccacccaccttggcctcccaaagtgctgagattacaggcgtgagatactgcgcccagcctggacccttataccgtatgcaaaaattaactcaaaatgggttaaagacttaaatggaaaacctgaaactgtaaaactgctagaaaaaaacgtacagaaacagcttcacgacattggtcttggtaatgcataaatatttttaaatataccaaaagcacagacaacaaaatgaaaaataaacaagtggaactacgtcaacaaaaaccttctgtatagcatacaacaaagtgaacaggcatcctaaagaatgagagaaatatttggaaaccatgtatctgatagggagttagtattaaaaaagcatttgggttttaaatatgacctcaatcacaagtcaacacagttagtttgctaggcatcttcttcattaagtagtgtcggtggctctgtttcatctctttgcatctgtgcacattctatagcatgttacatcaatcccttctcataaacttctgtgaggtgcatgtatattggagctttaccttaatatataatatacaaaaaaatacatatggcctgtaatcccagcactttgggaggctggggtgggtgcatcacttgagcccaggagtttgagaccaccctagccagtatggtaaaatcctgtatctattaagaatacaaaaattagctgggcatggtggtgcacacctgtaatcccagctactctggaggttgaggcatgagaatcactagaacctgggaggtggaggttgcggtgagctgatatgccactgcattccagcctgggcaacagagcgagattccatctcaaaaaaaaaaaaaaaaaaaaaaaaaacagaaaagaaaaaatatatgaactcttatgagctgtagatacacatagcaatgtgagataaattgtgatattgcttcacagtctttaaatggatctgtttgtaagcaagcaaaaaatttatttgaagagagggactagagttaacagggaatttaatttggtgcctcttcagagtgtacacccccattccagttcattttcaaataatcaacctgagaacaacatttttaaaacacttgataacttgtatctcacattctaccatgtgacaattcaatgacaacatcactcccttttctctattccctcttaccacggctgcgatactgtgtcttagacatctgctttttggctgcttcattccccaggaggctacattttgcatttttcaatcttggaagcagttctgttcctttgaagtgtttcttcattgttccttaggacctagacaaaactaatacttcccattcactttgctaattttccatctttaatttatatactttattaagtatattttaaatagagacgagattaaaaaatatttacaactattctgtaggttgcctgttcagtctgatgatagtttcttttgctgtgcagaagctctctagtttaattagatcccatttgtctattttggtttttgttgtcattgcttttggtgttttagtcatgaagtctttgcccatgcctaggtcctgaatggtattgcctaggttttcttctagggtttttatggttataggtcttacgtttaagtctttaatccatcttgagttaatttttgcataaggtgtgaggaagggattcagtttcagctttctgcatacggctagccagttttcccaacaccatttattaaatagggaatcctttccccattgcttgtttttgtcaggtttgtcaaagatcagatggttgtagatgtgtggcgttatttctgaggcctctgttctgttcccttggtctatatatctgttttgatatcagtaccatgctgtttttgttactgtagccttgtagtatagtttgaagtcaggtactgtgatggttccagctttgttcttttgcttaggattatcttggctatgtgggctcttttttggttccatatgaaatttaaagtattttttgctaattctgtgaagaaagtcaatggagaaactaagatttgaagtggatacaattatatttcttaaaaactctggccaggcgttgtggctcacacctgtaatcccagcactttgggaggccaaggcgggtggatcacgtgagatcaggagttcaaaactagcctggccaacatggtgaaatcctgtctctactaaaaatacaaaaaattacccgggtatagtggcggacacctgtaatcccagctacttgcgaggctgaggcaggagaattgcttgaacctgggagactgaggttgcagtgagctgagatcacgccactgcactccttcctgggggacagagtgagactccgtctcaaaaaaaaaaaaaaaaaaacctaagagaatcatctgggtaattactttttataaaggtaattcagtaatgcttctaacaacaaaattaatttttaaattcttaagttctcttcctagatataaataactacatggacaatgtaaaagaaatacaaacgccatttgtaatagaatccaaactagattagattggaagttgggtttattatttattgatttgcttaatttatcttcatggaaatatatattctgaagctactcttgttgatcctgatatgcttttttgttattgttgtcttttatgttttaattttttgactttaagtttttttatctttgtgcatttacatttacctttttagtttcgtgtcaaattataaaaaatttgctgaaatttttttaaacttttaggttcagggatacatgtgcaggtttgttgtatagttaaactcatgttgtacagattattttgtcagccaggtactaagcctggtacccaatagttaatttttctgctcctctctgtcttcccaccctccattctcaagtaagccccagtgtctgttgttcccttccttgtgtttatgagttctcatcatttagctcccacttataagtaggaacatatagcatttggttttctgttcgtgcattagtttgctaatgataatggcctccagttccatccatgttcccaaaacagacataatctcattcttttcttacggctgcatagtattacatgatgcatatgtatcacattttctttatccagtctttcattgatgggcatttatgttgattccatgtctttgctattgtgactagtgctgcagtaaacatttgcgtgcatgtgtctttgtggtagaatgatttctactattctgggtatgtactcagtagtgggattgctgggtcaaatggttcttagctctttgaggaattgccatactgctttccacaatggttgaactaatttagactcccaccaacagtgtataagtaatccaaaaaatgaaaagatatcaaggaaaaaaatgtaatagaatatgtacaagaaacaaaaaaagaactatttagaatattactaaaggacatagaagaacacttgattaaatgcaaggatgtatctgcttttgagtaaaagataatattataaagctattcattctccctaaaatcatccatataaatgagatcattctgaatgtcatatagaaaaatgtatatgagaaataactaagttaattagcaaaaacaataatggtaaggagaatttacatgttacaaaaaatttattaatatatattaattaaaacttattgatactggcacattaaaatatggtataagaacacatgggacatctgttactatgtccaaatacatttagggatttgcataaaatagatacagcattgaaaagcttaatacatatttaaggaaatatgtattagtcaatatggaaatcatagccttctagaaaagtagataacttgtttatatcaaaatagatttaatataaatatttaaaagtaatacagatgcagaaaaaagtattaaaagaaaatataggacaatgtaaagatacacatgtaatattggacggggcctgtctttctaggcaaagggaaccaaacccaaatgccataaaggaaaagatgaaaaattagataatatatggaaggctgcataaaaatataacatatataacataaaagaaagggtatacattgggaaatatttttagcctatatgatagcaatgcccacatttattcagcagcagcagtggtctttggttaagactgacattctgactgactgaataggcttcattcagctacatatttacttagatttaaaaataataaagggcaggcaaccacacagcatgcacagcaacagcataatagatgttcagctatcatgaacaacttttaaatatcccaataactgtcactggcttggtgggtgttattgaacaacttttaaatatctgaataactgtcactggcttagtgggtgtcgccaccacacatcaggaaagccatcagctccaggggtccttcagctcttacattacattagtgatgtaacttctcagggatacttgccaactgttctccaatgtagctggtatcttatcagtcctaggctattcactgatttccaggttatgtctgtgatagctaaatttcactgtgcattctaattctggtacctagggagactgtctagaggtgggagcccagatttttaaattagaattttaaaaatattcccaagtgatttcaattagctgcaaagtatgagaaacattgggttgctcagtaatcttgacaaccaggtacaggtttttagttcagtacaaaacataccagcaggatatccattcatcttagattctcctgcacattctttgagttaatgttgcaagaaggatttggctaaagataaagagtaggaaaaaagctacagcttagagattaactctatattcccaataataatgacacaattttcttaatatccaaatctctgcttttacatgtggtagctactagccacacagggtcactgaaaaggattataagttattctactataaagatacatgcacacgtatgtttattgcagcactattcacaatagcaaagacttggaaccaacccaaatgcccatcaatcatagactggataaagaaaatgtggcacatatacactgtggaatactatgcagccctaaaaaatgagttcatgtcctttgcagggacatggatgaagctggaaaccatcattctcagcaaaccaacacaggaacagaaaaccaaatacagcatgttctcactcataagtgggagttgaacaatgagaacatatgggcacagggaggggaacatcacacaccggggcctgttgtggggtaaggggcaaggggagggatagcattaggagaaatacctaatgtagatgatgggttgatgggtgcagcaaaccaccatggcacatgtatacctatgtaacaaacctgcacatcctgcacgtgtatcccagaacttaagtataataaaaaaataaaattacattaattaaattaaaaataaagctcctcagtttacactcgccccatttgaagagctcaatggctgcgttagaccagtggttactggattagacagaacagttatggaacacttccatcatcacaaaaattctcaacatagtataagtatgaaactttctaaaaaacagtaaaaaataaagccttagttttttttgttttttcgttttttggttaaaaaaaaaagagccattatataaacaggcagttcatagaaaggaaaaaatgatatataaatatataaaagtatcttcaacctcattcaaaatagaaataacacatcctaaaagattggaatgaaaacatttgaaactgcaatattttagacattattttccaatgtgtgcaatataacaaaataatacgttctttcattttaagttattcatttcatataatttttctttaaaatttttaagctactgcatcacacccatggtattatggttactgctgtttaatacaagatagacagggttttccagagaaatggaaccaagtatatacatgaaatgggaactggtttatgcaattatggagaccaagaagttctaccatctgctgtcttttagcaggataaccaggaaagctggtggtctaatttagtctaagtctgaagacccaaggaccagaagctcagatgtccaaaggcagaagaacatgaatgcttcagctcaagaagagagagccaggcacagtagctcatgcctgtaatccctgccctttgggaagccaaggtgggaggattacttgagcccagaagttcaagagcaacctgagcaacatagtgaaactccatctctacagaaaacacaaaaattaaccaggtggggtggtgcatgcctgtagtcccagctactcaggaggctgaggcaggaggatcgcttcagcctgggaagcagatgttgcagtgagctgagattgtgccactgtactccagtctgggcaacagagtgagaccctgtttcaaagagagggagggagggagagagagagagagaggatttgccctttctcctccgttttgttctattttagccttcaatggattggattatatctgcctacaatggtgagggcaggtctctttactcagtctaccaattcaaatgcaatctcttctggaaacaccctcacagacatactcagaaataatattttgccagctgtctgggtacacctttacctagtcatgtggaaatatcaaatgaaccctcacataaacaatagctatctcctacttgttatacgataatatctggtaacatttactgatagaataaagcgtaccttggttgtcaatacaaagcatcacaacagattattgttcaatattttagtagtttaaatccatatatatagctgtgtgggtttcatatgtgcagcatgtcatctaatctgagtgtattctgacagaaaaaaaaaaatccttagttctggttctaaattgtcctctgcgccagtgccccatcagagaaacaagttacctcagaatgctagaacttctgcaaggactgccctatagaattatggaagcagtgggtatcttttgggggctggagccttgtaaaaggctcagccactaccaagtagcagcctgaggcagagcaaaagtgggaagaaataccctggttcctcccttcctttcacttgcagatctttttcaagttcccagctggaagctccttaatacaggagcctgggacacagtccacgtcactcagccctctaatgttttgggtcagagcagggaaagggtgacacgtggttctaagtgaaacagaacgatgaggacagcctgaagaaggtatgttactaacgacaaattgcctctatgagctgctttttctttgcttatagaagaggatgcaggcagaatccaagtacttactgagtgattcctcattccctttcagttttgaaattgcatgcttccctttcaacccataaagaaaatagatcaatattttgatactgaggaaattgagatttaagataagtttccccctaaatttatgttaactagtgccacatgtataaaatgttacatttagcgctcttctgtcctggtaatatttatgagtaggcaaagctagccaagaacagtctttcaatgtcctgaaagaagggaatccatgaaaaatgctgaaccattggtttagggtcatttttgccacataatcgacactgagtaagtagagtggtgctctccttaatcaattatcgattcaattctttatttctcaaaatatgtgttagagttcaaaacatagatttgctttctatgtgggaaaaaatagcaaacatcttacagatgatcaaacatcaaacatcttacacatgagctccagagttcactgaggaggaccagggtatatatgtaccttaatacacatctgttttcgttttttgttttgttttgttttgttttgaaatggatcttcttctgtcgcctgggctggagtgcagtggcacgatcttggttgactgcaacctccacctcccggattcaagcgactctcctgcctcagcctcctgagtagctgggattacaggtgcgtgcctcccgcctggctaatttttgtaattttagtagaaacagggtttcaccatgttatccagtctggtctcgaactcctgacctgaggtgatctgcccacgtcagcctcccaaaatgctgggattacaggcatgagccaccacacctggcctgttgtcacttctgggacaaggttacaacacacacttggtatgcaaaggaaagcacattactaagttttattgaaatgttttgcttagctggaagatcttatggctctgtccagtcctaaccttggcatatttcactgatggtttccttgtgcaacacagctccaagctcaggtgtttaattgttgctcttaagacattctccaaagtttcttgtactttcctatttctcttctgggtgatactcttcagttatctaaggcatgtctgccaaacaagctttagttcatccctttcaatcagggctttccaaacacaatcaagtcacttacctctcaggtccacttttgcccctcacttttccaatattcacttaatcatctctaagttcttacttccaatgacatctgtgatagtgttatttccagggagtctctgcattgctttgcagggtttgtataactttaatcaaccgaatttccaattcacccatctatttttgttctatttcattctacttatatgttggctgataatggttgtgttccagcccaaatttttttttttttttttttgagacggagtcccactctgttgcccaggcttgaatgcagtggcgcaatctcggttcactgcaagctccgcctcccaggtccatgccattctcctgcctcagcctcccgagtacctgggactacaggcgcccgccaccaggcccagctaatttttttttttttttgtatttttagtagagacagagtttcactgtgttagccaggatggtctcgatttcctgacctcgtgatctgcccgcctcggcctcccaaagtactgggattacaggcgtgggccaccgtgccctgctggtcccaccaaaatcttatcttgagttgtagctcgcatgatttccacgtgttgtgggagggacccaatgtgagataattgaatcacgtgggcagtttcccccatactgttctcctggtagtgagtaagtctcatgagatctgatggttttgtaaagggtttcccctttcgcttggctctcattctgtcttttctgccaccatgtaagacatgccttctgccatgattgtgaggcctccccagccacatggaactaagtccattaaacctctttttctttataaattacccagtcttggatatgtctttatcaacagcatgaaaatggactaatacattggcctggtttcgaattatacctttgacataaataattactcaagtgctactggctaaaatgcatactatgtatattatctttattgaaaagtgtacctatttcttaaggctatgaattcccagaagatagaaactccatgctttgttgctaatgtggtttcgaagagatattgataatattatttgagtataaagaaacacttttcatgattacttcgaatctgaaatacaataatctgatgtgtctgctggtttacagcacaggggtcactgtacaaactgagactatgagggtgtacatctgatattccacataaatatgtgaatatattccatataaataggtgaatatattccacataaataggtgaatatattccacataaataggtgaatatattccacataaataggtgaatatattccacataaataggtgaatatattccacataaataggtgaatatattccacatatatatgtgaaatatattccacataaatatgtgaaatatattccacataaatatgtggagtatatttcacaaaaatatgtaaaagaaacattcttagtcataaaaaccaggacttgaactacatagctttatctatccatattcccaattgcctttataagtcatacctctaaattggccttgtctaagattttttctttttattattatctgcactaaatttactcctttcagaaatgttcacaaaaaatactttgggtgacttagaagagccatggttttaggaaaagattcaaatgttaggacatttgtccagaagtagctatgagtatgaaaggaggaaactggacaggcgcagtggctcatctcatgcctgtaatctcagcactttgggaggccgaggcaggtggatcacctgagctcaggagttcaagaccagtctggccaacatggtgaaaccctatctctactaaaaatacaaaaattagccaggcatggtggcaggcgcctgtaatcccagctacttgggaggctgaggtgggggagtcacttgaactcgggaggtggaggttgcaatgagccaagatcacgccattgcactccagcctgggtgacaagagtgaaactccatctcacaaaaaaaaaaaaaaaaagaaaaggaaaggaaacaggaagccaaaatactaagacatagcctacagaattgtgtctataaatcagagagataagagatacagtccaaaatgaatcacttgttttgtgtctaacaaataaaatttgtaattggcttttgaataccattctttcattttgggttgcttcatgttaatttctcatactgaaacgttgtctcccttttgaagccatgagcattttaagtacctaataataggattctttttcagtaagtgagagaggagagaaaaattgctggagcagtgaaaagacatcctcagggggcaatcactttattacattatgttcagaataatcatgaatttgggtcgggctagagaatatcagtttcagagaaaagaatcttctatttattttagcgagtttgtggaaagttgcagaaaattatcccaagagctacaaagcgattatgttactaattccatctttgtactctaccctgaaataatgtaaaaaaattaatatatcactttgaaaatcaatttctgatccttaaatcagaataaatacatgaattaattaaactcacagggaactgtgctcaccttaaaactctttatgtgaacaatgataggtaaataatgaaatttatctggattggaaataaattggtctgtccagccttcttgttctcataaaatcaaattctttgtatttatgtacacacaaacattgaatttccgtgtacattactctcactttcttagtttgcatttttcaaaatttttagtctgtgaacatttaatccatctaagttgaataaagtatatacttgactatgacactattattattattattattattattattattattattattatttgagagaagtctcgctcttgtcccccaggcttgagtgcaatggctcaatctcggctcacagcaacctctgcctcctgggttcaaatgattctcctgcctctgcctctcaagtagctgggattaaggtgcctgccactatgcctggctaatttttgtcttttttagtagagatggggtttcaccatgttggccaggctggtctcgaactcctgacctcaggtgatctgcccgccttggcctcccaaaatgctgggattacaggcgtcagccatcacgcccggccagcagaactttttttaagagaaattttcaccaagaagaaagtactatttgtgtgatttaaaggcacgtatttactaggtgcagtggctcatgcctgtaatcccagcacttttggaggttgaggcgggtggataacttgacgtcagaagttcgagaccagcctggttaacatggtaaaaccctgtctccactaaaattacaaaaatcagccaggcgtggtggcatgtgcctgcagtcccagctactggggaggctgaggcaagagaatcacttgaacctgggagggggaggttgcagtaagctgagatcacgacactgcactccagcctaggtgacagagcaaggctgtctcagaaaaaggcataaatttatgaaatatatttattctatctcgtcctactttgaatattgcatagggctttgcactggggtcttttgtcatgtaggaaagctgtgcgacttttcacgttctagcacacagtagaacaaggttggctcttacctttgctccaggaaaagtccttgtgaatcattctcttctctcctccattgaagtccccacccccaggctcctgcatcagaagtgtagtaaatgtgagtagatctaataatctggggctagggtagcaaacatcatgaacacattgtctcattttctgcagggaagtttacattggctatatggaaatagtgagcctccttctgttgtgtgagccaagagtgacttgaatagtcggattgtcagttcaaggtcagtgctggagccacagcactaaaaagaaagatgagatggaaggcgatgaatagcagttaaggatgtcatctctgttatcagattgcatgcattcagatgcaggctccatctcatgcaagctgtgtgaccttgggcagttgcttttacctcctctgtaaaataagcgtagcaatactatacacatgaaagagtttgtgtgaaagttaaatacaaaaggagacaagaaggagcaggagaaagaggaggaggtggaggaggagagagttagggggagggagagaaagagtgaggaagagataaaggggaagggaaaaaagagggaaataaagaaaagcaagcaaggaagaaaacctttatgcaattaaatgcaaaaaaaatacaactcatgcaaaattaacatagatctgaggttatcagcaattcagctaaaaggtgagagtagatgtctcactgagtgcagcggttttcggaaaggaaatttgatgtggagtggaaaagagaaaacagcaaatactaccccaagagaaagggaaaggactgcctaacataaaggccattcgagagcgtatgtgatggagtgagaggattcaaatcacagttggcttggaagagacatgtcttcttattataaaggaagaaaaaaagtaaagacaggtttagacttcagtctatataaaggacctttcatatgcaaagagatcgtatatttactgagagcaaagagggaggtgtgagaatggtacctccttggaaaagtatccccacacagtcggagagcccagcgttggccaaagggcatgaacaggtcacctgtgcagactgtgatatggccttctgcagctgtgtgcaactgtgcatacacaggaactgagggcatagacatttaggacccagggttggaatccacagggatactgtgatggtaggacactaggacaaggacatataggggctggcaagagcatggaggaagagaagtaccatggagtcagaaccatgtagaaaaggaagtgaagtcagggagggtgaggttgataggagattgtattagttaggattctccagagaaacaaaactaacaaggtttgtgtgtgtgtgtgtgtgtgtgtgtgtgtgtgtgtgtgtgtgtgtgtacacatatacatacatgtatggaggttgggagagatgggagatttattttaaggagttggctcgtgcaatcgacaggcttggcaagtccaaaatctgcagggtaggctggcaggcttaggactcagggcagagttgcagtttaagtccaaaggcagtgtgctggcagaattccctcttattccagggaagtcagtcttttttttcatatattgagaccttcaactgattagatgaggcccacccatactatgaagataatttgctttacttagtgtctatggatttaaatattaatctcatttaaaaatacctttaaagaaacatctagaataatgtttggccaaatgtgtgggtatggtagcctagtcaaggtgatgcataactttaaccatcacaaagatggaaagtgtctaaggaagcatggagttactgaggctgaaaagcaaataaaaatggaatgatggaagagagtcggaaagattcagtggtctatggtggaagaatagaatatacacgtttataatttcaaagatggtgcaatgctaggaaatgattaagaagaaggtgtgggcagggaagtgttgaagaggagtctgtgaaagtcatttagggtgttttatgggtcaaccacaaggcttttgaagcagagagttgcaaggggtgtgaagaaatgacctgtggtttgccagaggacctcagtctggaggggcaaagtttgctatcaccagctgacactcataaaaaaggagaataaatgtgttttctctccctcatttttttcttttggcacctcatttttacaaggaagaaataaaaattctctgtaattgacagaagaactataaaaatgcttactgactccatggaaatatagcatgtgggaaaagttagcacactgcaccttaggtcccagaatgttcatttggatttcaggtgggatgaattcaccatgctagtggcattatgcaaagctttgtctgtgcattgtcccacatttcatttttctagaagaataaattaaagttttcaggagttacacacctctcacaactaccaaccagtacctgctggagtctggattagaaacccaggctgctcgaatccagagatcactctcaattctcattttataacaatattaagagagtttcttttgtttattggagattctaaaaagagggaggatgggagagggtgagggatgaaaaattacctatgggatacaatgtacactattcaggtgatggggacactaaaagcccagaactcattattgcacaatatatccatgtaacaattttcagttatactccctaaatctatcaaattaaaaaataaaaaaatataatgaggaccctggatggcagaaaaaagatcgttggaagaaagagaagacagcagtggaaaaccaggcctccacatgttctttgtagtagcctttgtagtagctaatacggaagtcagatggagttgaagaaggtgacagatatctgtgattgtcaagggaagtatactgtttctggcataggtgtataagaccaggatttgtatgtgctggtaaactccaggtctgtccatatcacaggtcatgacatggaagttctgggtttagaaatggacagacaaggggacctttctgagtagaccttggtgtaagtcttggggtatccctggcctcactgttgtgaatggtctgtgtccagtgtattcttgcagtctcagccctgaccacactccagctttctaggtgcatctcacatactttccttaagattccatatagaacacagcttttgagggatgttgtgctcctgcaaagtctgtcctccatgtcagtgagggagaaaacccggcccagctgttctcacctagggtcggccaagaggaggcctgtgcatcaagttcaggtttgcggaacaggaggaacctgagccatctttgtgtggtgaagaaactttatgtatcagagagagggcttcagttctatggccacttctacaactcacttgatttgtgactttgactcaaagtttgtgacttcagactcaaaatgtgattgagactcagtttcctcatctgtaaacttagggcctctgggttcatgtgacctttagggttaccccggactcaaagatccatgctcatgggatgccttttgctctgcaccattccttgggtgtcatagggtctaactgaatccgagtcctactttctggtacttaaaaatgactccaattcacagtgctacatgggaaatgggaggaaagaatgcgagagaatcatggttgttggctgtggctatagaagcatgtcagggaagttcatcctgaaagagaatgagattcacagaaactcttatatcttaccccacctccctacaatctggaggttaggtagttttcctctactaattctcattctatttataatttttcatttcattacaattgtaatttgtcaaatatattttctcgtttaaactttgtttggggtttagagttgatgttagttttatgttctttttcctcctttaactgagtcaattccaaaatgtactactctttctctaactgattttgtcttaatattatcattctactttgtacattgcagccggaggtcacgtcctaattaatcaaatgccattttatcattaatctgagaagcaccaattaatcaagtttttcctcccattgaaactggtgattaaccaagctgtgacactatcttttgagtgactttctatattctgcttctgatttagtagttaggtgtacacatcagtttcaatcactactgactgatcttagctggttctgaccaggacaatggtccttatcttttcttcaaattgattcatggatccgtaatattcttgcttcctgttctgttcctgggttaatgatatgtgaaggatttctctactcttaagttcagattttcaaagatatgcttaacttctagataatggtgtggatcttcatgacctcagggtgtgaagtccttgactacgagtatttttgtctatctactttaatgacatttgcataaatcttgatgtaggatgtcagaattatgtggtgaatgttgtgaatattttttgagaaattaattttttcagataaaacgcaagtctgttgtagtatttcaagatattagagttcaattatgctggaaaatgtgttcataaaggccctatgcatttagaattagtggcatacactaaagttatttcattttgaataagatataataactagaggctttgtagtagctaatatggaaatcaggtgaagttgaagaaggtgacagacatctgtgattgtcaagggaagtatactgtttctggtataggcgtataggaccaggatttgtatgtgctggtaaactccaggtctctccgtatcacataatcagtctctcagtctcattgataaaaataaattggggattaagttcccaatgctttccttcagattccaagattactttgaaatcagtattgctatactttaaagggaaattattagagcatttttgtattctctattttttttctgcatttttccccattttaaaaatgcttgtgattacttgaatagattcaagcgaagtgtaacaataagatgactaagacatggtttgaaactaaatgtgatcgggggagtggttttctttttcttgaaaacattcaccaatttttttatttgtaagtagcgatactacctttatatagctgaagggctgtgttcttaccattagacggtgcttggaacagaacaccacgtacttaaaccatccataaatatttaaaggttgtgattatgtcagcagttaccgagggtggaaccactgcgtgctcaggaagtcatatatataggatgcctcttccacaccacaagcatcaatatgtgtaccttagaatgccaagaaaaaattatgacctatcatgaactcatttactttcttttaagttagttgtctatcatcttaggattattgaacttccctggatcttagtctttcgtattctcctttgtcgccaggctctgcactttcccaagttttttctccatacctttgaaactctttcctctatttcccattaccagttacacacaattacttttgcataaaacttttttaggaagttgttaatactttcacactatcttcctctagatagattgaatcagatggactgaattttagaatctagtaactttaaagatgagaatctttctgtgtgtgtgtgtgagttggcattctccaaacctcagcagctcttgcagctcttggagacattaacacagagattgttgacatgtctttggagtgagtcccgaaacctgacattgaaccatcacacagtagcctcccagtgccccctcccaccccagtgttttcccagaagagactctgagagacacatggctctatctaggagaagtcacaatgataattctgatactgtgctagtggaaagaggatgcagatgaccaggaatacctgaggagttaagttggaaaggcctctgaaatttactgtaggatgtctaggactcagcttctacttccttcaggtgatcgtcaatttcatctagataacccttcaagggtaaaatctatttaagagaattaacatgtggtttacctctacccctcacatttgtttaatcaccttcacaaagacaaagtgaagaaactgtgtagggtatgttatttacttaaataaagggaacggagatatgcacatatatttacatattttcttatgctttttaaataaatgggaggataataattttttaaaagaaagttacctgccgggtgcggtggctcacgcctgtaatcccaggactttgggaggccaaggtggatggatcacgagatcaggagatcgagaccatcctggctaacacggtgaaaccctgtctctactaaaaatacaaaaattagctgggcgtggtggtgggtgcctgtagtcccagctactcgggaggctgaggcaggagaatggcaggtgaacccaggaggcggagcttgcagtgagctgagatcgcgccactgcgctctagcctgggggacagagcgagactccgtctcaaaaaaaaaaaaaaaaaaaaaaaaaaaagagaaagttacctttatgataaactataggggagggatagaacagagacagaagctagacttttttttaacatgccttgtttttcagattttactgtagagtaatatacacaatttaataattgtatacaaaattaaatataaagccatttctaaaaagcaaaagtaaaatggaacaaataaactatttgttgtttatttcaactattaagttgaaggcataaatacatagaaaggaattatttaaagtgactttaaaacagtaatctgtgtattttactgttttagatcccattgccaaaaaaatcttaagctactttcaatgatcacatcttgctaatgacagccatttttttacttaaaatattgtgctgtgactcagaaacttatcctgataaagcagttatgtgattatattgatattattggaaataataattttcaatttaagagaaaaaagaagcaaatctaaaatcagaaagattaagtagatatcatataaccctgtgtttgaattagatacatcaatatgaactctgaatatattttctcttaagaaaaatagaactatttcctagtttggtttatcaaaaaaccatgactatgtttatcaagaaattatcaaggaaaaatgatatctcctagcacctagactgagggcactaaataccactttcctctaaaaggatctagaattccttgcagtaaaagactggatccaaactgagccatcaaatatacaaataaattgggattactttataccagaaaacaagtatgttgtcaaagactactggagtgatgtcaaaaggactcagtggttaatttgaaaagaatttcactggccaaatgaagtaattgaaacatcaataataccagaaatggactgaaacatcaagttaaacattaatgaatgccttatagaacaaaacgtttcttatccatctttatgggaagatgccagagaatcaactcattagtctgaacattggtttgtaaaaggaaaaatcaagcatttatcccacttttttttttttaattactaaactgcatctcagggtaaccaaatatttaatgaaagaaactttcccattttggaagcactccaggtcagcatacaaaatttaagaatgttagaataactccattttgtaaactccaatgaaataatgtacctagagaacatcagtgatggctcacattgaaacagagacaacaaggtaggaggtacctggaagtagacaatgtgtgcttcgaaagattcttgccaaagttctaactaccagtttataataaatacaggaacagaaaaaaaaaaaaaaaaacgtatcatgtaacaacagaggggaacaatgagcaaggtgggaaacattatagaacaaatggggccatttttttttcaatagttgattgaaagaaaaaggaagagtgatccataaatagagatttaagagaaacagcaatcgaatgcaacacatgtaaaattttgatatcccgatttaaacaatattgcatacacttatatgcacatatacttttaagagataagcagtccacacaggatgctgataatacagaactattgtgaaattttagatgtgacaattgtgtttttgttttataaggaattctcattctttaaagatacactttgagatatttacgcatgaaataatatgatgtctgggactgaatttaaaataatcgagttgtaaagatgataaacttggaggggacatgggtgtaggcgaaataaaattggtcctgagttcgtctctgaaggtagatgtgtgtgagttttaaattctgttctctctacttggttctatgtttgaaaatgtccataataaaaatgttaatgacagataaatgttttctcctctttaaatttttagtaaagttctcagttttttgttttgttttttgtttttgtttgtttgttttgttttttgttatttatttatttatttttttgagatggagtctcgccctgttgcccaggctggagtgcagtggcactatcttggctcgctgcaacctccgcctcccaggttcaagtgattctcctgcctcagcctcctgagtagctgggattacaggcatgcaccaccatgcctggctaatttttgtatttctggtggagatgaggtttcactatgttggtcaggttggtcttgaaatcctgaccttgtgatccacccacctcggcctcccaaagtgctgggattacaggcttgagccaccgcgcccagccaagttcccagtcttatacaatacaactttacttgtaataagttaaggctggcagtaatgagcaccatgaggaccaagctgaataaaggatcaagaagaatgcgaagttggttgcctcagtaagggatgaaaggaggccacccacacccaagcgaggattcagccagctctgataaagtgccatgtagctttggttgtgactgacttgcttttcattctcccgcacttggagagtgtgggatggagaggcactgatgagttgattaatctccttggtacctaccttaggagattccgcgctcctctctcaggaacagtcatggtaggcgattggaagtggccttgttattagtcatgcttcatcatgacctcgaaatcaccagttgtcatatagccaggctttaagaattaattttacaagcatatataacacattttcaaataagcttttattttactacagttaattatccatatttatagctctgttgttttatttccccaaaatacctaatataaggtaaaattagaaagtaagaacaacagggaaatcatatttttcaatacatgagccaaatgtgaagtatttaaattttttaaaaaatcaatgagttaatttacagtcagcattcaaccggttgcaacattttttgaaggaaaatagcctaaggtataaatatagtgaagatatacatatgaattattctgacacctgacaggtgcaacttataaagtatgaaacagtttacatgacaggagcataattataaatatttaaagatcctttttttaaacaatataacgcattttgttgatttgccttgatgcttactccagatttttcccagatttatttagagcagcaagagctatgtgataagtacagctgattctcactttccctgacagttatgttttataaagtttccatggacaatgaattatcaaatactgaaccattgctatgctatgtcatctcacagggactgccttaggagggactagagattgtttttaagataggataaaaataccttgtttttttattttagcaattttgattataaattcaaacctgaaaaatacagagaaaatataaaaatagaaacaactgtaatttttcttcatgcaaaaattatttatatatagcaatgtttcctttcagtcttttctcatatttatacaaaaattaacactttaattagaagtgtgtgtgtgtgtgtgtgtgtgtgtgtgtagagagagtgagttgattctcattatgcgtggaaattatgttctataaagttcctgtgaacactgaattagagagtagtgggtaaatacacaattagagtcccgtgagcctctgactgcaatatttttgtccacccatcaatacgtaaccttgttttacgtatgtttctgtttaaagacaccttatatagtctgtagtgctgatttattaatattgagctcatggccaacagcactataactcatgactgaatgaagcttccctaacacatattttctccgtaaggtgcatggcagctttcttgtacttaggaacataaggcagtatttcagctctacgtttggggcccattttaaacagggaaatcaccaaaaaatgcacaaaaatgtgaaaaatgaatagataatgaaaaaaaacacttgtttacagtattgtagctgaaacaggaaggcagagtgccaccttgtttgaactcagttggaagcaggtacgttgggcagcccagagtcttcactgctgtgggcacattcacaaatgaccactgaagcacataaagctttgatttggggttaaaaataaatcttagctagtaggcaaattcacaatacagtatctatgaataatgagaaagaactgtaatttactatttgcctaaaaaataccatatgggtatagtatagctctattatattcttgccacgtcttttataatctgtttataaaaactagcctcgggcaaaatagtaaaatgagcaattttttaaaattggaaactgccctttgccttctcagtggtacacattttttaaaaaaatttgatttgcttgctctcagtttggggttaataagaccaaaatttaaaatgcaagcttccaaagataagaatcatgcattttgttgaattgcctttatgcttactccagactttcccagatttatttagagcagtgagagctgtgtgataagtacagctgattactgtcttatttacgttaattttccagagcctaacctggtgctagaaacatagtaggtactcaggagatacttaggcacaataagtgaattcatgtcatcagtaatatatatcccaccatggtgagtagaatggccttccaaagatgttcactaccttaacgttgggacctataggtatgatatctctataaaaaaggcatattgggattgtagatggattttaggttgttaatcagatgatcatagtaagattaccctggattacacaggtgggcccagtgtaatcaccaagggccttaaaagtcaaaggaggcctaaaaggagattcagagggagaggaggctgtggaaggagaatagagttatgcaatctgtgaatgactcaacttgcttttgttggctttgaagatagaggaagggagccataagccaaggaatttgtgcaacctctgcaagctggaaaggacaaggaaatgaattgtctcataaagcctccaaaaaaagcatgcatcctgctgacatcttgatttcagcccagtgaaacctgtgtcagatttttggaccacagaactgtaagataataagtttgtgttgtttttacccacaaatttttggcaatttggtacactccatgcctgagaaaattgatacacctaccacatgacatttatagtccgataagtgatatcacaaatttgaaaatccattaggacacacagcaatgaatatttatatgttaatgtcaaacattatggtgaggactggaactgatattttgagagaagctcattctcagttctcaaatctcattatataatttggcagctattcataaaactgattgactgattttgtaaatcttttgcaaccaatagtctctcttgctttagggctaaaataattgattttctctcattattttgtcatttttgagtgcaagataaattagtgctttatatattttaaatcatgtactaagtaatagcttggtatttataaaatgtttataatcaggctttgtgataaaatatggtaagatcaatattacagtactccaaaaaagcaattgccctctgaaacttcagaattaatgctcatgaaataatcagcaaagaagaaatgaaaattaatgttgttttaaaaaccattgaacatggacaaaatattaattgcatattgtcagtcaacatgatttaatagtggtttaaataagggtggttatgttgtcataagaaataagatgatatagaatacttattttacttcctagtatataggctgtgctcaataaatgtaaagtgattgccgttatttttgaggatgccattgttattataatgcaaacacagaagggatctattcccctcttttgttttctagactggttgaaaatattttattttttaaaaagtattaatgtctgctgaaacccaatactatgtaaatatttgtcattaacgggtgcttgccagtctattttgccccatactcaagggttttgtattttaccatcagtcactgacttgagagaatacatgaaaatcacccttaagtgtgggtgggttgtgattactttacaagttcctactttgtggatttagccagatcagcatcttgtggtgtcagagacattactgggacatttacccaaagagttcattacagcactgctgttcatttcatccatcctcagaaaggcagcagcatcgtggagtgccaggaattcactctcagaggaagtcagtgtttttcaaacattggtaccataatcaaaatgaaaaacaaacaaataaaaaacaacttttctccacacagcaaaataccattctttcttacttgaggcagtaatgaagtggttttgaaacctttgaaaatgagcattgtgtagaatattgagtaaatggatttgaaacaaatgaaggaaacattgatatggatttctagtgttttctttaatgtatcagtcaattcacacaaggtaaaatgcacacaaagtaaacaaacaaaacttaagctatctaaaagtcatctcctgtaatactgtgatttgtaataatattttatgcataatgtctgatatataatagtaattcctgttataaacacatatacatctattgatttattgcctgtctatgctaggaaatgttctagacattttagatgcatctagatatttcttatgtaaatctaaatgatggaaatgttatttattgatattttacatacaaggaaatgggaatcagagacttttgtaggtcatataattaaggcagtacctgactccaaagtacaagtctgtcccaacatgctctgcttccattgtagaattgttctttgtgtgctttaaattataatatttaacaaggagttctatgtccttatagtaattctagagaaaaggaaagtaattctttaaaaaaggagaaaaacttacatgtacatttataattaatgttatatatgactaagccaaaaccttatgtcattataatataaagaacactgtctagtatataatagagtataagtatgtgtaaatatattgtcactgtaggaaataaggaaaatgaatattgctatatgttagagaaactcaaatgttaggaaattagtccccagcatgatgagcagaacaagctttctgtatgtgtgctcaggcaatgcaaatggttccatttgtctcatatagatgttaagtacgtgtcctgactcatacacaggcatgtatacacgtatcaactaaggcatcttagtctgttttgtatctgcctctgaaactaatgtcaaatcaatgtcatggaattctttctgacagcatttctggcaacgttgcttgtggctcttcttccactcagcgctttgacagtgctgtttagttttttttgtttttgcgttttttgttttgtttttgtttgagacagtatctccctcttttgcctaggctggagtgcagtgacgtgatctcagctcactgcaacatcctcatcccgagttcaagcaattctcatgcctcggcacctggagtagcagggattacaggaatgtgccaccaagcccaactatttttttttcttttttctttttagtagaaacagggtttcgccatgttgtccaggctggtcttgaactcccggtgctgaattcctcatctgcctgactcagcctcccaaagtgctgggattacgggcgtgagccaccacatccagccaacagtggtgtttatgggaacccgatctcagaatagtggcctattctgtcctcagatattctaattcttctttctaatatgctaccaaaacccacatgttttagtttgggttcctctagaagcagaacctgagacaagaatttgagtgcaagttatttatttggaaggcaatttcaagaaataacagtaggaggggagggaagtgagacagagaagggaaagtagttaataaggtttgcaatttgagcaactggagcttagccccactggggaattctaggagccagtatacttcgccatgtctcaatgtatccatcagaggagcaagggagctggggtatttatccatcatctccaggcagtcactggatgaggacttagccttcctccctgggagatggacaaagccgtcaggtaaacttgtgcactactggatgctggacttcagcaagatgtttctgaaaatggcaaaaccttcaggtatatggtgaagagtgggcatctcttactacagtaacttatctattgtaactaattgtaacttatctattgtagctaatctggtgaagtcttcagttcttttctttatccttgccttagaggcctgtgtgagctgggctatacatagaagattggggtctggactatatccttttgccaggacacttgtctcctcctaaaaaccccacatgtaattgtttcctctgagaaaagctggtgtttcttgtctcatcaggcgttcacagccagggaatctgttcatgaactgcaacttaatgctatctcttctggccccataaataacaggtaaaaaaaaaaaaagccctgcttgttttaagcaggcattattccttctcatcattgcattactgattcaaattgaaagcctggaatgtggcttcacaggtagcttactcaccaaggttgtccctgcccttattattatgaaacaattctaggatttttatttcatccttagtcctctttggctctcttagctaacttgaatctttcaagcacttctgggtttgcactataggactttaccctcctcaagtcttgaatttcttttaattctcattaactgttttttttcttttttaaaaaattttttgtgggtacataattggtgtatatatttatggggtacatgagatgttttgatatgggcatgcaatgggaaataagcacatcatagagaatggggtatccattcactcaagcacttatcctttgagtcacagaccagccaattacaatctttaagttactttaatatatacagttattattgactatagtcaccctattgtgctatcaaatagtaggtcgtattctttctaactatggttttgtacacattaactatccctacctagccccccactacccttcccaatcttttatctattgatgttgacagcaaatcacactgactgctggccaaagtgtaaagatttctcccgctcctttgcatatgatgaggagccaaatgtggtaaacacttcctccatatgaactcaaatgttcgcatttgacgtttcacatctcttattattttctgggggaaaagtcaacccacctccaatgttctttcccaccagccacagtctttctaatttgtaactgacttgtagaaattgctaacgtttctttttttggaatgttccaaagcatgctaacatttatttatctaaaatatcctgttatgcaaaactttgtgcttggcctagtaaataaagatctggctggcattttatgctcaaccaggttgtcttgtatgctattcaacatctaatcaactcacgtgcagtatcagactcacttaagagcttgtgtaaagtgcagactccaagatcccacttcggatctacccaatcagaacctctgagtgtggggtccaggaacagtgttgtaaggagccctccatgtgatgtttgatgttcacatgaagcttgagtaacacaattctatagctttgctactcaatgtgtggttctagcatcagcatcatcagagagacaaaacttgttagaaatacaggatctcagtcactgcttcagacgtcttgagtcagaatctgcattttaatacgatccctgggtaattcacgtgcacacccaagtttgaattgctctgttccacaggacttagcttgtattttcagtgtcaataaataatacgatgtatcaaattattcaatataattagcattagataagtatcctaatgtgtttgtttttgagacagagtctccctctgtcgcccaggctggagtgaagtggcacaatctcggctcactgcaacgagttctgcctcccgggttcaagggattctcctgcctcagcctcccaagaagctgggattacaggcttgtgccaccacacccagctaatttttgtatttttagtagagatggggtttcatcttgttagccaggcttgtcgtgaactcctgacctcaagtgatctgcctgccttggcctcccaaactgctgggattacaggcatgagccactgtgcctgggtcttcctaatgtgttttaaatggagagttacgttaggaaaatgttcctaaacataacacaccccaaagaaaaaccaatatgaactcccaaatcattggaaagccacaaacctggatattaagtatctagcatgagtcctaagaaagaaaaatagctactagagaaataaggatacagaattccgcaaatctacttcttacttcattatatatatttttttcaagaagacaatgtaagactactctgaatgattggaacacgttcttgaggaaatggagggaaatatgtcccctcaccacatgtagtgcagagatttattttctagtgaacactagcaggtctgctcaagtacatactgtcattcgggaaatgtgcctcagtcaaacacaaagaaaacataattttttcttggagtgttgagtctttagggaggagctcttttttgaaataacaaagggacatggaatttggatttttaaagcttgaacatgtcctcattacctgggcacagattcatttcttgtgcaaagatgtcccgagtctcacagcttgaagatgcctgtcaatgaatgaaaggtcgctgcagctgcaggagggaagtcaaagtgcttacaccagagtccctgctttataccttgccatgctttacgcctttgcatcttgcctcacctgagaggtaggttcttagcataatgggcttatcatttttatcgtaagtattttaatgactttaacaagcacaattgtctaaattgtattctgacattgagctagtctttcctctgtttttctgaacatgactcttacagattctccaccaaattcaccaactacattacaactttttccattaggaaaccaacaaacccctatctagccttatcttatggttgctatggttattctcagccatcgatgatgattttactacccactgaaaagctccggcctatgtcctatataggaaatgtgatgaattgattagtgaaattcagatgtggcattaatcatatcccaagatgggaatggtgggggtcaacaaatcctccctactttatatgctgtcatttactttacacttgtatttaccccagtgacaatgatagcaacccacattgcttaagactatcattttggaatttatatattcattcagtcagtctgtactgaacactgggcatttatgatgtgttgctgagtgtacagagatgaatgagacacagtcctgggccccaaagtgctcacagcctcttggggcttagaggcctgcaaatgaatggagatccttgtgacccagcacagagagtgccctaactgcctgtgggatgaagcaggcatcagcaaggacttcatggggggtgggtgagaggaggaggatgaagacattcctggcagaaaaaaaaaaaattgaaagactcccattgtggggcagagggtatcctgggctgtgttccccactttcctaagaagagacttcagcctgcggtgctatgagaacatgcactaaaatctagaggtcctcgatgtctcttcagagaactgttggatctaccaagaagctataaaatagcttaaacattaggggcttcaatgaattcagagaaaaatatagtcaacacaattgctttatttcattttcgccaacagaaactctattagactgtgaacgcttttgtgtgtctaatattttccctgctggtttttcctttggatatgtgtcttcatggggatgaacaagcatgccaaagaaaatcaaatagaacagggagaaaagttatgcctacttattatggcaagctctggcttctacaacatctgaaaattcatgaggaaatgtgtatctttaaaaattcaacttatcatttggcattcatcgtgagagactctgatctgggtggtagaatagagttggtcaggaatgtttatttattttggaagttggccttgagcaagttacttagtgtgtttaaatggggtttattctgtaaatcacagatgctctgtcctttactttgattgatattggaaaggttggatttggaagtacactcacacgtacacacttcatagtgtgaaaagtctaaaaaaagcaaatatgtcctctaaatgctaattaactgtgataaaaatggaaaatcttgcatttactggtattgaattataattacaaaatgatttaatagatgggaatataactttaaatacatgacacagaaaataatttcctaattttcactaattcctagagtgatgggattatgagtaggcttttttcccccttctcctttcccccaaaattctataacgtatttaagtgaggtttataatgaaagttttcacttatttaaacataaattacaatttgaaagaaaatagttttattgaaattcaacttaaatattttgatacctacttaaatgtttaattcaattaaaatgttaatcattaccaaagaagccctaggcaatgtcagtaaatgaacgtgtagaacttagaaggactctgatttctgtgatgagtgatacatcattcccatcttcctttcttgaaaagtgctcaagttgaaatcatccttttatgtcttctcccccagtctaaactaacaggtcataggtcctgtttacttagggctctgtgactcctcttttaccaccgtgataccaggatgaatacctttctcctgatggagaattaatagaacaactaggcaattcggtgggaccagagcccttaaacattcctctttttcagacaaaattgtatgtttgaaacggtttacttctgatggcaaaacgtgactctcccaatgaccatcatgacaatcaatggaagccaattgggaggcactgcagccaggcttcagagagatcacgaccttttgaagctgcttaaatcagacttgaagctgcttagagggcatcagcagatttgatattattaattttttttaactttaccacttatcaggccaaagattctttttttttttttgagatgcagtctctgtctgctgcccaggctggaatgcaatggcgcaatcttggctcattgcaacctctgcctccagggttcaagcaattctcctgcctcagcctcctgagtagctgggattacaggcacgtgccaccacactgggctaattttttgtatttttagtagagatggggtttcaccatgttggcaggctggtcttgaactcctgaccttgtgatccacctgcctcagcctcccaaagtgctggtattacaggcgtgagccaccgcgcccggccaaagattcttaaaatagggtgtaataaattattttattggaaaaaataatattttataagtatcttcagtaaaaatcaatgtatataaacaccattaggcagttctattttggtcacacaaatcggtaacagtcaccagcatcactgtgtcccctgaaaagatctctggatggtttttttttttcgacaaggtcttgctctgtcgctcaggctggagtgcggtggagtgatctcagctcactgtaacttccacttcccgagttcaagtgatcctcctgcctcagcctccctagtagctaggactacaggtgtgtcccacaatggccggttaatttttgtatttttagtagagatggggtttcaccatgtttggcaggctggtctcaaactcctgacctcaggtgatctgctggcctcagcctcccaaaatgcgaggattacaggcatgagccactgtgtctagcctggatggtttttattaacctgaacagtggtgaaaaataaaataatctggaccataaataaggaaagacctcaacatcaactaaaacacagatatttataaatgactttgggatgtggcattcatttccaaattttgctttgttagaccttaggcgtttatatagctaaaaaagtcaaggggatgacttcacttgaattgtgcatattcatttgccatttaattcaataaagaacagcaaatgtattgattgcagtaacagttactgctgctgctcacaagccagacaccaccagaaacacacctataggcacactaagttggccatactacccggtgcaagggacaggatgcaccctatgtgagtatcctaatttttatcaaggaggtaggaagaatggggcaaaactaaagctgtaagtggtgaagagagagctgttactcatgctaaccaaagaggtggatgtccagtcactttgctggtttagacattactttagttttgatcttcactcagacatgattacagagtggttttgtttttgttttgttccattacagtggaagaatgaccttgtgtggtgctggtgtcctgtgaaattgcttatattcaatagtaaaacatcatcctcactcacagctgacagtggtcaggagctgctcccatctttgtcagcatccttcacctcatgcctactgtgtatcagccagtgctaccaggcctgcacacacatcgctgactgttcaacacttcctgcaaagataggaggcatccttcttcccaatgtgcacatcaaacatccacatctctcagaagtctggtagcttgcctatggccacacagaaaagaactaaagctatttatcacaagaataattaggtaaataagtaaatacacaagaaacaacaagaagctttaaaggaagcagacacataaatggttgagggaaaccagagagacttatggaactcgatcacttgggacttaagcaatggagaggaattcataaagaggtctcatgggtgggtggcatcagggaaggattccagcttctatttgggtaaacatgtgcacaaagacccaggggcctacaagagaaagaacaacaaacctttcacggacataagggaaggctttatgtcgtaggtgatacctgaaccaagagtccaaagggcagagaacagtttccaagcagagaatccatggattatgctggggtgggggttggttggtagaagacaaaaaatgaacaatgagaactgagaaaagttgtggggtatgacagtcagaagaatgctagtgatccccgagctaccaatgtcaggagaattatgaggaaagggattaaatcataaagggttaaatttcagtgagaatgggacaagcagaaacagtaaccattttctccttttcaaggagttagagggctgaaggcatgcgacagagggaaaagaagctttggagtgtggagacagcacacatcagatacgcagtgggtgggtttgttttcattattatgcatttctaggaacagaatatatagcaactgttacatacctaatggtagcagtaaatatttaacaattaacatttaacaagcctctggatgattctgatgcatactaaataaagagaacctctgtatgctagaaataataaggcctggaccataaagtactagtgctacagtcaattcataaatctgtcatttcatgaataaaatttcatggttgtaattgtagcattataagctttatgtgtgcatgtgtttgtgtgtgtgtgtgtgtgtgtagagcgaaggaaagagatttcatgctaaaggaaaccttagaattcatggactgcctaggttctctaactttgtttagcatacatatattagggttctctagagggacagaactaatagattatatacatatatatatatatatatatatatatatatatatatatatatatatatatatatatggagtttattaaggagtattgactcacacaatcataaggtgaggtctgcaagctgaggagcaaggaagccagcccgagtcccaaagctgaagaacctggagtccaatgtttgagagtaggaagcatccagcgtggcagaaagagataggccagagactaaaccagtctagtctttccatgttcttctgcctgcttttattctggccatgctggtagctgattagatggtgcccaccctggttgaggatggttctgtctttcccagtccactgactcaaatgttaatctcctttggcaacaccctctcagacacacccaaaggcaatactttgcatccttcagtcaatcaagttgacactcaatattaaccatcacaatacatgagaatcatccaaaggcttgttaagtgttgcgtgatactgcattctgtgcacctaccgtgtcttccctacccacttttccagccatggacactgaggttgctttcaattctcagccaccgcactgcaaagagcagctacatgcacgtcccttttacacatgtgtcagaactactttgagataggtaactggagacacattcactaggtagtagggtatacaaatactaaaaattttactacataacatgaggggtgccgtcaaagagttataacagtgtacactcccaccatcaatacgtgagttcctatatccccacatttgtgccaacacatgatactatccaactttctgattttgacagctttttaagtacaaagcgatatattttttatctttttaaataatattgggtgcatatatatttgtatatatacatagacacatatatttgtacatatatatacttatatatttatctcaccttgtgatatggtttggctgtgtcctcacccaaatctcaccttgaattgtaataatcccccctgtgtcaagggggggtccaggtggagataattgaattatggggcagttttccccatactgttcttgtggtagtgaataagtctcaccggatctgatagttttataaattggaattcccctgcgcaagctctcttgcctgccaccatgtaagatatgcctttgcttctcctttgcctgctgccatgattgtgaggcctccccagccatgtggaactgtgagtcccttaaactgctttcctttataaattacccattctctagtgtggctctattagcagcatgaaaatagactaatacactttgctaactgtgtagtcttggataattcacttctttctgagtttcagttctctcatcagtaaaatgaagaaaaattaagtacctctgatagaaaagccatgaaatgagatgatgtgtgaaaagtaattcacatgagctctgcaaagcaataagctaccaaaatagttatttgtttttattctgggatttgattaaaaatattgtttctcaaaaggcaaatttttctaaagtacttagggaactgaattataagaaaattgtcaattatcagaattcagtttggggatattcttatgagatttttggaacccacagggagagatcaagaatacctacacagttgacaatgtccaggttaagggaattttggtaaaggaaagagactaatagtagattaaaaaagagtatcttttgcatttcctttttcgtttatagtttctggtgtatatgtaacatatcattaaaaactggtaatagaagttaaaaagaaatctataatcttatcacttaaaagcactgctgtattaaaactttgatgcatcttttgttatgcttaactgaataatttataagtatgctgatcacattagtcatgtatcacacttaactaatgaagagagcatgctaatttttcaatagtctctgcataagtcattttaattgcttcataatattccatcaagtacatgttgctggggtaattatattttagtgctctggactagaaagtaattcagtatctataaaaatgtaaaagattaattattaatacaaactattttaatcaaatggatttagacaggttagcatatcttagtgtatagcaatgtgcttaataataccttatatttgtacagccccatagagagtaaacactttcaagcagccttgtgatctggaccgtctgggtattactgttatgttatagatgaaggagccagtcaaggctatgtgtttaagaatttgcctttagatctgacctttgcaagagccaatactggggtgcaatgtgatgttttgatacttatatacattgtggaatgatgaaacatatccatcacctcacatattttttgtggtgggaacatttaaaatccactcatttagcaaatttgaaatatataatatattgcattccataaatatatacaattatttgtcaattaaaaataaaaattcttgtaaatttaaattccttacagatgctggatattaggcttctgtctgatgcatagtttgcacatattttcttctattctgtaagttgtctgtttattgatgatttcttttgctgtgcaaaagctcttaattttaactagatcccatttgtcaatatttgattttgtcgtgattgctttcaatgtctttgtcatgaaatctttgcccattgtatgtccaggatggtgttacctaggttgtcttcaagggcttttttagttttggattttacatttaaatatttaacgcatattgagttaacttttgtatatggtgtaaggaaggggtccagtttcggttttctacttatggctagctggctatctcagcactatttattgaataaggggtcctttccacgttgcttgtttttgtaagctttgtcaaagatcaggtggttgtaggtatgcagccttatttctgggtactctgttctgttccactggtctatgtgtctgtttgataccattaccatggtgttttggttactgtagcactgtagtacagtttgaagtcagataacatgacgtctccagcattgttcctttggattaggattgcctcggctatttgggctcttttttggttccttatgaatcttaaaatagttttttctacttctgtgaagaatgtcattggtagtttgataacaatagtattgaatctgtacattgctttgggcagtacggccattttaatgatagtgagtcttcctatctatgagcatggaatgtttttccatttgtgcatgtcatttctgatttctttgagcagtgttttgttactctcattgtagagatcttttgcctccctggttagctgtattcctaggtattttattctttttgaggtaattgcaaatgggattgcgtttctgatttggctcttggcttggttcttggctgttattggtgtataggaatgctagtgatttttggacattgattttgtatcctaagagtttgctgaagttgtttaccagctgaaggagcttttgggctgagatgatgggggtttctagatatagaatcatgtcatctgcaaacagggatagtttgacttcctctcttcctatttggataccttttatttctttctcttgcctgattgctctggcagacttctgatactatgttgaacgagagtggtgagagggggcatccttgtcttgtggtggttttcaaggggaatgtttccagctatggcccattcactgtaatgttgtctgtgggtttgccatagatagcttttattttgaagtatgttccttcaatacctagtttattgaggattttttaacttgaaaggatgttgaattttattaaaagccttttccacatctattgagataatcatgtgatttttgtctttagttctgtttatgcgatgaatcacacttattgatttgcatatgttgaaccaaccttgcatcccagagatgaagcctacttgattgtaatggatttgctttttgaagtgcttctggattcagcttgcaagtattttgttgaggatttttgtatcagtgttcatcaaaaatattgtcctgaagttttctatttttgttgtatctctgccaggttttggtatcaggatgatatttacctcatagaataggttggagagaagtccttcctcctcagttttttggaaatcatatcattgggaatggtaccagctcttctttgtacatctggtagaattgagctgtgaatccgtctggccctttttggtcggtaggctgtttattactgattcaattttggagctcattattggtctgttcagggaatcaatttcttccgggtttagtcttgtgaggctgtatatgtccaggaatttagccatctcaggttttctagtttgcgtatgtagaggtgttcagagtagtttctgatgtttctgatgtttggtgttttttttttctgtgaggtcagtggaagtatctcctttgtcacttctaattgtgtttatttggatcttctcttttttcttctttattaatctagctagcaacctatcttatcaatttttattatcttactaattaaaaaacaacctcctgaatttgttgaacttttgaatggcttttcgtttcttgatttccttcagtttagctctgattttggttatttcttgtcttctgttagctttggggttgatttactcttgcttctctaattatttcagttgtgatgttaggttgttaattttagatctttataacttcttgatggggcattgagtgccatgaatttttgccttagctgcgtcccagagattctggtaggtcgtatctttgttctcattagtttcaaagaacttcttgatttcagccttaatttcattatttatgcaaaaatcattcaggagaatggtgtttaatttccatgtaattgcatggttttgagcgatttttgtcagtcttctgtttttattgtgcgtggtctgagagtgtgttttgtataagttaggttcttttgcatttgctgaagattgttttatgtgcaattaagcaatcaattttagagtatgtaccatgtagcaatgataacaacatatattctgtagtttttgggtgaagaaaaaaacaactccattaaaacgcgggaaaaggacatgaacactgttgttgttgttgggttttattttttttttttttttgagacgaagtctcgctctgtctccggggctggagtgcagtggcgcgatctcgactcactgcaagctccaccttccaggttcacaccattctcctgcctcagcctcctgagtagctgggactacaggcacctgccaccacacctggcaaatttttttgtatttttagtagagatggggtttcattgtgttagccaggatggtctcgatctcctgacctcgtgatccacccacctcggcctcccaaagggctgggattacaggcttgagccactgcgcccagccgtgaacacttttctaaagaagtcgtatatatggctaacaagcatatgaagaaaatcccaatatcactgatcattagagaaatacaaatcaaagccacaatgagatatcatctcacacaagtcagaatggctattattaaaaagttaaaaagtaacagatgatgatgaggttgcagagaaaagggaacacttatacactgttggtaggagtctaaattaattcaaccattgtggaaaacagtatggcaattcctcaaagagctaagaacagaaccaccatttggcccaacaatcccattactgggtatgtacccagaagaatataaatcattctaccacaaagacacatgcacgcaaatgtttattgcagcactagtcacaatagcaaagacatggaatcaacataaatgcccataagtgacagactggataaagaaaatatggtacatatacatcacagaatactatgcagccataagaaaagaatgagatcatgtcttttatgggaacatggatggagctggaggccattatcattagcaaactaatgtaggaacagaaaaccaaataccatatgttcttataagtggaagctaaatgatgagaactcataaatacaaggaaaggaacaacggacactggggcttacttgagagtggagggtgggaagatggagacgagcagaaaaattaactattgggtaccaggcgtaatacgtgggtaacaaaataatctgtacaacatgagtttatataacaaacctacacatgcacccttgaacttaaaagttaaaaaaattcagtaaagtaaatgttgtataataatttgacatgaaattaaaaaggtaaatgtaaatgcacaaagaaaaaaactaaagtcaaaaaaattaaaaaataaaagacataacaataacaaaaaagcatatcaggatcaccgagagtagtttcagaatatacacttccctgaagataaatataaataataaatcccagtctactctagtttggtgacctcttacagagaacaataaagcaatgctatcacacacacacagacacacacacacacaaagaggtcaatattgggacttctttctccactgaactttcttaatacaacatcattctacttcttaagttaaacaacttaaagtagggctaaccaagggtctgaattagaatctctcagcataagtgagtgttttgaaaatttgataaattgctcttaagtttcttaatacatatagaatctttatataagattctgtaaacaactttgtgagcatgcaatgaataatacatgaaattgcttataaaattaatagacatagtaaagatttaatacaaaaattgtgaatgtaagcactcacattttgagatcttcaaaatttatgataatggctttctgctaatgaatttaatagtgaccacagttaataataatgtactgtatatttcaaaattgctaaaataatatatttttaatattttcataacataaaaatggtaactaatgaggtgatgggtgtattcattagcttgattaactctttctacaatgtatgcaaaaatcaaaacatcacattgtaccccataaatatgcacaattatttgttgtaaccttaaaatagataaattcaaaaaacttatgacaaatgtatgataaatgcatgtatttcaaatgaggaaaatcatttaatttcttgaactctgaatagaaaatgacacagaattaagattgctgtaatgtagttgttaaagagtttctcattgatagacttgttttcactatgacacttataaacacttaacccttgctatgaaacataacattaggttacattattctagagaccatcttaaaaccatgcgagtattgtaattgttttttcccagtagctatttagatctgatcactataattgctaagtaaaataaaacagggaattgcaactttccaaatcatcaatttctaaataaattttagttgacttttggataacacagggaggaggggaaacccatgcaatggaaaattcatgtataacctttgataccccaaaaaggtaactgctaatagcttactgttgactggaagctattttgtattttgtatatgagttatatactgtattcttacaacaaagcaagctagagaaaagaaaactgtaagaaaatcataaggaagagaaaaaatacttactcttcattaactagaagtgagtcatcatagaatcttcatcctcattgtcttcgtgttgagtagtctgaggaggaggagggagaggaggggttggtcttgctgttcacgggtggcagaggcagaagaaaacctgcatatatgtggaccctcagagttcaaaaccatgaggttcaggggtcaactgtattttggaaacatatgcatagcatgtaaattgtctccttttttttttacatagctaaagaatatgacttatagaaactgataattttatgaaacataatcaatctcaattactaaatgaaatacgtttttgtgctgcattagaagccattaagttgggccaggtgcagtggctcacacctataatccaccactttgggaggcagaagcaggcagatcgcttgagctcaggagtttgagaccatcctgagcaacatggtgaaactatgtctgtacaaaaaatacaaagaaaaaaaaattaggcgggtgtggtggcttacgcctgtagtcctagttactgttagtgctattttacaacagcatgtgctcactttgtgtctctgtgtcacattttggtaattcttgcaatatttcaagcttttaaattattattatatgttacggtgatctgcaatcagtgatgtttgatgttactattgtaatatcacgccacaaaccatgttcatattcagcagcaaacttaatggataaatgtgtgtgttctgactcctccaccaactggctgttcccgcatctctctctctctccttggacctccctatttcctgagagacaacaatattgaaattagaccaattaataaccttacaatggcctctaagtattcaagtgaaaggaagagtcatgtgtctttcattttaagtcaaaaactagaaatgactgcacttaggaagacattgtccaccaagataagcagaaagctaggcttcttgcagcaaacatttagccaagttgtgaatgcaaagaaaaagtttgtgaagagaataaaaagtgctacttcagtgaacacatgaatgataagaaagtgaaataaccctattgctgatacgaagacagttttagtggtctggatagaagatcaaatcagccactacattcccttaagccaaagcctgatcaaggccctaagttcttttcaattctatgaaggctgagagaggtgaggaagctgtagcagaaagctggaagctagcagaggttggttcatgaggttcaagaaaagaggctgtctccataacatagaagtacaaggtgaagcagcaaatccttaggatgaagctgcagtaagttatccagaagatgtagctaagatcataggtaaaggtggctacactaaacaacagattttcagcatagatgaaacagccttctattggaagatgccatctagaactttcatagctagagaggagaagtcaatgtgtgacttcaaaggacaggctgactctcttgtcagagactaatgcagttggtgactttaagctgaagacagtgctcatttaccattctgaaaatcctaggacacgtaagaattatgctaaattcttctctgtaaagcacaggcagatgacagcacatctgtttgcaacatggtttactgaatatttgaaacccactattgaagcctaccgggctcaaatagtctgcctgccttggcctcccaaagtgctgggattacaggcaagagccactgtgtctagcccttgtttttgaagaaatacattttgtaaggctatagctcttattgatactgattcctccaattaatctgggcaaagtaaatttaaaaccttctggaaagcagtcaccatcctagatgctattaagaacatttgtaactcatgagagaaggtaaaaatatcagcattaatgggcatttggaagaagctgattccaacccttagggatgactttgaggggttcaagacttcagtggaggaaggaactgcggatgtggtgaaaatagcaagagaactagaattagaattggagcctaaagatgtgactgaattgctgcaatcttataataaaacattaatggatgaggagttgcttcttatgaatgagagaagaaagtggtttcttgagatggaatctactcctggtgaagatgctatgaacatagttgaaatgacaacaaaggatttagaatattacatgaacttagttgataaagcagtggcagggtttgagaggattgactttaattttcaagtttggctatgggtgaaatatcaaatggcatcacatgctacagagaagtctttcatgaaaggaagaattaatgtggcaaacttcattgtttttttaaaaattcactccacagtcaccccaaccttcagcaaccaccaccctgatcagtcagcagcgatcaatatcgaggcaagaacctctaccaggaaaaagattaaaatttactgaagactgagattatgattagtattttttttagcaatcaagtattttaaaattaaggcatatacatttttaaggcatatagctattatacacttactaaaatataaagatactatttatatgcactaggaaacaaaaaacttgatgtgatgaaatttattgcaaaatattcactttattgtggtagtctggaaccgaatccacagtacctctgaagtgtctgtacctatgataagtaaagaaatgttataaaggaatatattagcttgtaaattactaagcttcttacatagaactaatttaattaagctattgcttaacaattaacagttgttaatctattaacaattaacagttgttaatctattaacaattaacaaccaccacccacattcactagatacacacaagtaaacagagtagcaaaaccaaccctcttgtacccattccgaggtcccaagcatcaaccccatggccttttctcccccgtgcaactctttcatacgttgcccatgatctgtattattttgaagcaaatttaaaacttcctagctttatatccttaaatatttgtgtgcaaattcctgaaatttaagattctattttcttaaaatagaatctaaagaagtgaacaataatttatttgcaccatcaaataatcagttgtttttcaaattttcaatagttaactggaaaacagcattttattattactatttttttaacaacaactttccaaagacctcaatatgatacaaaagagaatttcttagtaaggactattgatttcagagtccattctctgaacatgttctctgtgtagttttacctcatccactatctgccactcaatcaagatttgagtccctgaggaattgctgaaggtacatatattcagagaagatgcttattcctattcttacagagccatggttttcaaacctgcgggaacaaagccacaatgagtcattatgtctgttattctttttttcattactatacatttgtggcctaagattttgtgactgtcctggaagaattcaaaggaaaatttgaatgtatggcacaataggctttacactacatgtggcattaagataaatatcatttaagtgtaaaataagccctaatactgtgtcatcagaatactaaagaattccccctcagatacatttattttaatttttttaatctttagggagcagcaaggcgttttatctggttccttacagaaacacttatggttattctatatattatgaataatgtagtttcttaaaattaaaataagcagagtttaaagtacgtatacagcatcattaaaataacatgcaatatgttttataaagtgacttcagaggatgcatacaaatatctataaaagttatgtatgcacctttaaaataatttgaaaatgttgatcaaccaatctaaactgcgttgaaatagaaacaatatggatatttaggaacttctggttgctgcatggtactataattacactggctgaagtataatttccaaaaattatatgcaaaggcaaactagttaaaaagaaaataaaactctacagtaaagaaattaaaactatttttgttgaagtaactttcctaggaagtattctattggtatcttttgtcttgaggttaaaaatattgtctactatgtttaaataattatttggctttatttcccaaatggaattgtcactttgatcaaagcatatagagaggcgttgctatttctccttttactctctagtggggtgacttggatgttaaactcaagtaatgagattcagagattaataaactgtctgtaacactgtgccatctgtgaagacttaatcactatacaacacaacaatcacaactgcatgttattgaggcttgttatgaaggaggcagatgttaatctcttcatcttacttaatttggatatcagactttggaagtaagtattcttatctccaatttatagataaagaaactgaggtttaggaatctgattcaagattttccagctgttaagtgatggatccccatcttttaagagccaggattgtcttattattttttttccaggtcatactaaggtctccagtacaaaagtttggatgagcatacttaatttctctttatggaaagggcttgaagggagtattaatatttcacttgttgctggaataatgattgttgatgtttgaaaaaaatgttgtctacaaagattgagaagattttttgtgaacatgaaataaatgagattttgtcatctgtgttgagtagaagaaatatttcccaaatttcagacatcctagcattaaaaatggagaacatgtattaaagccttcaagctttctctgttcttgtttcatttatctatatcaagatacccatgggtatgtgagccatttactggttggttttgtagttttgttacatctggcagtgtttcaaaaggtaatgcaagtgggcaggtgttattattgattgaaataagcagtttacaccagtctaaaacagtgtccgctgcatgcatttattcaccctctgctcccaaatgacagatgagtttgtctttgtgaagaataggttaagccctgattacattattactaaataaaatactctctcttttgactttctctataatgaaactttaattatgtgactaaattgtacagaatctgaaggtcagaaaacccaaaataacacaccatcatacatttctctgtgtgtcctaaaaacatttggtaaaatttaaagttggtggcaacttaaaaaataatactgtagagataattaatttttgtattcactaaatcttaatattacaattgggcatgtctcagaggttaccgagtttctcccagtgtctagcttctatgaaagtataggttaagatctacataaagatacagtggtactcaggtaaataagacatatagtgtctaatgtacatcacaatatacattataatatgaagtatacattaatgtacatccatacatacactagtatcattattaatatacattaaataatatatggcttcagaggccgtgatgagggtcatcagttctgaactctatgaaacagtaagggctgattcaactctatccaaactttttaaacattctaatttttcaaattaaatataataaactggatatttattttaatctgcttagaaatgttggttgattgcgagtctctttctaaagcacatatttaagtttccatttgggaaaacaattagcaatttaataaataaatgacattttgaagtagactgaaggctaatcaatatattagaatgactgtataaaaacaatagaatatacaggtaaatgaggaataatttactttaaattttataatgtctgtagtggggaattcagtagttttctttcagcactgaacaatagtgattttgatggtaatggtcataagaatgccattattcttagtaatattaatggtaaaatgagagatgctaattgagctctttatggtataatgcatgataaattatgtgatatctaaaatatgaagttgaaaggtatttctcatagtgttcttaatgatctataaaaaagcacaaaagtgaaaaatagaattttaatgaggtattcttaaaaaaatcttctatttttgcttttggataaatacatgcaaaatttaaatcttgattgtctttgctgaactattttttaaagtgccaaggacctatttctttttcatagttagcatgcttattttcatgtaactttttataatgaaagacaatacacattcagaaaaagacaaaaagcataaatgtatatacaactcattggactatcaaaaagtgaaaatgctatgtaaatgttacgtaggccaaacatattattgtaactttcatgcccttactgttgactcttacctccctcttcccaccaaataatcatgaccatgaattctattgccatagattagttttgcttattttgaattatatacagaaggaatcatactatatgaacttttaaatatctggctccttgggttaacatcatgcttatgaaaaacacccatgttgtgtctacataggtataactgatttatttttatataatgaaatgtcctacagtaatgaaaataagtaaaagtataaacaatacaattaaaaatataatttaaaaatatagcagtatttaaaaatccattctataattggacatatgaattatactttgggtcaattatgaataatgcttcaaaaatattcacgtacatacatgtcttttgctagctggaaaactgcctgattttgcgctgggtacatcattcttcagagtggaattgccaactcataaaaaatgtatatatttaattttagtagaaaatgcaaactaattttaatggaaattataccaatttatattctcaacagcagtgtattaaaattccatttgttccacattcttgaaaacacttggtattaattttcttttgttttagatgtttattgttaccctcatttttagccattctagttggtgtgcataactctcacactttggttctaattggcattgtccaatgtctaataagattagcaaatatttcgtagatttgttaggcatttaaatacttttttctctttttttctctcattgctttgtagttcactatgtattctggatactaatatactgaaaaataggttctaccattctgtggtttctttctattataacatttttaaatgaacaaagttcttaatgtattctgacatcagtttcctttcatggttaagaaaatcgttgaactccttaaaatcgtgaaaatattcagctatgttatcttcctataacattactgttttgcctttcacatttatgtctacagtcttcctggaattcacttctgcatacggtttgaggtagtgatcaatccttctttaaaaatttctttctttttaattttttatgggtatgtgaaatgttttgatacatgcatgcagtgtgaactaagcacatcatggatggggttatccattccctcaagtgtttatcctttgagttacaaacaatccgagtatactttttaagttactttaaaatgtacagttattattgactatagtcaccctgttgtgctatcaaataataggtcttagtcattctttctgtttgtttgtacccgttaaccatccccacctccctgcaagccccccactacacttctcagcctctagtaaccatctgtctactctctatgtccatgaactcaacttttttgatttttagatttttctttttaaattgttttccaatgtggatatccaatttatacagcaccatgtatttaaaagaattatttttctccccactgctctgcatggcaaacattgttaataatccactctccatacatgctgaatctgtttctggattctctgatctgttccagtgatctgtttgaagaacctgccaataagacattctcttattttctataacattataagacttaatatccagtaaaaaaaaaaccctccaactttgtttttcttgaggagtatcttggtgatttccattttgttacatttccacataaaacttgtaactatcttgtaatttgtgcacacacacaaacattggtttgaatttggtagaatctatatattaatttaggagtattgacatcttttcaatatgtattttctactataaacctttaaaatttttctcaatattttataattttcatgtaaaggcattaaatatattttattagttttttacagttaaataatatagtttgatactaatgtaaatgtcattcaaaaatttcactttctgttgcttttgtataaatgtttaattcatttttatatatagacttttatctaacagacttgctaaactaattctatagatttttcaaatttcctacatttgcactcatacacctataaataaaggcagttttatttcttcctttccaatcctactacctgttaaatatttttcttgccttattacactaactagaagttcattacatatttaatgaaagggtctatacagaacatacttgtcacattctcaaacacaaagcagctctcagcatttcctataatgtatgatacttgctgtatgatttttacagatactctttgcagagttagacattgcctgctgggctaagaattttaatcctgtgtgaatattacattttatgaaatgctttttctgtatttggtgagaaaaccatatgttacttaatgtgataaattacattgaatgacttttaaatattaagcaattcttgcattcctggaattaactcgattgagatatgatttattattttttctatatttttatattgtagaatcatttttaaactatttttaaggagttttggattggcattcatgggtaagatcgacttttattttccttcttgcaagttccttgtcagattttaatatcagggttatgctggcctcacaaaacaagctgggaagcattctctgtttttctgctctttgaaggtacttgtttaatactggtgtgattttgtccttaaatgtttagaagaattcactaggaaagacatcgaggcctgcaattttctgtgtgaatatgtttacaattatgcatgtaatctaacagatgtgggcagttcaggttttcctgttctcatctgttttggtaagtggcgattggtttggaatttatttcatttaaatttgtaaaattagtggcataattcgaaatatcattatcactctaatgtgtataggatcatcgtaagatgctcttttgcattactgatattgtttattcatgtctcctatttttttctttcccagatcaatcctaactagggttttgttaacttaaacgttcttttcaaaaaccaacttgtgttttttttccctaattttggtaatttttcatatgtattttaatcatgaggaataatacctcttgtagaaagaagaatatacagaagtcaaaatgaaaaataattacaatagtctgaatttccaaaattcgggataaacacaattcctccaaattttgtgtatattctttcagatttataacacaaatgtatttatgaagtatgttttctaaacacacacagatgaaatatagaattatactgaatgctatttgatacatatgaccactgtttcctcatttatacatcttcttactacttccctgcttagattattttaaaacatatttaatattgcatgaccttcttcaaagattctacaaaatatatttataatcaataaggagtttgtttttaaatagaacttaaaatgagcatatctaacataatttataagttctgcaatatcataaaataatcataggctatttgacttctgcttgtagtgtaaaaatatctttttagaatttattatttgaattagaattcaaagtctaataatacgttgaattaatacatgttttatagtacaatactatttattacctttgaaatcatttttattgagaaagtatttagttgccataaaatgcacccaaataaagtgcagaaattgatgagttctgataaatgtaaacacctgtttaaccccacaaagaggaatcagaatgtatccatcacccaacagttccttcatgctcctttgtagacaatgctcatcacaccctgaccctggaaataatcagctttctgtcactgtagagtatttttactattctagaattttatataaatgaaatcatcttgtgttcacttttatatctggcatttttcattctacaaaatatttttttaattgttttatgttgttgagtacatcatcagtttatgtcttttattgagtaatttcccattgtatagatatactgtttgttttttttttttaactctgtcttatttttgtcaattattcattcttttctaaaatatttcttaatttttggctttaatttgctttatttttccccctaatgtcttaacttctatccttaactcatttatcttctgcctttcttcttctgatatccatgggctcaatattggtgactttgctttcatttgtgatattgataatttgggtcttttctttcccttttttcccccatagatagcaaactagaggtttatcaatcttagcaaacttttgaaagaaccaccttttagtttgttgattttctcgaatgttttcctgtttccaattttattctttgtgctctaatttttaaaatttctttccttctgcattctttaggcttcaattctaaattctctaataacctaggatgaaaacttgcattatttatttagatctttgtttgttttctaatatatgcatttaatgctacaaattttcctcgaacactgcttttgctctatcctgcgtattttgatgttatattttcattttcatacagatttaaacattctagataatttcacatgaaacttctatttttaacttgaatttttttcagatgtttaggaactttctagttatttttctgttattaatttatagtttaattcctttatgacctgagagcatacattgtatgatttctatttttataaatttgcaagagtgtgttttatgaccgataatacatggtgaatgttccatgtgagcttaagatgagtgtgtctgctgttgttgggtgaaatgttctcaaaatgttaattaaatctagttgaataatagtgatgttcaggtcttctatattcttactgctttcctgcttccttgatacatcaattattccaactataataatggacttctctgtttttaacttgccattctatcagtatttgcctcatctaacgactctgttgttagttgtctacacagttaggattattttaccatcttggaaaattgatcactttgtctttaggaaatgtttcttgctatcccaagtaatcttccttgttcttcaggtttctttgtctgaaattaatgtagctccttcggcttttattttttattagtgttaacgtgtgatatatctttcttcatccatttacttttaatgtacgttagtctatatttaatgtggatttcttgtagacaacatagctgggcctactctttctatatactctgacaatctctttaattggtatatttagattgctcacttttcaagtgattattgatatatttgaattaatatgtatcatgcttttaactgttttctatttgttgcagttgtttttaattttttgccccattttaagttccttatctgattttaattgaaaatttttttatgattctattttatctgctcttttactgtatcagtcatactttaaaaattgtcagtggctgccttaaactaaaccaaagtctattttcaaatattaataatactattctacttattatatagtgcaggtcccttaaaacagagtattcctaacttctcccttacgtacctgacaacattcatttgtaatttaggtgaatgtaatattaatttgcaataaaaattaaattcatttaatttatccatgtgctataagcacccaatgcatgattattattgtaaatgtttgtcttttaactaatgatttcattaactaagaataagaaaaataaatgatcttacttcttttatttcttctttaatgatcttcctttctcaatgtagatccagatttctgagctatataactttccttttgtctgaataacttcttcaaacatttcttatagggaaggaatgctctcgatgcattccctcagtttttgtttgcctgagagtctttatttctccttcactttggaaggataatttctctggatatagagttgtagttttatttttacttctttcaatgctttacatattttactcctctctttgcttgcttgcttgttttctgatgaaaagtccaatgtaagttttatctttctttctctatcagtaatatagctacctttcgatgccctctgcttcttccaaaattttgtttttgtctttggtttactgtaatttgcatctgatatgactcagaatagtttttattttggtttttaatcttcatgtttattctctgagtttcctggatctacagttcagtgtctgtcattaatattgaaaagttattggccattattacttcaagtatttctttgatctattatcttttccttctggtattccacttacgcatatgttacaacgtttataattgcccacaattcttgatactatcttatgcttttcttttttctttttctattacaggtttttttctttttctttttctattacagctttttttttctttgtctattacagcttgagaaatttgtatcttcttttcttttatatatatatatttttattatactttaagttctagggtacatgtgcacaatcttctgatcttttgttggttgtattgaatctgttgttgggcccatcaaaggcattcttcacttctgttccagcatttttaatttgtagcatttctctttgattcttttgcagagttttcatctctcgattacattacccatctgtttttgcatgttttgagctttttccattagaccccttagcatatcaatcatagttgttttaagcccttgtctgattttcaacatctgtggcatatttgagtcttgttctgataattgttttgtctctgcagagtgtggggtttttttttttcttactttttgccattccttgtaatattttgttgaaaccaaaatgcgctatatctgatgacaatagaaactaagacaaataggttgttagtatgaagatttacattactctggctaagaaatgggttacagtttaggtttgctataggtactataggtaccagatgcttccggttcatctaatgcacttatttctattcctccttttgacttaaattctcttcagaggcggtctttgttttttaagtctttcaactgttatccagtattattgcactggactcctgttgtgtggtggttcgatgtgtaagaggagcaatgttctgtaatattccaactcaatttaagtgtttcagtgggttgttgtctcagaactgtgaccttcacaagcatatctctggtggtatagcttttttccctcctgccagctactgtctttcctggctactaggtttccaatctatttctgtgacgctctgactcctgttgcttttttttccttaggtaagacaggaaaggtacggaggctggaatgggagaagtactgccccccagttgggagaggttctggcaaagtcttttcttcaggagaatagccctttgttatgaagaaaaccctgagcatacttcacagtcattccctttcccacttcctgacagagccagaagggagtctttttctaatcttcatagaatgcatggatgggttcttggaggtaaagcccacagaaatgtggagccctctaagactgtggtcaggaacttctcactctcatgctagtctacactcagtttccagagattcaccaaaattatcatagaagttttcctgtcagtttctggtgccagtggcttttgttccaggtggatggatctcagctctgactctttggatggtcccgtccctctagatttcagcatggtggtgtgtcatgtgtactagcttgtgctgctataaccaataccatagactgggtgacttaaacaacagacatttattacttatagttcttgaggttgaaaagtccgagaacaaggtgctacccaattcacttcttggttagggtcctatttgtggtttgcagatggctatctctctgctgtgtctgcacctggtgaagaaaaagaagtctgagctctcttcgtattcttataagggcactaatttcctcatgaaggccccacctcatgaccttatcaaaatttgaatacctcccaaagacctcatttccaaatacagtcacattgtgggttagggcttcaacatagaattttgagagggtgcaatttattctatagcaccatgaaagcacagttctctgatgagtctaagaaaagtgattgatttctagtttgtttgtcttttttcttgtggtgcagtgtagagcagtgtttcactctgagatgggtactgtgtgtgtgtgtataaatattctaatatattctaacagaataatatgtatattctgtagaatatatattagaataatgtatattctgtagaatatatattagaataatgtatattctataggagataaatattaatttccctttaagaacagtttttgctgctattttattattttttattgtacgtaggacactacataagaaaaaaatgaatagacaattttaggcctagaaggctatctttctgcaaagtgtaatttcattcacttttacaggcaaccagaagcactgaacctctctgacatcctcactataattccccacagattggaaagatgggaagtttacctttaatctccgtgcggggctgtcccatctctggctttccctttatcctaaaaagtagatcctctaaattcttacaaaaagcctatggaagcctgtaaaatattctcttctttgagggctctagaactaaaattttgtccctaaccccatgaaagctgctcataaaaccatgaccaaaaacaacaacaacaacaacaacgaaactacccagctattgtttctcctcttcagaaatcctttagttatccctaaagagaaagcctcaaatgctgggctcacctctttgggttttcttcttctagatcttggacatttaatattttattatatttttatctcttcaactttttttttattccaaaaggagggttcagaatttccagtctagcagtaccataatgtgaatttttatagttattgtccatctcaataaaaatttagtcttccacaaaatcgtacatatcatatcctaatataaatgtaagctttatgacttgtccacatatctctcataaaacaatttattgctgtgtttcaacaatagttacagattacagccaagtttgcatctttcctgtgctttttctcttctggctatttgatctgtcttgggaattcaaacccttttatgcaaaaggtactaaacagtatattttataacttgtatctccatagattctaatataatgatttgcacaaggggtctcatcaagttatcattaataattgtgttccttcaaataaatattttaataatattcagtatttttggaaggtggtagagtttgttaaataaaattccattccctttaattttgcaaattgagatgtattatacgtgcagctcaaaacttaacattctaatttgattagtggattctcattgctatttctttattataataaatgaattttacattcataatcaagactgaatcaactttgtaagatacagtcctgatgtcttgttcaacatatgtttaaaagttactctcatctgggtttatgttagcaaattttccacttttcagtagttcttatttctgtttgcttttattatatacttttctagactagataaccttttgggaggcacatttagtaaagatttatacctgacatcataaaattaaaaagtgatttctatttgacagcatgttgctatgatttatttagcatctgaatgtcagctgactatgtcaaaatgaattgtacttgaaaataggtcatgtgtaggacacatgtaggtcacaagaattctcacaacaagggaggttattaatgacaaggggattttcatgtttccctgtttctttgttgaacttctactggtgctgctctttatttggatggagctggactgatttctatataattgcagagtctgctgtgcaactatgtgtaacgggtcccatgtttctgatttataacagtgacgttttagagcttcttacaaattgccatatgggcatctccctttatacttcttggcttttatacgtgagttgctcaattaatatttgaaaaagaaattagtgctattatgcctcttcataaactttagaatcactttggaaatactcaaaatcctgtgagaaactttaattcattaactccataaattttcttggttaaaatacattcctaaattgtctatgaacacctcattgagtttggaaatcaccaagtctaaaagaaaagaaaaatacaatgaaggctttttggtttttatcatgtaagacatataaagttcattttacttctagatattttatgtacttaatgatataacatatattctgtgtctattaggaggttactatttatatgcaagagtcttattgattattcaatgtttatcatttatttttgactccaataattttgggaagatataaagtttaatagaaaagttctttgtctataaaagtcagctggtggagctgagtcccagttcaacaataacctaagttgcattattctaaaatgtgtaaaaggttttaaacataaattatgaggaaaaatgaaaaaagcttcagataaaatattaaatttcctctagggtaagttgtttgctttcatgttctgttgaagtgatgccttttgatggcttagctaaattatgggctttggagtcagaaaagcctggaattaaatccttgctctgccactttctagctgtgtgactttaggcacataacctctataattttcattttcctcagttgtaaagtgggtacaaaaataactacttcacagagttgatgcaaatattaaagctagctaatacatttctgctatgtctgatgctgagcccctaactttcatgttgaaaacatttaaattggtaacatagaacgcaatcactagttgttatggtccaaatatttgtgtctccccaaacttcatatattgaaatcttaaccctcaacaagatggtattaggtggggccttttgggagttgattaggtcaagagtcctgttatggaaatgtaattagtttccttataaaagagacccaaaggagctcattcaccgttccacgatgtgagactacagctagaaagtggcattctatgaaacatgaagtaggccttcaccagacaccgaatctgctggtgccttcattttggactttccagcctccagaactgtgaaaaataaatttttgttgtttataagatactcagtttatgacttttgaagtgagaccttctaaaatattttttctctctgaaaagttgtgagataatatagggaacataaaagaataggatttatacacaaaccagaggagtactttaagagtgaaacaaagatccaaagcacaaaattagcttggcatgcattcaaaatgcaaatttcaggaccctccccacaaatttagtacacaggtgcaagattcgtttctaaagaaacacctcaagtaatgctgacatatactaaagttctgaatctttaaaggaagacataaatgtccctgtaataaaattattatttttgaaaaaagataaagagatacttaaatccatgcattcctttgtgaattgttatggcaacaattcttcatagcaaattgaggaaagtttcctaggcaaaggaatacatttgaaactcaatagcatgcactgaacttttcatttataaagtaatatagcatcatatgcatcattcacaaacattctgaaaatttccatcaaatattaaaatccaaagcagaatcttggttatgtatgaaaaaatttcaacaagtggagcaaaaattgcaaatttattgatcagttaataaatataataaatagtaactgcatatttttccaagtgacactggcattagaaagttatttaaagtatccagagtgctactaagtaatgcttttgcctgctgtatggctatacactcttcctatgtgtgtctccattattttattattataaaattaatacatgcccattaaaaaatctagatttgactggaatgtgctgtaagtcccatatccccaacctcacaattttccttaccctccataagagataattgctaaaagttttgaatatgacaatgatatttttattattaatataaactgtatcttatatttattcttaacgttttcaaaatttaaatagctcataaattgatcaagtgaaaagtgaaaggctgtcatttgcagatgtcttattccatttacctgttggctgtctctgccactgtgcatcttttctcccagtcccttaagaccccaaaatcattgaactcacattaattttgaaacaaatgtgagatcttttggagggtaatttaattaatcatccagctgttcactctgcaagaaattataattagggattgtgttagtctgccagtggcacctaggaaatagaatcaaaagtataagaagatctaagatcctcaaccaaagctgcacattactctaatttggaaagcttgtaaagacataagcatacaggctgggtgcggtggttcacgcctgtaatcctaacaccttgagaggccgaggcgggcagatcatttgaggtcaggagtttgagaccagcctggccaacatggtaaaatcccatctctagtaaaaatgcagaaaaaaaattagccagccatggtgtctggggcccgtaatcccagctacttgggaggctgaggcaggagaattgcttgagcccgggaggtggaggttgcggtgagctgagattgtgccactgcactccagcctgggtgacagagtgagactcggtctaaaaaaacaaaaacaaaaacaaaaagacgtaagcttacacatacacacacccaaagagaaagagagaacaaaatcaatgctcaggctatgagcgctgagagttttaatgtgcagtctaagttcgggaaacattgccctatatcagccatcctaaaagaaattgaaataatcgattttttaggtgaatcatcgggattgccatagaaattgagactgtagtgctctagaggttgggtgggaataagatttggttagtgcaatatagaaaacagctaacctttcttaccaaacctcagtaaaaaattttgaccagtggaacagaatggaaccttctcaggggtctggttatcagagtccaaatatccatggaattaaacaatgttctcctatttatgttctgggaaacactagtctggaaatttgttctgcaaaacaacagcagcaacaatagcaaaaacagaggggagcagttttctggccttatatgtttgagatgcgctaggtaagtgtccctgccatgggttgatacattgcaatttgcacattagcacatgacatgctctgagaggccctgtaattgagacatccgttgaacttttgttttgtttttaagctcagtctttctcaaacatacacattcaacatatattttattgagaaccactttgagctgaacaatgttctaggtgttacggatggaacacaataaacctccctgctttagtagagtttgttttctaggaggataagataaacaggcagataatgatcaaataagagaaatccctcttaaaataaagagaaatacagagaaaatagcaagatatttatggggagtgtcaggtacacaggtactttagagactgtgatcaaaaagggcctgtcttgggggtaatattttagtcaaagcttaaaaggacaagagaggcagggcatgcaaagatctggggaaagaactttcagagcagaatggactgctggtgcgaatccctgagagaactgaacctggcttgttcaaggaggtccagtgtggatagagcataatggaagtggttgctaaagactgtgtttgaataaggagtttagattttgttctaagtggcaaagaaagtgttggggatggcatagtttaatttacctctacaagtgttactgtgtgctcagaggggaagacattgggggtgatggcaaagaacaaaataataataaagaccaggaagaggctgtcagggaagttctggtgaggtgatgctttgttgaactgagtggtcatattgaaataaagagatgccccgattttggatataatttggagatgccatcacagctgtgcctgtgttatgtgagcttgaacatttagtgtatggggtactggtggagtgggggcagaaggtaggggattgattgacaaggagaatcaaattaatttaactataaaacacccaatcttttaaaaatgtactagaaaatgttttggtaaatgatagtaagggaatatttgtgaattagaaagaaaaacaggcagatgatcagataccctgggtattggtgtttctaatgtatttatctttgccttgtgcagtctacatgaggttgatcttatttgttgacccagtcataggcaagggacttatcatgaacctgcaaatgtagttgcatgtccccttattatgaaagaaagaggtggaggagaggagaaggaggaccatgacaaggaaggtgagaaataaaaatgaaatgtaaattattgagaacaacttctgcttcatgctgacttctccacctgtagtcttaacagtgtgctgtgtggaagaaaacaaaagttgcataaatgttgggggctgcagtatgtgggttttacaggtaagctacctattatgtcgatgcatcctgattttatggaagaaacatagctcctggccctaccatgtaatggttgcaatggttgcaaacactggagggatttttttttctttcctttctgacctctaatttccttgtctgcaatttgactgtgctagcttagcatcaattcccaagatttctctagctttcaaattctaaagtccgtaagtttaattacaggtctttccaaattattattgcttccaatttcccttcacaatttgaatgtgtgtatctggcattgtgctgctgaggtttaacaacctgttagctgagtgtagctccaacttgaatgttgcgtggtacttttctttatgttaatgagtaagatgagaaagtgaaagaaccaaaagacatcatagcttaattcattcatcaatgatgtaagcaacttctttgttgactcgaatgattgtttttcaacccttggagaatattttctcaatttttttggtgctattcacaatgttaagtgctacagacatggcacatttttacgtttaatctacactttacagaagcaatttttgttacaggtatcgtggttgaaaactagtttaatggggtggtagaatttaaactctcttaagaaaaaagaaaagttgaagcgacagtaatttctctggatgcagagacatcatgacataactgttaatgtgattttcttatagaaggtagcaccattcatagtaaaatgcagatcacacattgctaatagacattataggtgacaagctgaaatggatgttctccagatacattgatgtgcttctttcccttttcttttagggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagtaagtgtttgtttatccaatacactgacatagatatcaaaagagatgttttaaaagccaaactacaaactgaaatggactttttagctacataaagaggtataaaaaataggaataatttttgtggaaagcttttttgtgcatgcctgtacatgccaatattgactttcatgttcaactttaacattttaattcagagatggaagcacttgatagatggatagatacatatttactgatacatgggaatgtatttcttcaaatagaatattattgactatgttgtaactttcaaatattagaagtttccttcatgagttatatttgatgatatttcatttaggtatcctgagtctaataaaagggacagtgttccatttagtttaaccgtcatgttatgaaaccaaaaaatattttttctttagcctaaaaacaatatcatgcaattcacctttaaatgtgctatgctgtcagtataaattaatagaaaaagagaagacttctgcctgaatataacatgtgtttaaaatactttcacataaaaaagatagaaaccacagatttcacttagtctcctcttaatgaagcattttattatatatattttttgtgaggaagggacctaagagttattgatagtgcacctcaagccacattatcctgttagatacacttttattatagaacagtgggttagttaatatgatttacaattagcagactaacagtgtgaggtttgaagagattcactaatttgctcagagcctcacatatgaaataatctggaagagaacccaggactgctcaattcacgacatcgttttttttttttctctagtaaacatttatttttagctactaaagcttttttcatacatacgctgtcactttgtgatgtaagccaagttaagttctgattcactttctttacataaaagaaaagcaggtgataaagagatcaagtgacttgttgaagttgtctaaactctatccgacagagagatcacattgcatggtttgcgtgggtactctcctgtattttgtgatgttttcagtgtccatctctaccatcaaacatatttgacagacctgattcctccagggcctacagaataatactaataaaagtattaatataatattaatagcaataatagcagtaacactaatagtaatattaatagcattcctttctataactgtagaaatagcaccgtttccttagtgcttattatatgcactattccaagcagtttacgattcctcaaaatagccccgataaatattactgggtaactactccatttacctcttttgaaaatgagaaagctaaagcttagagaggttgacttgctcaagccacacagaaaggaagtggcagagctgggtttgcagccaagtttgccaaactccagaaagcaagcttatattgacatttcctctagttgttgaataacagagatgagtcagtggccaactaacctctcactatctgtccgccttaattgcaggctttcgtggcttcaacaatccagcttagctacaccatgttagttcctcacgtcacaattagtatacctgaataaaatcacgcattaaaaaaatcctacccccaattatgatcctgcaaactagaagttggacagtagtcttatttgtctttggatcgtagagcttagcaaagctcatgccacatgatggacaactagtaaaaccaatttcaaagtgcttcctgtttacagttatattctccacttattcagaacatccaccttgcaaaatacttgtctatcacagtataaaaatagctaacagttattgtgcatgtattttttgtagacattctactaataatttaatcctcaaaaccacccatttattagagagaaaactgggtcttagaaacattaagcaatttgttcagtaccacacccttagtatgcattaaacctaggatataaactcaatattaacaaatttaacattaagagcaacagtttagtgggactgtttatgctgttttgctggctctaaagcaccaggtataatgtccacatggtggtgatagctaaggtacaggttcttttgagttatctgctgctctgtggctaatgataactcaaacctccccctcacctgtcttgatctgcagctctctggaatgttctttttgttgcaacttcatttgctatatttggggtgagcatactgtccatgtatttggtcaatattcttttcacattgacccatggttgaagtagtagtactggaagccagcaggattttaaactcaaacttaaacacatatagtgaaatagtgtggcaggagttaatgacaaatgatggttgtgtaactttaaaccattattaaaggagaaaaagtaataaacttaatggataaacattcttgtagataatcagaaaataaccaaagaatgggttgggcatgagtaccttatgggaatgtatttgatcaaattggcttttatacctcaattacaccatagtcatgctcacattttccacctgttcatagcattggcattgcaatatatttattaaaatgtgatattatatagccatcatttattaaagttaatatgtgtcagagactgtaaagaataagcatcttctgatttgttcctagtaatgtagggaagcaggcacatgaatattgccatttcatgcaggagtcagaggagaaaagcagaattatctactgaataagacatacagcttgctctgggtggcatggcaaagaaatagctaggactactggctttccctgccctcagaaggaagggctgtagttgctatcatcacaagtatcctgttgcaagagtttgtctgcaactcccttaagtagcacagacccaagatcagattggattttccccagacacaaaagactgttctcccgaaatccctattaaaaggaaaagtggtgttggggagtgggtagggtttctttactgaatcacagccacaggacattcatccatgcccaacaaagtaggtttcccctgagcttgaggaaggcctgaaggattgcatgcaactggccatcctcccctgtctgtgcctcctcatctgcaccaaattaacgtgactcaggtgcgcttcgcctgagccattcactcaagtgtagcacacctcgcagactgcttcatctcttctgacatagaagaaggtgaacttaagagaaattggtaacttctgcagaactacacaacccgtgttagatctaggatttaaaatcagctgtctcattttcctaagccagtgcccttgataactatgtgaatcatacatgtattgagcctttaaccatttattggtacttgccaaaaagaactaggtatggggtatagggagatattctaaagtcataaatattttcttaataaagacaggcatgtgcaatgttagaaaaattatatgaactaagtataaaatattgtagaaggagtatagggtgtgagggataaagtgattgataaattgtggttagtataagaaagtttatagcagtagattttgaaacaaagttgcagatattttcacatgggagactgaaaggatggtccaaataggaaaagtgctgtaccccagtcaagcacaggaaagaggattgctggaatgattatttgagtacagtcattcagactgaaattagggctatgggttagagggtgaaatctggaggcagcaactcattagaaggctttcactcttgtttggacaagtgatggtagaaccccaagctagaggaacagcaatcagtaaagggggaggaagggcaaggcgcggtggctcatgcctgtaattccaggactttggaaggtggaggtggggggttacctgaggtcaggagttcgagaccagcctggccaacatggcaaaaccctgtctctacttaaaatacaaaaattagccgggcgtggcagcgcacgcctgtaatcctagctacttgggaggctgagacaggagaatcacttgaacccaggaagtggaggttgcagtgaaccgaaatcatcccactgcacttcagcctgggcagcagagtgagactctgtctcaaaagtaaagggggaggtaagcagattcaaaatattcttaggatattgaatcaagatatcttggtcattgtatgtgagggaacactgagttatcaaatttgctttttttctttcctccgttgatcctttttttttccttcaaatttgaacaactgtctggaaggggctgtcatttactaagatgggaaatgagacaataaatagattgtggaaggaaacaagagataattaatcctgtttttgacacattgagttcaagggcctttgatatatggaagattggaactccaagccctctgagttgaagacgtagaattaaaacctatataaatatcattattgttagtaaatcataaagtattctacttattgtactacagttaataacaaatgcgtgaagtgctatgtttgatcgactactcatgtcttgaaaaatgggaatgcatttccgtcataataaaagcagctcctttgtactattttttaggtggaataaatatttttatgccaggctccccttgtgcctaatacatgtttgctgaagtcatagatgcaagcctatcctgtgattattacaggaaaatggctattgtgaaaaccacacataaattgccgtttaccccaacaagttagggcagtaacttgttatgaaggaacatcaagtgaatggaaaatccatatcaaagagcatgttctacttttatgtcagtaaacttgaagttgtttcctgagtaatgagagaagtagaggctaaattttatgggatcaaagagaaactataaatttccaatatcttggccatagcagcagtgatcctgtttgcagatctggagaagaaatgtatagaagtaaattactggtgggagaaagaaagaaaaagaaaagaaaatgtttgatgctacagaaacaatactacatgtctgaaagagaagtaaacaatggtgaacaaaggaaaataaatgggtgaaagtgaatatatctgcaatgtccttaggaagcagcaattaaaccataggagataatgttctttaattgtggatgaattgctgaggcagttgtccttagtgtaaattctaatttccttttctctagttactgtataaacatcctcattttgcagcctatgatcatctcttcctcatccccaacagaataagaacatccaactgtcaagccatactcaactaatttgtttctttggctagccatgattttatgatttttctagccttagggtttctgcatgatgcctagggcaatcaccacgtacccaccagccttcatttctctatttggataactctcttactcattcttcttttctcagcatagaaatctctgcttctgacaacttctctaataccccacattcaaatctgggaatgtttccacccacttgtagaacagcttttcttctcccaatcatgacatgcccacgttatactgggttgcaaccagacattctttttttgttattagtcttctggataaagactaataacaacaatgaagaatgaatgaatgggggcaagcttagtaagcctcaggaatgctttctccatcattctagtgttcaacttgttaaagatcaggaataaaggttagcctaccaggagaactgagggagaagattggacatgatgagcaaatgtacagatgtgttaaaccattgtgtttaattgcttcaatgcagacagttgaagagaaaattatggatcatatttaataaattaaacatcaatcattttaaaacatattaacttgcacataataggaatgtatactttattatttaaaaaaattccaatttttttacataataaactataaagttggaattataaccatcagcagatttaagtttagaaaacatataaagaggacaatttaaaaagtactgtaaaagcacagacatttacctgggtgaggaaaacaaaacattgaaagacagctagataatagtctctgtctattcaggatgctaatctctcataccacctgtctggttagggggaagaatgaaaagcaataaattggttagatttattaaaatgatagttataattgagttcaatacctatttattgagcaactcccacatgctaactgctaaaagctggagtaaggtgaattagatagttcttacactcagattatctatcagctaatatagtagctgagaaatactgttttatgtcaaagtttgaaaagaagatagactctgattggcctaaaatcaaagagtataaattctctaattctttgcaaaatttataattttaagtttgatgacaagtggagtgtattagggttctctagaaagacagaactaatatatatatgtgtgtgtgtgttctgtatatatatgcacacacacatatatagaaatttatatatacaaagggatatatatctaataagatacatttgtataattaaaatatatatatttataaatatatatactagaaatattgaaatatcgaatatatataaaggggagtttattaagtattattaagtagtttactgagtattaagtattatcgttaagtagttattaaggtctctccaaataagattatgacacaaagccacaaagctggagagtttgatatacccctgaggtaggacagtaaaggtatattgctggcattgccagctgaaagcaaattgtttctggtgagccttatggacaggaatggagaaaaaggcatttgccaagtcaatggctgcacaccaggtaccaggagatgtgttaattggagcaggcaatgaaaccacatctagtacaacagctgcaattgcaatcaccacttgattaagcttacaataatccgctgtcattttccaagatccatctgtcttctgcagaggccaaatgggagagttgaatggggatgtggtgggaatcaccacccctgcatctttcaagtctttgatgttggcactaatctctgcagcccctccagggatgtgatattgtttttcatttactatttttcttggtagaggcagctctaagggcttccatttggcctttcccaccataatagccctcaacctcccagccaggaagccaatgtggaggttccgccagctgctaagtatgtctgtgccaattatgcatcctggcactggggaaatgaccacaggatgagtctggggacgcactggacctactataagtcacacttgagctagaactccattaatcacctgacctccataagcccctactttaactggagcaccacaatgatgttttaggtcccctaaaatcagcgtcaactcagagacagtgtccagtggtccctgaagtgcctgattattttcctttccccagtgcacagttaccctggtaaaaggctgaatgtctcctcggggaaggataggagaaagattaacagcatacattgtcagtagggtagtagggtccttcctcaaagggacctggcctccccttcattcaaggggttctgggtctgtaaactggctcaagtctggaagttgactgaagggctgtgattctctgtttttataattcaaatgagtcttttgtcaattcaacctagaagttttctacttatataaattaagcaggagtgcagtaggcttcctatcagttttacttctaggaacactgtgattaattagccaatgccagagctctatacaagtcagactattgtgattgctgttttgcctctgctgtccattacagtagctacgcctgccttgcctttgatgtttgagtgccaccacttggttcctgccacctcaggatccagttattcccattttatttaaattttgtcgttgagtgactgtggttcccactgttagatctgacatacagggaagagcaattgtagggctcttcaaagatgcagatgctgccctcacaaatctgttttgcaaggtgttggtcaagggtatatcttctggaccctcccagctgggatgagtaggtctaaagtgactaatctactccaccatccccatctccctaagcctttggattcctttctctacattaacccaagggacatcaggcttccagctcgctcacagtgggccatcttttaatccttatttcagctaactaagcaaataagctgttagaaccttttttaaaactccctaagctgcaacgttaaatgcagaatacctacttagtgggctgaaatcaataaattcagcctgatctaattctatgtttcttccaccattatcccacacccttaatatccattcccatccctgttctccagatttctcttcatataaattagaaaactcaagaagttcttttcaagtgtagtgcacctcctcatgggtcacactctgaatgtcacctctaggggcccgccaggactttagtctagttataggtatagaacaaacaggggtgttggggttggttcctcaggagaatcaacattatctctcctggcaactgcctcaggggaggccatcactgttgtctcaggcagcgcagggtttatctcctcagacaaaggtggaaagaatgatggcagtgtgggtcagggaggggatgatgccgctactggggatgggaaagctgtttcttctggcaagaaaggttcatcagagtttacaaggtcagtgtccccagcttcatcagggtcctcccgcacatccccattccaagttgcaaggttccattcttttccaatcaatgccttcattttaacagtagacatggcaaggctgtgcatccacctttccttgcagttcagccactcacatgataagagctcatgtctgattttccacaatttcagctttctctaaaggagataagactctgactcgggtcagtcttagaagatttgagacccactatctgcttctgaagccaggagacagaatccctgagttcatcattttctttcatcactttgtccagtgaactgaggagcaaccaaccagcttcattatgttccttggttctccacatatggtcaaaggtattatgtatagagtcactaaactccttacctctcacaagtggtaaatcaggagtgtccaatgcattaattttgcctaactctctaaacagttcatgccaaggactatcagtgttctccatactattagaagtagagtccttagcatttttgggtctaatcatattaagcagccaactccagaaaccccaaaacagctaaagaactccatccttaatattctgttcctgtagaaccactcctggtaccaaaatctgtattagtcagtattaatctgactaatacagaatatctatctatctatctatctatctgtctatctaggagtttattaaggagtattaattcacatgatcacaaggtcctacaataggccatctgcaagctgaggagcaaggaagctagtccacgtttcaaagctgaagaacttggagtctgatgtttgagggcaggaagcatccagcatgggaggaagatgtaggcggggaggctaagccagtccagcgttttcgtgtttttctgcctgctttatatttgctggcagctgattagttggtgcccacccagattaagggtgggtctgccttccccagcccactgactgaaatgttaatctcctttggcaacaccctcacagacacacccaggatcaatactttgcatacttcagtccaatcaagttgagactcagtattaatcattacatggagttatattaaaattaaaataagattagctattaagatactagaaaataaggaaactatgaaaacctatcagggtcatggcaaaagaattcagcatcagttgaagaggctctcactgaccaaaagtgaaaatgttttagtatcaaaaaggatagtaactgctaagttttgcaacaaattaagtatgtttgaatgaatgggttcatgataataataattgaaaaagccccattgatcacctatgagagacataaagacccaactccttattttgaaaactaatgaacgaatagaggaaacacgaaccatatcttaattttcctatgtaacttgaacctccaggtaaccagatagaagagaggagtatctctttaattaaatattttaggtaataaataaaaatgaataatagaattagaaaatgtctatttggcagcactaaataaatgactggttcaagctaactatgacggttcacaacaagggagaagatcagtttttcagtatcagtcatggcgttgtagcttttattggactaagctgctgtccataaaattataagtgttaaataaaatatattttaaaagcctgcttcagagttctgaagtttaaggtattaataaaatgaaagaaactggagcagaattgattcttggaataagggaagtaaactttgggaaatccacatttatcttgcttttaccaaaggaccagcagaaaatagctagattttactaggaagtggggacagaggtcagatttcaagttgccagagaggctagaaattgagtagggaatatttagaagaagatcagagagcaagggtccgtgctcctgcagacacatttccctcagatccttggccaattcttgtaactcacatgctcaaggtgaaatgccaagcagccctagagaaagcacgagaaagaggtttaaaagtctaaagatttcagtatctacgtagggctggaaggggaccacctttggagttcaagtcctgccaatttagaggaatttgttaaacaccttggagttttactgaaatgccacaaggtaatctgtcacaggaatagagatgttttttaaaaagggaagaaagaaatcccacaagagtattgccttgggagtaaagactgtacctgaggacatattgttatatcctagagctaaggacaaaaccaaaatagacttatccaacaaaacttgaaactaaggcttcacagggtctaggtgatcagccagtaattcacctccctgtggaccactgccatttacttcccgccagtgccatccagctcgccactgtctctcctacactcctaacaggcctcatccctcccatacccacactctcccttttcccacttcctccttctttcctggccgctgctgacacatagggttacctactcagcttaaatagcacttccttagagatattgtttctgaacaccaaacaaatttaaatctccgtgttcaaaactctcctgtaaccctgtcctttcattccatgctttggaacttgtacatttgtctgtacatgtgtacatttgtacaattacaacttgtaaatatgtacaattacatatctttactactttactatatttttaaatagaccaattgtaattgtacatatttaccaacttgtaaatgtacatatttacattataatgtgtaatatgtctgtacacacaggaggatttgcctgctctcttccttcgggatggagcatccttgaggccaggtgtgttcactgtagcaacagcagctcccaccgtagcacttgacacagcattcaataactattggttaaatggctgaattaaaaaaaatctgattatccatgatgtaaattgtatcataaatacataaaaatcacaaatgtattacattcatacagcagtagttgatcaaaagagagataactttgagataaacgtgatttcaagtgttgttattattaaaatcataacagtatacaaaataatgttgaggcattttgatatttccatttgatccctctagcatctttgtgtagtatgagaggctggaatttttcagtacatagccaaataaggaaactgagaatcaacatttaggtgacttctgtgacattgcaaaagttgcaaatgaatattagagccaaaaatgcaacttacatcctccggtgatgcattcaagtgtccttgacatagtggatattactaatttcaaatctgtttaaaagattaatttacattgacaaaaattaagtgagaatgatcatgttttttcccataacctgctggtgtgttgttactgaccttaacttggtctatttaaaaagataataagggcaccttttccctgtggttatatatagcacttgatctctgtgccttcttcctttttattgtattaattttagttgttttaaacttaagagtccttaaatcattctgtgttctgttatgctaccatgcaaaaatagtataatctatttcctgttgatttcttgagtacttggtctctcttctccattgctttaaaaaaccagttcagtaatgcaggtctcaagtgcctatctatcatgctgctactttaatatttcactatataatagttaaacagcgactcagtctgatttgtgtttcttagaagtcaaaattggacctctgtttgtttagtaattcatgggcaataactttcaaataaataaacagtatgatcagtgtttaaggctgacttcatttttaactaagaagagtttggtctatacccctttccagttgatgaaatagctatatattttttttctctgatctttgacaggaacattctagttctatttacattttggggagattcctaaagaattaataaaagactctagtgtctttttcaatcactctttcatgaccttcaaatacagttaattttctattatttaaaaattgattttctaatttacacattttctattccaatttttctcttttaagtttttagtcatctgacctcagcaaaaattccatgattcatagtttcactcacagaatcaatttatcccgaaaacatcttcaagggacaaatctctaccacctccacaattatcggcaagtaccacccacagtataaataaataaaacattcatttccatggtacaattcatttccaggtacaattcaatatgcaatggggttatttattttcagagaataggtttatggaacctacttgttcttcctatcaaacaaccctcatgctgccatctgcctcagaatcatttagggacctgtattcctgttccaggttagaattccagagattctaatttggtgaacattaggccaagcccaggaagtagaatgttgaatgtttatggagatcccaagggattcttttccattggttccaatataactggaccatagagctcagttcatggtcttgaatatttttcttagtaattcacttgggggtgaggaggacattgctttttcaagtgacaacccctcaaaatttgagaagcctcaaacttctggagaagggctaggatgcaggggtggggagaagataccaggaaaactggaatatattgccatgaggggtgtgtgtgtatgtgaaatatgcagtggtagaaaaagtttgctgctcaagaaggtaaagcgtttttacaatttagttgagacccttcttagaggctacagcggatcaactccctctcctgcatgtcttagaaatcattcaatacccagccgtgatacaaaagcggaactctgaagacaggcatgaataattgcatctcagggttgtgtgtcttccccaattgactataagctctttcaaaaaaacaaaaagtgttctttgtttttatgcatcactgtgtcttccacggtattcacagaaagctctccataaatacatgctgcaggaaaaaaggcagaagacacatttcaagaatactacatctgacacaactccctgaaagatatttgaatattttctattgcaaagctcttaattccatggcagattgtatttctgaattgtgtaaataaagcaagctatacctacgggcacagggagaattgatatgagagtagggcgtacaatctttttgagtctcttctttcctcgattcttgctgtaaatgtgaagatttgagatggaggtattcactgagggggaatcaggtcaccagcaattgctgtggtaagtcagcttgggtaggagctgacagacacagaaaaagccacagaacccacagatggcttgaaatcatccttgctgcataacctggcaatgacattgataattaagggtttcttatgtacttcagcaattcattattatttaaagagtcacaaatacaccaaatgtacttattaaactattttttgctatgcaccttttcctgcccaatattctaacaataaatcctagtgctagcattagtagttaatattcatttattgctaattgtgtgtcagcttctaaaaactaggcagataagcatgcatacaacaatcctaagaagactatactattattctcattttacaaatgagacaacagggacaaagaggttaagtaactcactgtgataaagaggataatacctccctaatatcttagtccctgaaacctgtaaatatgttgtgttaccatggcaaaagcgctttgcagatgtcattaacttagggatcttacaatggggagattattttggtttatccaggcggacctgatgtaatcacaagggtccttataaaagggaagtaggaggcagggagggagagagggaaagaaaggaagatttgaagatgctgtgacactggtcacatgaaggaagaggccacgagccaagtggtctctaaaaggtagaaaagacaaagaaatgaattattttttagagactttagaaggaaaaagctcctgccaacaccttgattttaggacttctgaattccagaattgtaagataataaatttgtgatatattaagagactatgtttgtggttatttgttttacaacaataataggaagctgtctgaatccttttatgttgctataacagaatatctgaggctgggtaatttattaaaaatagaggtttatttagcttatggttctgcaggctgggaagttcaagaagcatggtgctaacatctgctgggcttctggtgagggcttttgcagggtcaaaacagtggagaaggtcaaaagggatgtggaaaagtgcaaaaaggcaaaacctgaggggtgtcttgctttatagcaacacactcttgcaagaacaaatccattctcatgagaactaatcagtctcatgagagaagggattcactcactaccctgagaacagccacaaaccattcataagggatctgcctcatggttcaaaccctttccactgggccacaactcccagcactgccacactggggaacaaatttcaatatgagttttggtggagacaaaccacatccataccatggcagaaaataatatacttgctcaagtttgagtgagtattcaaaccagcacagactagttgccttaactactatgccaacatgaaatatatattattagaaatggctgaaaagggggctagactaaaaagcggggaatttgtcagaacaatttgcaactgtggtcagagaactagagttcataccctgcccatagtgagccagtgtatgacagagccacattattaatctcgataataacccaatcatttaaaatatagaatgtaaaatatgtataatatatacttaaatatataaaacctcagttaataagcatactaatgaacaaattcacagttagaaaaataattcttattcttcctttcagttaagcaaaaagtctcctcttacatctttagactgtaggccttttactgttacaaattttgttaacttcagatttcacatttttcctatggtcaattttataatacttctacttttcctatttatacaattcaactatgtacaaaagattgtcttcccagcctgggcaacatggagaaactccatttctgccaaaaatacaaaaaattagctggacatggtggcaaattcctgtagtctcaactacttggaaggctgaggctgaggttggaggttcacttgagcctcggaggtcagggctgcagtgagctgagattatgccattgcactccagcctaggtgacagagggagaccctgtccaaaaaaaatattttcccaaaggtatttacaaaagataggagtaagtatgatattgactgttaatttaaatattaattttattttggatgcttaatttagtgtttctaaaataaatattgatttgtactaattttagcaattctatttactcatatctttcatagattagtacaatacaaagacatattgctatgaatcaccctgaaattttttatttttgtatctgtttgcattgctgttgcttttttaagagctcaaatatctgagaatctttgtggaatagtgaaaataaattctggtgatggctaagatttgatatgttgctttcttggtcattgatgtgaaatccaaacgtatgttttcagttcgcaatgttaaagtaaattttcaaaacataaaaacataacttccattcaaatacagaatatacatgtatcaaagaagtatttgattcattaatgaaggaatcagaaggatggtaaaactagtttcaaagaaaattcaagagattgagtgtatatataggaatccaggaaagcatgttagaataatattactaggtagatacgcaagaagttaatattcaacaggacaataaacccataacctttggagatatagtttctaccagacagaagcaatttgcatctctactgagcaaaaatctacagattatgtttaactttatagaatctggccttaattattattcattcagtaataaatagtaaaatcagaatttattaattcacctagaattaaataatctttacctgttagaagatgttctacaatgacattgagaagatgtgaagttatttctttgctttatttatttccacttttttttctaatttttcttaacagtggtaagatcactttcaagagaatctatactcctgtctctgtcaccagcatttttggacagctgagtactgtccaaaatatatagaattgaaatgctccttctctctctcaaaagattaattttttcaggtttttatatgattaactttatgccacataactcagaattttgtaattgtttaagatgatttttaaagtatatcaaatgggtgcaaataactttttataaaaattgcttataaaaagtgacctacaatgagtgttatatctaaaataatactgttaaaaatcatccagaattttttttcatttcctgagagtctgtttctatatattaaatgtgtatcctttgaagttttcctgtactgataatgtactcgcattgtgaattatactgaactttttttctctgaagggtattgtttacctgcatgggaaatctgtgatgcgactgtagccagtttgttgatttccgtctttctgtactttgttcctttcaggtcccctttttcaaggtgagccaacctcactcctactctgagtactaaattatttcctgtcactgtagtttctcagcaatcctcagagctctctcttatgacagtgaatgggacagtgctgggaaaatgtctaggcctcttgaaattaagtgttccaagagtaatcctagtttatggggacaagttataggacttgaagactgtagagggtggcaagattactgattaagatctccctttgcctcctgtttctagacctgagaactgagagagccctttatcaactaccttaagtgactccagccttctgttactcttgatcagaatgcctgttacaacctgtaatgcttttatgaacttagttgtttacttgctaaatattgtctgtcttcactaaatggaaacaccatgaggacaggggccatatttatgttgaattttttttaaatcccagaatctggcacactgattcaaacgtgatgggtcaaataaagttttattgaatgaattcatagaattgcattgtcgtgtacctgtgaagcaaggagacagtaagaatgacagaaaatgacaagtggccttggtttaagagtatgcaattgctttaggcattaatggttttatatgtttttctctatgccattttgctgattgaaatattccaggcacaaaagctttaggtgccacagaagatacatatcatcattataatgtaataataacagcagcgaaaaagaaaaaaaaagtactagtagctaaagtaacacaagctaaacctttaatgggaaaaattctcttggtagctaatttcaaaaatagtctttacctaaaatgaaatcattactgtcatagttgcctttaagtgatacattaactcggagataactgcattgctccaaatgtgtcagcatttaaagtctgtcttactggaatttttcttaatttattgtaatctaataatcataggatgcattatttgtatttgacacagttgtatttttcccatgcgcattcattcagctatgtaacgaggaaggattgttaggctaacattattctttctacagaatgcagtatttattcatgtgcacttggtgaatgaattctctataagcacattagcaaaatgtgaaaaaaataaaacctctgagtcttcaaaagatggctgcataaaatagttgaaaaaaatttgcagggtggtgtgtatagacatttcacataaaatatgatggataatctgaatcaaatgcatatttgggcttacaagtagctataataactttgtcacatcaaacaagatgagtaaactggaatgtcatttcgttgactggaagaagccagcttaccagttgaaaaatcgcttcatattttattgtattttttgagcctcttcatttattacataagtgcactctcaagggtaattgccttaaaaaaatctttgacttgtgaaatgtagacaataccgtcaggatttccaagtgttatgagttctttttaatgtctcttgttcaggtgcaactgattttgacagatgtattgttaggttactggtataacatgacatcttttttcagatgaaatgagtaagagtgattttgacaataagtagataagacagtcagaaagttgaaaaaaacatgtcaatgtcacagttatgccacaaatactacagaacagaccttacaatatcattaagtcagggtctttccaacaatgtccttgagaagacagaaaatagtattgcccttaaatactaccacttagccacagacggaaaataagacaaaacacaaagatcagtttaatgtgtactcaaggcggcatttgatgagtctatgctatgtgtgtatatttgtgtatagacctcgttaacatactgtatggatgaaagaattttgagatatcaaaaccactttttctggagccaaaaaagcatttaactttagaattccaagaactccattaaaaaacattgattgtgaaatatgcaaagtgatttaatgtatattaattataactttgttgaatggaataagaagaaatagcctttaataatatgagaaaaaggccaggcacagtggctcacgcctttaatcgcagcactttgggtggctgaggtaggcagatcgcctaaacccaggaattcgagaccagcctgggcaacataatgaggacttcatctccataaaaaataaacaaaattagctgagcatggtagtgcacccttgtggttccacttactcaggaggttgaggtgggagggtcgcttgagcctcagaggtcaaggctgcagtgagccaagatagtgtgagtaccactgcattccagcctgggtgacaaagaagaccctgcctgaaaaattatatatatgaaattatgtatatatatatatgaaattatatatatatatgagaaatttaggaatacatttaaaaatgtatttctagatcatgaattttgtaaacaggttagtaaagactaaaatgaaatcaaccccatgtgtcaatagggaattagatgtttggtggtcatattttcccttactattgactggtcagaagctggactacacagacagtccctgacttacagagattcaacttacagttttttgactttacagtggtgtagagacaatatgcattcagtagaaaccatgcctcaagtacctatccagccatgctgtctttcactttcagtgcagtattcaataaattacatgagatattcaacactttattataaaatggtttttgtgttagatgattttgttcaacaataagctaatgtaagtgttctgagcatgtttaaggtaggctaggctaaactatgaggtttggtgggttacatgtattagatgcattttcaactaacaatatttttaacttaagatgggtttatcaggatataactccatcattagttgaggagcatctgtatatgcatgtgtatgagtacgtatactgccttttctcaatatataatgcatttaaaatgatttaatggaaaagatatttatccttagaatgccttctactatctttgtttctaggatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtaaaactattcggtgaagtgctcaaaaatctgattatttagatatcacctaagtcactttatgcttttatagcttatcttttagcagtcagagtgccttattttcagattcaagggcttgtacatatgtcaatattgctctttcatgtaaaaatggttcatattttgcaaattgcacaaaatcttcagtgtttttttacatagtgctgatagaaccatatagctattttctaacatcataaaggaagggatgggtcattgaaaaatgttgaggtagtaaaaataatgaggttgtggcaaagataaaatttacatagaaaatgagcgtgcaatcagtaataatgacaaaaagaattaacaacggaggaaattacaacaaggttgagatattattatattgaaacttcggggaaatgcatcctagtatttgaaacggaatgcgtagaaggagattgcaattattatgaaagatggtggtccacagaagggaaccttttttttttttctttagactggcaataatggtgctgttatttttctcctcttctaaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgaggtgtgatggttatgtttcaattaatgctgattttattatgtatatgtggtttaatctcccagaggaaaatacactataaagagcccaccttttcagtaaatcatagaacaggtgaagcatttcccaaggcagtctaactcacagtggcagctttcggtgtatagtacttgaaccttcatctttctcacagtatgtaaatttattgttatagagggagatgatcttttttacctaaaatatgtagtcacagaacatcatatgcaggaaatcttctgcaccaaaaaaatcttattaccacaagcaaatataggatgtttgctatgacttctttgtgttctagggtatttgtgagcagtatagatttataaggagaatgtaccaacaaattgattaattaattcattagcaatggattcaaatgctcaaatatcaatatgtgctagaagcgtatctaaaataaaatattataattggttatagtattaaacagatcaagttttaccatgttataaagatgtatttttcatcgaccagtgaatatcaaagccagatgtgatcagcaacttgtaaaaataaagttctagtgtaaataaaagctaaatgcacataaatttgttttaaatctatatcttaatttttgtgtgtgtagggttatgaaaaattgatctgtgtgtgatgattatagctatacttgctaatcataattaagcagatttttagaaaatcactaaacaatattattgatgccatttttctttctaagatcagctttggagggattccagcacctggaaaatcagtgtcattcccacatagaaattttcatggatgtttagaaaatctctattataatggagtggatatcattgatttggccaagcagcaaaaaccacagatcattgctatggtgagagtctttatgcgaagacattagtaaaactatatttcttttttccacacagtaaaattcctccattttaggttcccatttgacatggggttttagaggtactcttatttaaatatttttctttgattggcaatatgcatataaaagattggttctatctgaaggaattataattttgggggcataattattttatttttatatgaagtaaagcagtgtttttatggttgatattttaattttattgtgatgtcattactcacaggagcctaatttcttttaatctgtattttttttttcttttttgagatgaagtctcactctgtcacccaggctggggtgcagtggcataatctcggctcactgcagcctccgcctcccagattcaagcgattctcctacctcagcctcctgagtagctgggacttgtagtcctgccaacacacctggctaattttttgtatattttgtagagacaaggttttgccatgttagccaggctgatcttgaactcctgaccttgggtgatccgcctgcctcagcctcccaaagtgctgggattacaggcatgagccactatgcccagcctgctctgtgattttttaaataagatattccctgacaaacttaccagatgagcataaagagtttctggaatcagataacaaccatgtatattagggagacatttgaaaaacttgtattttgccatagtcattcatgataaataaaagagacgaacagacaacagcatgtaagaaacatcacatgtaggaaatctgcaccaagagatcttactaccgcaagcaaatacaggttgtgttacaatattgcatcggccaatctgtccaaatggcaatgttggtcagactgcattacattctaattctgtggaaacggggacaatttaaatatagctgtcttggttaggtttcagttagggaagcagcaccaatgctaggtattgtgaacagtggatctatattaggacttggacctcagcaattttcagaggaactaaaaaatgaatggcctggcaggggaagtgcgaggatcagagaagtcattaattctgcccaaagcagtgatgtgtggaggcatgttggaacttacagacattttcagcctaggagggttgaagagaactttggcagttgttgcctgtgggtagccaccacccctgtgtgtccccagccatgcatccagcgatgggcctgggcttgctgtcggtcggttgggccagctgtcaggaagaagagatgggccatagtgcaggagagcaaggacagactggaacaaaccagccgctgtgtgaccacccctcatcgcacatgattagaaaaacaaccttaggggcaaaatgtgttgctggtgttttaattctaactatcaagtatcacccaagctctcttttttggcttttactcagaagcagacaagtaaggggatcctgggaaacatggtttctagctttaccagtttgataataaaatacaggcacatattgatttgaataaatttctttcattgcttaaaatccaaagtgggtaaatttaagctcatgtgtcagcaaatcccaaagcacatcacaagtgtatttattgtttaaacagcattttatttctaattatgtgaattggtggtatttatatgaccacaacagccagcaagattttaaaatagtatttttaataaaagcaaaattatttaaaataaaaataaaaatattttagatagatgtgtgtgtgtgtgtgtgtgtgtgtgtgtgtgtgtattttatccataaaatgagtttctagaaactgcaaggaccattcactcttcattggcaagaggatttgctgctggtaagctatcatgcagctatccaaatgatgcataagatcaagctgcaggttaatgggtacaaaaatatgattagaaagaagaggggcaataaattctagttttcaatagcacagtagggcgactatagttaataaggatttatagtatatttcaaaatagctacaagataagttttgtaatgttctcaacacaaagaaaagataaatgtttgaaatgatggacatcccaattatcccgatttgctcattacgtattatatatatgtatcaaaatatcacatgtgcctcataaatatatacaactattatgtatcactaagaaaaaagaccaagctgcagctggtaaaaatgtttttttttttttccctaggtttgatagtcttaaaattgcctttacacatatgggttagtgtagtttgctgttcagcttttgttatttcattcattggaacaatgtatttgtttataataaaagtgaattcacttttcacagattcataatagagccaaatgttttcgtttgaccaagaccaaatgttttattccaatgtgtattcttctaaataagcttgacttcattgacttttaaatttatattaaagttgagaaatggagagaagagcagagcaaagggttgaagaacctttaagaaatatggcagtggtttggactgtcatgttgatagcaggcagttgttttaaatcgcggataatgtgagattgaaaagcagccttcaaattctgttactaatgtgatgtgaataacattctgaaagctttttcttttactttattctcagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtaataaatgtattccctggggcaaagcatatggatttgaaagatttcattatctctgtggccaaattttatgcataaccaaaaatgtaatatttgcttaataaatgaatactcaggttaataagattataagtactcttccttagaggaacttgattccaattttcttttaaatatggttccaacactagcagttcttattaaccaaaatgatagttttggggaactgaagtttcctttcacgaccctgtctcccactccagacaaagaacatatcctaaggtgatgtgttttggggaaaacatgaagaccttgaaataggccaacaagttaactaagtgttcttcaatggaaaactagactcttcctaacacacttgttagtcttatctggtctgtgagaaaaagggagaggtctttctgggatctatatctatatctctgtatgagtgtacagtgtgaatggtaactttatttgctgatgtcttatgtaaagagttgaatacattttgaggggatgcaaagatttatgcaagattcctcagttgtcaccaaatgaaattctctctacttctaggcaatacggtattgttttaatgattagaagtaatgtacttgaggtgactatatgagtatctggataatgaatgtctaatttaggccagtgcgttgagtgagggatgtttttgtctcttcattaaaattataaagttcttgacaaaagctctacatcacatttttacgtatgtacaatggcatccaagccaagcaactagaggttgccttggggtaaattactacattaatttaataaataatctttaaaaacaacttaaagattccattgtactactcctctatattaagtatgaccaaaaaatagtggaatgtaacttggagaggagaaaaaaatgagaagttaaaatacagttgaaaattaaatacgagaaaacaagtatacaaatggatatacaaatgcctattatttatatgtctttttgttgctgtactactattgtagtttaaatacggaaccgagaattcgatattagttataatttttaaagagatactatgctgtgactttttatttagtgttcaaaatgtggtagatttgctggctagacaaaaagaaataaattaatgagtctcatattaataattaataggccctgaaaatgaaggtctaaaaatgtaagcttgccattagtgtgtcatttattgtgatgtatctgacatcttctgaagtggttatattcataccctaattttcagcatcttaaagaaaccgcttcagtgcaacgttactttggggagctccatgaagtcagcctatttctttcttttttttttttttttttctgagatggagttttgctcttgttgcccaggctggagtgttatggtgcaatctcagctcaccgcaacctccgcctcccgggttcaagtgattctcctgcctcagcctcccaagtaactgggattacaggcatgtgccaccacacccagctaatttggtattttttagttgagacagggtttctccatgttgatcaggctgaagccagtccatttctaaccgctttacaagcatgtatagttaatatattactaggtataagtctcatagaataccctgagggatttaaaaatttctaaatgaatgtttaaattcatgtataatataatctgttatgacatcatctgacttggtatgattattttcatactaatcataaggatactagactaaatatgaatgtcagtacactgaggataacacaagtaggattttatttaaaaactctctctactcttttttttccgtttctttcacaatattattttttgctagttcccgtgaagcaagtacattttgcatttgaaaatagactatttaaatggtagttgggtgggaggtcagcttgttctcccaaggggaagactttccatttatgttttatgtatgcgacacttgataattaaaccagttgtcaggatgtattataatgactttcaagagaaccatgtctttattgatggattgctatcacattgtactaaatcttttcattatataaggatggattaatttttctcagctactggagatatattttacaaatcttatatgtttgaaaaactcaacattttaatatattttataatgaaattaagattaaattgtattgagaaagaactgaattgtgcaaatgcttgaattatcagactaaatttttaatatgatgtacagttttgcaaattgtcatttggaattattcaaaaatattatgtcagcttaaatcatttttgaaatattcaacacattatattagtataaatcatgaaacatattagcatcactataaaatcccttatgacacaaaatatttttagtcgttgccacctttataaatgtcaaagcaaaaatcaatgagcagtacagttttatgttcccatttaaaacaaagtttttgatatcaaatttgagatttctgctatgattttagcatttctgctgctgtttttgcgtaacagtgaaaatcaggcttataaccatgcctcttgtccccatgggcagggcctggcagaggcaggcttgcagtatttgagatgtttctgcatttttctattactaagcattctcaattcttgtgcctctgacaatggagcagcccccttgatttgctgcacccaggagagccatttttgtcaatccaccttcctccctttcactgttgaaatattcctaactttcgggctgtaaacctgtcaccctttaaacttctgctctccaccaaagtgatgggtaccaaccacctccatattttcatcttgacaagagctatctggtaatctgaatccttaattctggttagtgactacggttagtggatataagaatgtctggcacttcagtgcgctgaaatacgcttggaaagaggcaacaccctttggtttttccctgaggaatggcctaggtataattgccttttgcacctttgctgaactcctaccctatatggcaggctaattttttttcttatacattgtgcactacagatatgtgttgtagtcttatgagagggtgatgacaactaagctctcatgtttctgatgcaatttaggactggaactagaagacgatctgtagaatggaagtagacgtaaatcttttttctcctgctgtattttgtatgtttatgtggtttaggctggaagacagaacaaagagagcaacagaaagggaaagagagagagaacgttctaggccataatctcatggtctccaacgtgtaattgcaaacacttccatctactattccatccttccattattccaattggcattgtcaatgttttccatccaaagactgcaattaacatatctggagttaaacaagttgaatttattgcttattgcaacacagagaacacaccctggaaaccaacggttgtctgaagacaaagttgttagaatggcataggatttggggttgtgttagctgatttgagggaggtttcaaggaagtgaaaaattgctgtagactaaatgctgtcacgaagtgagggtaattctatgattaaatatctttgtaaaccttatctagaaggatgaaataacgaagtaaggctaaagttgtaattggtaaatacagaacaaaacagttggtcattcataagtatcaggagagaaagaagtttgtgtttttgaggtttgtacaatagccttgcttctgtctgtgtttagacaagtttataagtagtcatgatttttccccaccttcatttcattatagtcacagaatggccttgtctgatgttggtgttctgtgttattgttgatgttcaacagaagaacaccaaagcccagccctcagtgccagccagattcttacaacaccaaggtctcactggtggtaccaggctgtgtcctagctgttgcggcctatttttcttagagttaattgtttaatatgagcaaaaaataaataaaataaaataaagtaaggcagacacctgtcttgcagacagggaagagtgtaggttttggagtcagtcttggttttctgttttccttcagctatccagcagctggatgtgacctcggtagtttcttttcctctctgagcctcattttctccgtatttaaggtgagaatgataagttatagtgaagattaaatgatactatgcatagaaagctcccagtatttgttataagtaatacctcaataaaattactattttattattatgacaacatgttcctccccagacttaaaagttatgagtggtgggactgggtgcatagaattttcatttacttacacaatatcagaaacaagaaaacaaattcaaattctatgatttctccttctccttcctgtttcacagtggtgcggcccttgaaaagggccaacctattatcagacctagtaacggaaaggagttgtatagctacaaaacaattagaatctaatttaaaattaggtagagttagttgaaatgagttaaagggacattttgtgatttgagtaataaattccaattgacaggtattaagtctcctcatcataggcaaataatgtttgttacaaaggaggcttgggaaaagctttctgaaggttcccccacaaacatggcacaacttcattctattcacaacctgtaacctgctagcttgttagatgaatgtgtttaaatgtgtgccaaattacagagtgggttactctggcagtcttttgttcctgatctattttttgcttctgtatggacagtaggcctccccaagccttttagttaatcctgctgcatgcctaaccaatgactgcccagagccctgctactcaaagtatgggtcctggaccagcactggctcagtgaaatacttttaactgatctatgatgagatgaatgttaaaattgagattaaactcctagaaactggtaaaaagagatcactgcaacatctaagcacatggttagtgggcttgtattttatgtcttatttatttgttattttactttttatttttttttaattttagatttgggggtacaagtgcaggttgttacatgggtatattgcatggtgctgagatttgggtttcaattgaacccattacccaaataatgaacatggtacctgataggtagtttttaaattcttgccccatgccctctccccttttgaagttcccagtgcctgtttttcccatctgtatgaccatgtgtacccagtgattagctcccacttacaagtgagaacatgctgtatttggttttctgtttttgtgttaattcacttaggataatagtctccagctgcatctgtgttgctgcaaacaatgttattccattcttttttatcgctacataatattctgtgatgtatatgtgccacattttctttatccaacccatcattgatgggcacctaggttgattccatgtctctgctattgtaaataatactacaataaatacgtgaatgcaggcatcttttttggtcagtggtcctcaacctttttggcaccagggactgttttcatgaaagacaatttttctagggactgtaatgttgggggatggtttcaggatcattcgagcaaattaaatttattatgtactttatttctattattattgtaatatatagtgaaataattatacaactcatcataatgtggaatcagtgggagtcttgagcttgttttcctgcaactagattgacccatctgggggtgatttgagacagtgaccatcaagcattagattctcattaggagtgtgcaacctagatccctcgcatgtgcagttcacaatagggttcgaactcctaggaaaatctaatgctgccagtgatctgataggaggcagagctcaggtggtaatgcaagtgataggagcagctgtaaatacagcttcacttgcctgccagccactcaccttctgctgtgtgatccagttcctaacaggccacagacctggtatcggtccatggccctggggattggggacgcctatttttggtagaatgacttattttcctctgggtatagacccagtaatgggattgctgggtcgaatagtaattctacttttagttctttgagaaatctccaaactgctttccacagaagctgaactaatttacagttccccctttttttttctgtagccttgccaaaatctatttttttagtaatttattttcatcatattttataaaagtatcaatttgcaatagatcagataataaaatgttcatccccacagatagtttgagaagaactgttggacaccagtggaaagtctaaaatgaaataagagaagtagagtcttgcacacagggctttgagaatgagatgtcggagaaatgccaggggcaggtgggtagaatatacacgtgacacagagagtgtataagaaatttctctctaaatgagtgaaatctatcttaaaggaagcactggatgacaaatctaggacatctgatttattttaatccagtcctgtaccatcaaggattacataactctattcagctgtctatttcagagtccactcttagaaaatgtgtctaaatgtatctaacctacattcttcccattccagttttcaggcctttcctattatcttacacaaaccaaaccagagttgggtcttcagtaatctttttttgcttcatggatgtgatgtaaaagtgagcttctgtgccctggctaaaatttgtgttagaccatatatgtccagggcaaagacatgtaatcacctaagggagttttgatgcatttttgatccaaatgtatgtggtagaaattcttcgggaaaataaaagaaatcacatatatcacatatttatgtaaacttcttttacataaaatcagtaaagaaatcacatgcaatatcagaaaaaaggctgtttggttttgatagattgcttatttttttgtttcttaatttgatctgcagaatcacacagagttgactattcaaatggatgtaaacctgactggtaaattcacgacaaagactcttagatttcacctctgctcaacatttagctacacagctccttgtagaatcgattgtctgtaagaggaaaagtctatgcattctgatggattcatgacactggggcttccttaggagggactagagattgctttttagaggtgataagaatacctcgatttttgattttagcaacttttgactttatacatgtctacatatatataaacttggaaaatatgtaagtaaatagaaacaatcatatttttcctttattaaaaaaactttttatttgtttctttttatttttgttttttttgtttgtttgttttgttctgagatggagtttcactcttgttgcccaggctggagtgcaatggtgcaatctcggctcaccgcaacctttgcctcccaggttcgagcagttctcctgcctcagcctccccagtagctgggatcacaggcatgtgccatcacgcctggctaattttttgtatttttggtagagatagggtttctccatgttggccaggctggtctcgaactcccgacctcaggtgatccgcctgcctcagcctcccaaagtactgggattacaggcatgagccaccacacctggccaaaaactactatttctatgtaagaacatttctgttcagtcccttcccatacttacataagaatatagttagggccaggcgcggtggctcacgcctgtaatcccagcactttgggaagccgaggcgggtggatcacgaggtcaggagatcgagaccatcctggctaacacggtgaaaccccgtctctactaaaaatacaaaaaaaattagccaggcgtggtggcaagcgcctgtagtcccagctacattgaaggagagtggcttgaacctgggaggcagagcttgcagtgagccgagatcgcgccattgcactccagcctgggcgacagagccagactcatgtctcaaaaaaaaaaaaaaaaaaaaatatatatatatatatatatatttagaattgtatataaatatatagagagtttattcacattgtttactatagttatgttctaaaaagtctgtgaacactgaattagggaatactgaacctttgctcctgggggaaatacagagttaggttcctgggagcgtctgtcacaacattttctcaatcagtcaatacataatcttgttttatgtgtgtttctgtttaaggacgtctgctttagtataatgttgtcaattcattaacattggacttatggccaacagcaccctaactcatgcgtgaatgaaacttatctaacacatgtattttctccaaaagacacatcacagccttcttgctcttaggaatgctagacaacagttcagcattatgtttgggggccactttaaacagtgaaatcacaaacaaacttacaaaaatttaaagaaaacattatttacagtatgagagctacagcaatgagggagagcattgccctgtttgacctcagcaggaaatgtggacagggccgcttaaggtctttactgctctgtacatgtcctgaaatgactgaaaacaccccttcaaatattgatttgagagttacaagtaagttctaataaggaggcaaattctcaaatatcaaatctacaaactacgaggatcaattgcatatacatggcttttcacggtgctttatatttaactttatacctgtaaactttcactatttattaatagtttattccaatattgttgtaatgattgatggtatagtttgctaaatactctattatcctaccataaaaaggtggttataaaacagtgcaaagtagcaggtaaaccattttattgggtatatcttggaattttgggaattcctaaacccttcctccctaagaaggaaattacatagatggaagctgaaatcaatctatgacaaattattgaaatattgtaaccatccaggattgtccagggttgggaatttggaatgccccattttccacatagaggatgctcatttccaatttgtctccctttccttgttgatgtcattgtttttaattaataatagagttaagtactgtagccaattgagtgatgtgtatattgctgtttctaaccaactccttatagtgttcactattgagagcgatctctaactgatttcatctccctaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggtaagaataggtgccaggctctatgagcaactgaaccatatttgcattagtgcccccgtgtcttggcgaagtcatcatgttttaactaatatgaatactaaggaataatttttcactgtctttgatcacggacattttgggtggatcaagtcgaaaaattctgacctgaaatgcatttctgcaaggtggacttacttctgtttacagtttcttgatgagattgattttaagtaggctgtcctcttcagttctcaccttcaaaccttgctatattttcctaatgttaaatgatccttatatgtcttcttctgattttatgggctgatttaattgcagtagtttcttgattatgcccttagctccttcagagcatccttattgcttccctactgtccagtacagaaggacaatattatgccaaaggacaaataatttaacttaatcagccccagcaacctcttctccttgttaagcataatgcactgatacatttgatgaaatcagggcatcagccttcgacaccagctcatctcccttagagaacaaaagcaaatgaagcatccacccgcccagtggatgtttgtttgaactaaaagcctggaaaagaaaacctaaaaaatggaaatgaattttttatcactggcaaattaaaacaaatgttcttttccgttagaaatccaatgttttaaaactgccagcagtaagactcacttctaatcatgttgaggtgttgcttatattagcgttgttttgtcatcgttatgttacattttactaattgcttgtatctggaatcatttttgcatttgatagaggtagctgagtctctattattcactaataaaatacaaattattttctaagtattgacggtgagcacacagtccatgaatcagtttataggattctaaaagcaaaagaacaaacaaacaaaaaaactgctacataatccattactgtgaaaggctgcttagggccaacaatctgaaaatatatacttgtttcctttactgagatgtttaaaccgggctgcttataaaaccttttggaatatatgattgattttatggcaatccatagtaacacattcttttaataaatagtaagatatatagaacaacttaacccagagcttttacttcaaaggaaaagatttagaagcagtaaaagagataaggaaataaataggcatattgttaaatgatgcaaaataaaagactggataaaattgtttgtaaatcatgaaaatagaatcatcattcttcacatattttatgtccttcatgttcaggtttaacaatgcctagctagttgatataaatttttactctagtgattgcttttagtcatactgtaatgtaattttatagtaaaatatatcacacatgtactctgtaattttgcttgtttttattatgatacatatgatatacatcatctttttaaaaagtatttttggatagttttagatttacagaaaagttgcaaaaatatagagagttcctgcacacccgacatccagtttcctctattgttcacaccttacataatatacacattttaaagataactaacaatttttcttaagtatacacctacccatgtgtctctctgctaaagaaagatgatcaatgcatgtctgtcccttgtatcatatcttttgatctcctatgtaaatgctctcctgaatttgggttttatgcttgcttcatgtgtattataattttacatctattaaggtgtttctaaataatatattgtaagaacttccacagtaaaattccaacttcagggctttcttaaaaaaaattacgaatctcaagtttacttaggtatctctgtttattcaatcattttttcaattgatgttctttcacatcagaatatgcttgaccttggcatgagattctattggtcattaaatacaagccctgcaaaatccaggccaccctaacagttccagggctggaagcaaggagccggatgatagcagaagacctgctgccaaactctgccctgcacttcccagccttgtacttccagaaccaggttaaggcgatccatcttccaagaagcccacttaggggttttgggctgaaaattctggatcctgggagtgaactagaggggaaagggttctaagtggacacatcatcttttcttgtgaggccttttggtaccatgggcaagagcatgactggaggagggctaaagtagggtccctaaaatgcaagactgccacagggacctggctggtacaggcagtggggtgatcaactcttgccaactttagctgaacgaccttcatcctgggaacaacctccttcccccagtcctggggaactgtgacagtcgttccccctggaaagttctatgtagataaggctgctctctatcactaggatctgtgttgtctaggtggaaagtgttttttagataattcttcagccagtttatgttcaagtaaaaagttactccgtgttgtgagacacgtctcatcagttctccttctctctaaatttaactgcaagtttccagttattttatctgggctgttccaacagcccgggttatacctccactctttaccagtcttgacagtggctgtcatattgggagagtgggctgctcctgaactagcagcactgtgtatatgccacaccagacttctcttatccatccatcactttttactctgtagctttttttccaccctcaaacaggtgcttttcacaaagtcggactgtattgtggtggtacattctgctcagcttttatcatttataaattatacattttaaatttagattctctagattgagaatggctgggtgtctaatttctgtacattcccctatggaatcttttgcaatgcctaacacaacatgcagcacaatctggggatactgtgtgcaaaattctcacatccccctcccttgtgtaaagcaaacattctccatccaatgaactgactacagcactgtgaagtctaacctgacatctcacttctgctgcagtgacatatagcgataatttatctgttatcctcggaggtgcttaacatgctgactgcctccagtaatggatccatccattaattcagcactaagtattcttcagaaatcttcctattttaggactttcatctcaaattgggctcagtgctgagcttctctctggtattgcattatattaacttgttgctgcctcttatcatagactaatgaggctaacctgggttgaacccctctttgttcatagaatctcttgcttattgaacattgtagctaggaatatgaattgcctcatgataggatagtatgctttctgtaaaattccatgatctttcctggtgactctgggtttgcttagctttgttccctacaggcatattgcacaatttattttattctgagttagtttgagatgtgtcaggaaacgccacctggagaaaagaagattagcagagttatttatatgcctggcatattatagttgcttcaaaatattattgaactattatcctttcagtttttaccctaacattcttaattggctaataagtcattcagaatacatactgagattatggtaaccatatcttacactacagaagaaatttaagcgctggaaatgtgtgtagtaccatgtacaataaattaacactcaaaaagctttgatgaatttttcttgatatattaaatttgaaacttcaaagtctccattaggttaaaataaaatgtttcggtgtgtctgataatagttttaaatttgaatgctgtcctttacttgccatgtaaatgtattttgtcagcaaaacaaagcattaaggaaaaatattatcagtcaaacaatttaattacagtggaaattcacaagtagaaaactagtgtggattatacaggaattaagaagttgctgactcacttcttattctttgaaattgtgttagtggttgatgactatcatggcaaataaagattaattaaaaaaataataaccacccatctagtctccgttccgtgggttcaattgttttgatttttaggtcccacaaataaatgagaacacataatgtttgtctttctgtgcctggcttatttcacttaacataatgatctccagttccatccatgttgttgcaagaggctgggaagggtagtggagtttggggagaagtaggagattgttaatgggtacaaaatacagttagaatgaataagacctactataggatagcacaagagggtaactatagtcattaataattgtacattttaaaataactaaaatagtttaaatggattgtttgtaaaatgaaggataaatgctttagaagatgaataccccattcttcatggtgtgattatttcactttgcatgcctgtttcaaaatatctcatatacccacatatacacctaccatgtatccatacaaattaaaaattgaaaaaatgtaatatatgtattcatactcgataaacttatttattccacttggatagagaaacatttagaatgtcattagaccacagacaataatggttaatattatatttattatttaaataattataaaccagccttatataaatgttagaaaaaaatcaatatagatgaaacatccttttatgaggcaaagaataaaatcaaactgtgaaatatttttgatattaagccatcaagacttactaaaatccttgtgtatgtggttcctttatgtataggaaaatacaataattaattagataaacagttggtaattttattccaagccaagagaacccattttccaaatagttagctttataaatacaaagatatttcatcattattaatgtatcttttcttatacatagtacatgttttcatcttttatgttcttaattttgcaattcaaaatactaagttcccatctgtaagttatatatagtttaatattgctggctggcatgtttaggattctggagccaatgtttatatttttcaaatctagatcaagttaatatccttgcacattattataatactagtgacttcctgggaatgctatgtaaataaaaaattctttgtatgaatttcagtttgtaatttagatcaaactaataatgactgcagtcattattccctcctttaatacagaaaataatcatatgcctctttcttttattttttaaatgaagttatctatgatcctgaattctgattcattgtgatgcgtactggatttatttcgtttttatcaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtaagggcaatctcacttcattttgacctgctttcaaactttggcatcagattaaaatttatgtataagatgaacaattattctttcctcttccccattcttatctgttccacaggaaatgaattatatttacattagaaataagaaaaaatgcaccctttgtttaaatgtcatattttaaatgacaacatttggaagacttggccatgttatgtatggccacgtatgtacacatgctaccagttcgccaaagataatgttgatgctgctataattttagacaagtatagatgtattaaaaatatgtcattaaactcaatatattaaggcacttgaacagtaaaattgatcatcaggtaccaataaatttgagactatgtagtcagttatcaaactggcatttgctaccctgacagcagaatattttccaaggcaggggaattcagctggttgcacttctcctaatgtgcctttttaacaacccattaccatcttctctggagggaaaatgaaaatgaacttctctagagaagcttggggttgtggtattgatcaaggtataaggatgatcaaagagtttcaacaagagcatcagtacaggacatgacaaggcaggacttgagagttaattgtggaggacaaataaccttaaaaataatatatatttttggctggcgcagtggctcatgcctgtaatcccagcacttagggaggccaaggcaggtgcatcacctgaaatcaggagttcgagaccaacctggccaacctagtgaaaccccatctctactaaaaatacaaaaattagctgggcatggtggcggatgcctgtaatcccagctactcgggaggctgaggcaggagaatcacttgaatcagggaggcggaggttgcagtgagccaagatcacgccattgcactccagcctgggcgacagagcgagactctggctcaaaataaataaataaataaataatatttttttgagacaaggtctggctctgtcgcccaagctagagtgcagtggtgcgatcgtagctcactgcaccctccacctccttagctcaagccatcctatctcagcctcctgagtcactgggactgcaggcacacaacaccaggcctagctaatttttgtatttttttgtagagacagggttttgccatgttcaggttgttatgcccacttcagcctcccaaagtgctggaattacaggcatgagtcactgtgcccagccaaaaataataattaatagtaataattgaaacctgtggttaggcatgagcaactatagctaagtcatcttgccagtcatgctttaatatcaaggctgttaattttaattattgagtttaatggaatgccataaccattacagattaaacaatttttaaaacagtgtgaccaaattagcctctaccctgtagtaatgttcaatatgtattttgaataaatacataaattatgagaatcaaaagtaactttttacttttataagacattttgtcaacaaaaagactcttctatttatatccaatggaccactcagtaatatttgtcaatcctattttgaacactaataaatacttcattatgtctagaaaacagtaataataaccatattcagcaataagagtggcaggacataatttcctccccacaaatactcatttatttgtttaaaacaatttgcagagaaaacaattctttatataatgaaagatgatatgaaaagagagaatttagacgttaaacctcaactggctagatttggggattgaatgacttttgggtccgtttgttgtgaacttgtccatagttacaaccttaacagctctggaacctaaaacctgatttaggagagggcacgcagagaggcttcctgggcctggcttctcaataggagacttgcttacagagcagggactccccaacccctgatggggagcagccatcagggaaactggcagggagaggctcagtcacgcacactctgagtggtagtgcatgttgattatctcagattgctgaacattcatttggtacaagtatatctacccttcgtcctgtgtggacatgttctggagctgccatgtcacacaaggactcccggttgcctactttctgaaggtacatactttctgtaaaatagaggaccatcagcacatttggagaacacatcactttagtgccataccttaaaaatgcttttcagaaatagttagcaaattatggatagatcttgactatacatgtttctttttaaaagatgctttaggctaacagtaatcctaacaatcttaaaaatatagcaaaaatcaaagtaacatttgcatactttttaaatttccaagcgtatctgtaaacctgttgtcttatactcagaagaagatgtatatttagtttggtcttatatactatacctactgacatggcatcccaagatggatggcatcccaagaattaaatggagccttaaaaaaaaaatctgtgtaccaggccttatgctaagcacttaagatgaatgagcatttaaatcaagcctcacaaaatctcttagaacctgttcttcatagtgtttgtttcctataagtatggaaacagatgcacagagagaataagttggctaaaatgacatggctaagaaaaggcagagcccagcctctaaccccagcactctggatccagggaagtctccctgaaatgtttgcctgccatgccatgcagcccctctgggtgcaagttaacatttggggtggttagtatttaatccatgcgtaataaatgtatcatttgatggttcaataaactataattaaaaacaagcattaacagccagccagacacggtgactcacacctgtaatcccagcactttgggaggccaagacgggtggatcacctgaggtcaggagttcaagaccagcctggctaacatagcaaaaccacgtctctactaataatatatatatatataaaattagtcgggcatggtggcacatgcctataatcccagcttctcgggaggctgaggcaggagaatcgcttgaacccgggagacgaaggttgcagtgagccaagattgtgccattgcactccagcctgggcaacaagagtgaaacgccgtctcgaaaaacaaaaacaaacaaacaaaaaaccaggaagtaacattaaaaacattaacaatctgacgggaacttaaaataatgcaggtttttaaaaaaaaactgtaatactttaagttggctcaaacctacagataaaggtgtaaatacaaatacacacacatgctcacattcataccacatggctattcacacacactctacacacatgcaccaatgtggcctttgcacactgtttctctcatgtggacacattcatatgctcattcacatagtccaaagctccttacactttcacacaccatcctcacacacgtttacacaactcacatattaatccttactcatgcacactcacacacaaccatccttttacacttctacactcataagtccttcccagacttcttatattcacatcttccttacacagagtcactccctacgcaaacacacacaaacacacacatacacacacacacacactcttagaagccctccccttgtcctctgtggacatgcagtggggtggccctcagtccagggacttcggagaggggtggcgaaggggtgagtacagaactgaaaaggcagctgctatccaagtcctcacatctggggctgaaatgtgagtggggctggggcaggagtgatggctactaagacaacaattcttacaaagttgcttggacgtaaaacacttattaaaggaaattgtttagtatatcatttggtatcaaagcacactggggctgcagagacccctgacaggaactaagaggctgttgagtgacaacgtcaaccttgtgaccttagcaagcacagcacccacctcctggcttccttgcctccagcctctgcacctccgtcacctgtccttccaatccacccctactatccagccctcaggttctggcctccagcctccatggcaccgtcctccatccaggcccgttgttttcctcttcctttctggtggagtttctacctgcctaccttccctcccctcttctccatggagccccaagcctgccctttgttccttatactcacacacagggtttattccagttgatttgaagatcgtggtgttattccgcctcctgtaatactgaaggcatggcccttttggaggcgagggctagggatatgaggaggttgattcttgtcaatatcaaagttttgcggaagaatgtaagatttgaattgtggtggtgaccattatcctagcgctcattggcacttaagtttatttccctaaatgtgataatgttgtatagagtttacttcaatattaattccagcaaacctttacattgtatgaaagtttttgaaatttacattgtaatggacagggaatcatgagaaatcaaaatcttactatcactttaggtttgggtatgttgatgtaagcatttgttcaagttcacaagcaatggaaaggatggcaatgtccaaggaaaagctttcgtggctagagaaaatgggttaatcaattgtcttatcttgtattggagtgagtagggaggagaaaagtgtaaaatacaatggtttagaacatttggtgagaatgagtactatagaacctaaattgccataggttactagtagtaaacattatgataatataatgactttaaataaaattcacaatttaatctttcacatttgaattaaaaataggaaaaatctagtctaacaagaatcaagaaaaattgactcagttggtctttttgaagcagatcaaatagaaataacatatgtatcacaaccatttaagagtcattcttttggattttaggcaaagccacttatgttgaactctttttaaaacatggtttgaggtttgctatagaatagcctttggttttacgttcctgcattagtttgctaaggaagtggcctccagctccatctatgttcctgcaaaggacgtgatgtcattcttttttatggctgcatagtattccatggtgtataggtaccacattttctttatttggtttatcattgatgggcattttaggttgattccatctctttgccattgtgaatactaatgcaatgaatacgacatgttcttacttataagtgggagctaaatgatgagaactcatagacacaaaaaggggaacaacacttactgggacttactggaggttggagggtgggaggagggagaggatcaggaaaaataactaatgggtactaagctttatacctgggtgatgaaacaatctgtacaacaaaccctcatgacacaagtttacctggtaacaaacctgctcataagttacccctgaacttaaaataagagttaaaaaataaaaagacataagtatactccgtgaggggggcagaggggggaagccttctctgaataatgtcctttctggtttgattaccaactagaatttttattgttttaatatttttaaatctccctgtttttacacattgtcattgatttgaaatgcttaaaattaaataaatcctgacacatttttaatgaattcctgtgaatctataaaaaagctaaatatgtataaacttaatggatatgaagagatgcccattattaatttttggtttcttaaaaagcagattgtaaagtagcatttctttatgattatatttatggatatacacacatatctatatgtttgtagtggtcattcatacacagtgagattgtcagtgacatttcttttttattttttcctggattgtttaatttctctacagtgaacatctctttttttataatcaggaaaaatacataatattgtttttagttaaaattggaaaaaattctgtaagcaaaatgtaaagtttccatcctttgttttaataaaggagatggcagacctgtaatcccagcactttgggaggccgaggcgggcagatcacgaggtcaggagatcgagaccatcctggctaacatggtgaagccccgtctctactaaaaaatacaaaaaattagccaagcgtggtggcaggcacctgtagttccagctactcgggaggctgaggcaggagaatggcatgaacctgggaggcggagcttgcagtgagccaagatcgcgccactgcactacagcctgggcaacagagtgagactccatcccaaacaaataaaaataaaggagattgcggaaaccctattatgtatatattcttggcaggttttgtaggttttttttttgttttgttttgttttgttttgttttttaatctgggatgaatgagggcacttaaaacctttgtctcttggtgtgtttcattctgaatcctaacaggtatcaataatttgatcacggctatttgatcaagttcccaagctgttggtgcatggtgctctgcctgtctcagtaactgtttgctgcacctgtaagccaaaagatagacctaacactttgattttataaggggcttagctacaaataacttaataagtgtttatttccttacaactggctaacagtgagatgaggccatctgtgtttgcttcttggtgcttaaagaagttaggctcctacctccccagagactgggagacaggggctgtatctttcttaatgcttacatttcaaaggggtgactcccaggtccttgaaagacatacctgggttgtaaaagtggcaagtggctgggagaagatttacatctgaaggggacaaagaaagaattgatcactgaaagttttctaaagtaaacgctctaagataaggcaggtcaagggcctgtagtccgcaagaaacctatctaaattgtggttaaggagaggggaatgttagtaccattttagtccttataataaggaaaaaaaatccataatatctctttcagataaaattggaaaaattttataagcaaaacgggaagttctcatccttagttttaataaaggagacggtagaaaccccatcacaaatgtgttcttgcaggttttgtagtttatttagtcgttaatctgtaatgaatgagggcatttaaagtcttgatctcagtgtatctttcattctaaatcctaaaaggcatcaaaaatctgattagggctatttgagtcaataacaaaactttccaaactttttcatctatggtgccctatgtgtctcagtaattttgactgtgctgctaacccaaaagactttcgtaacactagcaatgtatccctaaccttaaaaagtggtttaggtccaaaaaacttaacaatgccataacaacttaggagccttttgaaaaaaataatatacatgatttggaaaaaattatttttaattaaacacagttacttagtatttggacatgtgtacctgttgaacacggcaccgtttctcaagacttgaaaccagatcagactccagagccaggcgtggtggcacaagcctgtaatcccagctactccagaggctaaggcaggagaatacaggaggcagaacccctgcttgaacccaggaggcggaggttgcagtgagctgagattgtgccactgcacaccaactggggcaacagagtgagcagctgtctcaaaaaaaaaaatgagactccagtagcctcatatttttgttcaatattgatttcacatggtacttgctttttaaaaaatcagttactaaaactctgctccccaaagataggatgtgattaaagggaatatataatgatctaatgttgaaactaaactacctcaagctagttagtcacacggtgtttgatagatgttgagtatgacagatatttctcttgaagacttaaattatcctgggagtccctatgagttctgttttgcaccttagagcaccccaacacactgcttgaaatttgtgagcctatactgtgtattctcctacattcctagaagtatacctcaagtgaagaaaggtattcctctgtcttccttttttcttttcttcttttatctgtattccttctttcagtgttcaaacaatgtagcaattcaatgtgataaaatgttatttcatgtatgctgttgatatttctgccaacatattgaattcgtgttatgtcactgagggaaaatgaagggctctgatgtagtgggacatgttgaaaattaagcagtcacaactatctgagaattggctgaaatctgatgaatttattgatctaaggtttagttctgtgattaaagtgattaacaacagactgaagcatcattagtcattatgttatagttgacatctgtctttctcatgaccaagtataaatggtcaatactttaagatatctaaaaatggaaactggtgattgtatctgcaccttcttttaggtgtttgcccaactattgtgaacacggtggggagtgttcccagtcctggagcacctttcattgtaactgtaccaacactggttacagaggagctacttgccataactgtaagcggaacacatctgctttttcttgcccctgtgatggtttctttgtcccatttcccttttcattgctgtgtgtatatatgtctgttctgtgcaaactcagcatccagtggttaatccacatctcatttcataaagtcgtcaagatagcctataaaagtacataatatgaaacaaacttggcaaagggaaaatacatatagaagatgaaaggtagctaagggttgaaaactaagaaaatgcagaacgtgaattttgttatcttgttctgttactcaaattgggccagcattttgacactaaactttctagaaggcgcagtacaagtggaaacatgctcagttaccaaattcttactattcatacaattaaacaaagagattctcagaaacagccctggttggagtgggttggggtggtttgtggtatgaagattcagatatccagtagagactagatgccatagtctgtttggatagctgtaacataatgccatagcctaggtgacttacaaactgcagaaatgtatttctcaccattctggaggctgagaagttcaagatcaagatgccagcagattaggtgagggtgtgcttcctggttcatagacttccatcttctcactgtgtcctcacatggtgaaaggggtgagggatttctctgggaaatcttttacaagggcactaaatcccactcatgagggcttcactctcatggcctaatcacttcactaaggccccacctcccaataccaccatattggggactaggtttcaacatacacgttttgaggggacacaaaccttcagtctattgcgctagataattcttatgttatcttgcaaccctatttaatgagggtgataaggaaaagggtggtagataatgattaaattatgatggtagataaatagttaattttattcaatactttctaaatgtcagctactgatctagtattttctatgtcctaactcgtttaattctgatgctcaccctagtaggtgaatactattatatgcaacttacttataaagaaatagatattaatctatttgttcaaggctacttaaaatagttgaggcagagtgaggatgtgaacatgtgacaacatcttctagagcctgggataacaaccaatatccctttttcctgtattacaaatcatgaatttgtttttctgatgaaatggattgcatgtgttgtaaggcccatgttatttcattgtccagttgttctggcgcacaaatgggaagaccaaaatgcccatttcccccccattttttccgattattactgacatttctgagcaactgaactcttagtattacctcctatatccttgatttaaggtaagagtataaggtacaaagccatcagtctcaccacccttggtctattacactatacactgcattgtgctcctgccagtgtttggaatcctgggctcccagctctgggggcctgcacagaggaccctcagaagccctgattcggtgctggggaagacatcatcaagagaatctctcagctctaccactgttgttggagtcatttctgggcatgaattgtgtatactgaggtgcctcataagatttttatgaagaatattggctggtaataaagccacacctcacctgtacttgcatgccacgttatttgacccaggacacccagctagtggaaggacagtatattttaattttttacatcctccattatccccatgtagtaactaactcaaaacagaaagctattcagtgttttcatcgactattcattttaattgttatcagtgactgaatctaaatataaaccaaacaactctgaagacaaaaattaggtaataaataaagttactttcatctgtgacccacaatttgatacaataattgagtttcatttattaggttcttgaaaagacagctgtaatagaactgaagggtttttgcccataactattccgagaaatgaagccagaatgacagtcttggttatagtggagggcaggagatggagtttgttaaaaagccttattaggaaataatcattaaacagtcatgttttaaaaagtcaagccatacacataaatcaacagtcatgttataaaaagtcaagccatacacataaatcagaagtccttccgagtagtctcatccaatccttttccacaaccagtcccaccacaaagttatgatattctgccaagctctttcaaggactttatgaacatatgcatatgtacatagaaatgtataaactagtcatttttacgtactctcttcagtgcacaaaatgcaaatgtgactggaagatgaaccatgcttatatctctatcagcatgatatattataggaacaaaataaaactgtcacactgtggagaagtgcggaagtaaatttacatgattacttgaaattttggtaacattgaacaaattagccatagtatttcacgttgtttaaacactcattaacataattttcaaaagtaaaatagattcagggacaaatattcaggggattatttctcatttcacagaataaaatgcttaacagaagttatcagtatatttggccaagtgttcaatgagaggtgtgcattatacacaagtgtattaatatgaaaccttgtacatggcaaatttaggattacataattaaaaacatccaaacatccgattatggatctaaacacactgaaaccacttgaaggcatagttcatacaagtatgtcttctgctttgaattttaattatcttgagttctcattatggagcattggtgggagtttcttttgtaaattacttaaaattattgatgagctttgtgaatcccatttgttttatgaaaaaaatattttatagttaattttctgtgagaatatagttgtaacatgatttaaagtgtttctgttgtataattattggctaacagcagattttttaaggaagttacactgttgtgcttcagaccttaggttattacaaggtgctactaggatttccaaaatgtgtgccacaagataagttatgacattatacttataaggctccaacatttaaacacctaccttctctttccttgttcttcataatgtcaaagtagctaaattttgattttgaccaagtaatttcattttcctttagtgattaaaaaaagtcataaaatcaacttctttttttgctatcaaatcactttcatccatattaattttaaaaaagaatgagttttgttttaaagtaagttttgccttttctcctggtcagtaatgtacattttaaatttcaagatttgcggtatttcatgtccaaattaaaagttaagagattcatttcatgctattccattaatgatgattttttttcttaaagctatctatgagcagtcatgtgaagcctataagcacagaggaaatacttcagggttttactatatagattcagatggaagtggtcccctggaaccatttcttctatattgcaatatgaccggtgagttaatcagcttttattttacagttaaatttgcatgcatgttttaaataggcaaaattaaaatgaaataagcagaatgttgacgtaatttgcaacttgattaaaatatgtattgttccttagaaaaactgaacataaatcttaaaaaaataattaaatggtaatgattttaaatgtcttttttaatgcatgtggcatctgtgtaaaacatctaataataaatgtttccaattatgtccccaaacaaaaaggatagactatttatgagagaagattgatacatgtaaaagctttgaagaatatttactttttaaatgtatgtaaacataaagtttacgtcttcttgtattcttacataaatttacatagaaattaataaacatggaaatatgtttgattaaattcaacattcatccataatttaaaacactcaacaaattaccaatagaaggaagttaccttgtttcgataaagaccagaaaactttacagcctatattagtttatagtggaatttgaaagcttttcccattaccggctttaataccattctcgtcaccattgtattggaggtcctagacagtgcaataaaacaagagaaagaaatgaaaaatataaatattggggaaaaaaaagaccaagattctcactattcatagataatcaggttatgtattaaaatactctaaacaatttacagataaactattaggattgtcattgaacaacaaacataaaattaattttatttttgtatatcagcaataaaaattagaaaataaacttttaggagatcatattttcaatagcataaaaacctcaaacacatggtagtaaatgtaatgaaagatgtacaaggtttctacaccgataattagaaaacaccctttcaatgaactaatatcctaaataaatggagaaatataaaatgttcattgatcacgcctgtaatcccagcactttgggaggtgggcagatcatgaagttaagagattgagaccatcctggccaacatggtgaaatctcgtctctcctaaaaatacaaaaattagctgggcatggtggcatgcgcttgcagtcccagctactcaggaggctgaggcaagaaaactgcttgaacctgggaggtggaggttgcattgagccaagattgtgccactgcacttcagcctggtgacagagtgagactctgtctcaaaaaaagaaaaaaatatgttcgttgattagaagactcaatattgtataatatcagttcttccaaactagatattgattccgtgcaaacctaaattaaaactcaagcagggtgtttgtttgtaggttggtgtgattattttggtgaaaatcaacaagcatattctaaaattatgagtaaatacacagaggcaagaagaaccaagtcagtgagtcttgaagaacaaatttgaaggattcagctctactggatataggcattatactgattggctacgtaaagccgtatatagctgtcacaaagataaacaaataaaccaataaaaacaaaatagagaatttataaacagactcactcatatatggataattgatttattgccaaggtggcattgatatgtaatgaaggaaagatggtcttttcaaccagtagtgctggtggaatttgtacttaaatgtcagtaaaaggagtattgatctcctcctcatcaaacacacacacacaaaatagattctagatgaactgtgctgtccaacatggtagccactagcaagtgcctatttgaattctaatttaattaaaattaattacaaaacaaaatgactgcattttaaaaatttaaacttaaatttaaaaatttaactaaaataggattaaataacagccgggtgcagtggctcacacctgtaatcccagcactttgggaagccagggcgggggcataatttgagcccaggagttcgagaccaggctgggcaacatagtgagaccccatctctatttttctttttttaagtttactttgtcagtctccctggctgcattttaactgcttaatagcctcccggggctagtatggagtgtatcattgtagatgtagaaccttgtcatttgctgaaagttacaatgaacagtgttagaagtcaatattttatggagcaaaaccaaaggaaaagggcaaaattattatacattgaggcagagggtgttgcaaggggagatttggtacttaaaattgaagaacatatctttcgggcagaggaaacagaaagtaccaagttctgagacagatgatcttacttaccaggtgtgttcagaaaacagcaacaaacctaggatagcgggagtatggtgagtaagtggggcgtaggaagagaggagagaggcaagttgggtggggaggggaagagtatgggcttcatgacaatgttgtaagacctttggttttttactctgaaatgagatgagaagacactgaggagtttatttttttatttttttttttaatttttattatactgtagttttaagaaacggtgggatgcaatctgacttcctttagttggattgcaactgctcctgggttagggaatgcttcttcaggagcatgggtggaaaagagtgatgagactatgcatattgtactttataagatacaatttcagtatcttaattgtattgggagaccatttcaagtaatgcaaaaatccaggactgattgtacaagataatagcactgtagatggaggaaaggtgttagatttttctctttgcatagctatgaggtgtgagaaaacaaaaagccaaaaataacgacacagtttttgccctgagtaattgagtgtttgaattgtcattatttaagatgtgatcagaaaaggtttaaggtgaaagatcataagctctgttttacacaatttttttttttttttagtttgagatgtctgtttttccatgttcaaacaagattctgaggaggcatttgaatatgggagcaaccgcttctttatactaatgaatgtttagttctaaaaactgcaggtggtggcaaactctgtgccaacacatattttggcagaaattgctataaattagtatcttcaaaggtttttcatttaacacaacttggtagcttctatctgtctcacaaccattgaggacattgcctcatacaccaaaacagcccaaacaaatggtgttcctgcatatgtgtcttctcaatgaagctctcccgcctgtgcagtacaaatgcccagacagcactgcaggtgcttctcatccagtgcaaccactgagttgggccaatggaaataatatcatcatggatcttcccaaatgattcttatgtgtacttaggtttgggaatcactgttttagacttcatggttctcaaacttcagtatgcactggcaactctggtatgcgagaattaaacataacaaatgtgagaggactttacagagaaaaaaagagagaagactttacaagtgtaagatatgaattccagtgccaaaatgttttattattttttttccagcttggataggttggattgtgagtgagatttatgtaacaatccaccactgcaaacctgtaaattctatgttcccataaatgcatccggatctatacacatacacatgttataggaagtttcattctgaaattagacagcgataggttgataaatatctctagtctttgaagttttaagaaacacacacacacacacacacacacacacacacacacacacacacacatccattctcattgtttgcagtcgttatgttccgtaaagtaaccaagaacactggattggaaaacactgaacaaattactcctgggggaatcacagtacaattagtttcttgcaagcctctggtcacaacggtctcattcaccaatcaatacataatcttgttttatgtgtgtttcaggttaaagacaccttatttaatacatactgttgattcattaacattgagctcatggccaagagcactgtagctcacgcctgagcaaagcttatctaacatacgtgttttctttctagggctcagtgcgtgcaaccttctgtgcttaggagcactcgacaacatttctgggagtagggggcgttttaaacagcaaaatcaccaatgagtagcacaaaaatgcaaaaaaatgtggcacttaatagactacaaatgagacatttgttcatagtatgagagctgaaacaggaaaacaatgtttccttgttcagctctaacggggtatgtgaatgtcaggcaggccaaatttttgcagctctgtttgtgttcacaaatgactgtgaaagcattggggttacaaataaattttagcaagtaggcaaattcacaagtaatgagaatctgtgtgtgatgaatatcgactatatatcttatgtttattatgggcaataatttagtaatttataggccatatgtattttttattaactaaatgataatgaaattatcaattttattttattgaatatattatttaaattaaatcaacatttacttttttatattacatagcaaattaatgtacattattatagaagatatatctttgataaacaaattatttggggaaaaaattgtagttaagactaaacaattctaagagacctgaagagtgtgtatgtgtgtgtggggaaagagagagagagaacaaattccatgttttaggagcttagattttgaaatgaggtcagatgggtcatagatcccaaagaggagagaaatgaaaaaaaaaaaaaaaaaaaagactggagtcactggaagtatgcagagattaaaggtgcttcattcagcaagattaaaagtattgatggaaaagaggacattcagaaaatttaaagccacgtggatagcaagatgttcagaaacacagatacccagagacagctaaatgtctccagtagctctggaatattggaacatattcaaacaaaagtgacaacccagagtattgcaacccagtgagaaatacgtgttactacttgaaactttccttattgatctagttttgcaaatgaggaagccaagaatgggggaggttaagtgtaggaggtatagcttgaaactctccttattgatctggttttgcaaataaggaaaccaaggctcagggaggttaagtgtagcagggtgaaaatattggtaggaatagatcaagcactggtctcttttctcacagcctgaaagtttttccactaggaagagttaccttctatcaatgtttcattgcttgcagccaatagcatatcttctagttatatagatcaggtataatgactgctgaaaataagacaaaatgctgaatcaccaacatgcaaatatgtgtcttattaaaaaatccagtttttagtctagaactagtgtcaagtgattccacatgtattaaaatacctctaagcattataagctaaaatctacaaaaaaaatctctattttgaatggataatttcttaaacgatgttaaaagctgaaatttctttgtaaacagttttccaaacatagtttcaaaataattagttagagtaaggtgaatcccaggggctgtccgtattgctttttcttttcttttctttttttctttttttgagacaaagtttcactcttgttgcccaggctggagtgcaatggcacgatctcggctggtctaaacctccgcctcccaggttcaagcatttctcctgcctcagcctcccgagtagctgggattgcaggcatgcaccaccacgcccagccaattttgtatttttcgtagagatggggtttctccatgttggtcaggctggtctcgaactcccgaccttaggtgatccgcctgcctcagcctcccaaagtgctgggattgcaggcatgagccactgtgcccagccttcattgctttttctataatgaaattgttttatgttcaagaagtttcttgttatcaaatattgcactgtaaggatgattgttccagaggggagaaattgatgagtgccagaacagagactttcaagtttttctaaaagtgaaaactctatgggttaaactcaccccttctcatggtcccattactgagactcctgggtttagtttccctgactcagtaagtttagaacacaaggtctgggtctctgcattactaacaagtaccccaggtgattctgagataggagctcctgagaccatttcaggagaaagctggagagcataagacttacaatagcataattatttttactttagagatttcaataataaaggccttcttaacagctatgagggttaatacataactgtccattattcaaatgcagtcttatttacatcaagctttgctccagaaggctggctctctcccctcctgtctcctctgctttccttaagacagcacttcctacctgctcttagggtctttatcacatctatcaccttcagctattcagcgtgaagcaacacaagctttgcaagtgtattgcttaaacagcatgttttcactttgcactgttatcacactaaaaaatagcagccagcctaaggtaaatccagttgttaattactcagttgctttatttacaaatattgaaatctcttcagggggagacgtgagtagacccaaactaccattcaatggagattttctgcctatttcagccatctcttattcatttccctgtctccttaccctaccactctttttgcatttagtaaaagataattggtaataaagtaaaatcatgattctcatacagatatgaaaataaaagtttaaaagttttaaagatttttaaaatgcattattaatgaagaaattggaaagatattacaaccagttcgaaggagaatccaaagaaaagatgtatctacacattaggaacacagaaacaaatgtgcatacggaggcaacactggattcatccatggtggaggagggaagtcactagaacctcaaccaggtagcagttgcttgtctacagacaagacaagaattatttgttgtaaggaaacagtgcctgtatttctagacaaagacaaaaaaaaaagtctggcaacctacgttaaaggatgattaaatgcatcttggaagttagagatagagaattgctctgaagagatttaaaggcttatctcccccagatgcatttgcttattttctaagagtaataaaaacctaaggactgtaccttctctcctctaaagaaaatttgtgacattccagagccaaagtctctctatcactgtatggagggaaggaggagagagtgtgccaggcaccctctgtaagcccaagcctcataattttgtgaacctcctcttgtggtgcaagtccagcaggcacagctctatctagcactcactgcatgtgcaggtgggaaattgaggtatgagagattgatgctgattagattctctatgagcgaatggtccctgattcagaggtcctctgtgtctgttagtatagattagacaggtaggtaggtagtagatagatcataaacagatagatattatctgtgtattggcaagataactccttaacttgcaagtgggataacatctcagggcccagcacagtttcagatttaacattatttagcaattctattagttatctacaatgtatagaattatataacagctcaaagcaacgaacatgtcagagccaccgcagcatctgaatcagataacctaggaggttgtgctctaatctagacaatgtgttgtttttattcattcgtttgtttattccctcatttcttcaacaaatgtcttctgcgttttctatcaagccttgtgctgtgtgctggagatatgattgttaccagatcacaaactattgctattctcatagagcttacagactggtaggaaagaccagtaaagtcaaccacaaagtattgaattacaaattgtgatgaagtgcatgtcttttaccactcttattcctaaataggtgtttgtagaaacttcggatcactcaatcatgtctgaaagaacagtaaagaggctctaatttgagacttttcagagatttccagattaatgaagcacatgaggtttggaacctggcttttaaggcacctatctccgttgctcaaaatctattgtgacaatttcattgtgtctgttctgccctggaaatctagatggcctgataagtgtggcgtctgtttaacatcataccttgtagtgctttttattagagaataaaatcacttacagggactatcataatattgaaatattttagaatttcaaaaggaaacgttgttatgagctactctttaatggttgccatgcactatggccttgaatctcttgcaacacctttaaatacctttagaatcaggtgttaattgtgacccagtggatgctaaactacagggaagtctcactcagtgtgatccagaagggaaagagacaaaggcttcaagcaggtatattgtccgccttgcttggtagctagcttcttcttgcatgccattgatttaccgcaagaaaaggtgaatagtttttttgaacaaaagaaacagagtccaacagtggctaggctgtcaggtttgtctagttaataataaccttaaacttccgatagccaaggttgagttggctgaaattacagaatttcagacctcgttctgccaatttaatttccaaatttggaaatggaggctcagattttacctgactttcctaagggcacaagatccatgccagatctgcaactcagatctcttaattgacttcgacattatactgctggccacccgtaatttcattggctggtagattaagttctgtttgagagcattctactgttgaagggtgaactgaaatgcaagggggaaatacaaaaataacagctattgtttcgcagaaaaataataatccacacatggaaggcaataattctgtgaagttggtccagcctcatttagcctgcctctctaatccaaactctgatgactgggaaaggaatgggaatgaaattttcaaagtatacctccttatttggattgttgatccatgtgaatgtcttagctaaaaagagaggggaaagttttgcctactattactatttttctccaatttgggatattcctctgtattacagaagagttatgtgacttaacagcacatatgtagtagagttctgacaactttcactctgttttcttgtctactaaatcagaggctttttgatttatctgttcttgtgtctgcatatatcacagaaaatatagtataaagtctgttgctggtaaagttgaagggcagatatcacatgcctatcatctgttacaaacattgtgagatttttatttcatctaagaaattttgataatcagtatgatggaaatgtttacagacattcaggcaccaatagtgataactctagtagatactcaaagatattttacttttgtgttagttgagatgctgtgtcagatgcattcaattcaaaagagtaacttcctattgaactgcctaactgtccagatcacatgatatcaaaatgagtatttcaaatttaattttaaaaagatgcacactcataattaaatgttgattaaggagaggtatatagagggctacaaaattttgactttatttttgctgataccatgaatagttgttaagagtagaaaaggggctgcttacattatgtaatataaattatttcttgaattctaatatacatttttttaaatattgtgatatcattggattttgggtgtgttgatgaataatgttttgtagttataataggcagcatttttcctttcttgcagagaaataaaataatgatgcatctttaaaaagatggaatatcgatttcaatgaaataaaatacatcacaaaaataatcagatttcttaatatttttcatcataaatattgtgtggctaaattatatgaaaatgttaaataaaattactgtaaatgcatggcaatagtatatattttaggaaaaataatcacttaccataacttaaaaattccgagaatccatttgtgttgattctacctctcagggaagtttgatgactagaaacatttgactcagataaaaggtgattttgattttctttatttattttaacttttgcagactagtgatggtctcctctctttctccccccatttctgcatacaagaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaaggtaagtaaaccatggtgtctgtcttgttgcacacatcacatcatgcacttactcaactagctcctgagaattttaagtctgcaaagtggtggtgtctagccactgagggtatatgatctcacatacttagtaaacatgtcacagtctggaagtcacaaagatgcttctgcctgaagaaaagaacaaggtcaatttacactgagctttattcaaagccttgattgcttttaaactctcttcctggcattaattggataactgtacagcaaaggcctccttctgatactcagtgaatgcacagtgtttatccctgataaagggcaagtgacacataaggtttattttatcatggaaaacagctaataaaaatacgacttagttttctgaaagcgattattctacgtgcctctttctcatggattgttgacagcctctgggtataatggaaaattagaaaaggctgccagagacacagttgattcactagttcaaggaggaatcagaaaaccatcttgactctttatttgattctgctgtgaataaccagtctgctcctgagttctggttttggtctttctttagggcatctcattatgtcagagcctctgtttccaccacatctgccttacagtaagccttcatgagctaattcttgaagtcactgcaagagctttccagctggcctcctagcttgtcatctcttcacatcttctaaccatccaatgcaaaatccaaaatattagtctctatgaagaaaattaacctttaagaaatgctgcccccacttttaagaaacacagttctatttaagaagctctaccgcctttctgttgtttgtctgtccaacacagcctcttctgctggatcctggaattgcgtattctgtgtccaccctgcctatacaaccctcgtgccaccctcaaacacgtattttctagcagtggcattgaggtgtatttttctttacatattagataaaattctaagacgtctgtacaataacgctacttctttcatgttcactcctgcttgtcctaagaagggctggagtttcagagagaatgacaaaaatttaaaaagaaatttgtttcgtatagaaatagcatatgtcataaagatcatgcaaaaacgctgaactgtcgttctgacatttgaaccctgcatttccgattaagtctctctctatttattctccacccactaaaaatcagattattttctcccctgtgactgactgcccccttgcccttcttctcctctttctcctcctcgttttccttttttagaatgttttcatttggcctctacccctccaatcccatctttctggaacccacaccaaacttacctcctcctggaacctcaattctgtgtgcaaatgaggatcagacagttgtagtgcaaacagcataggatttacagctggaggtgtgggtgtgtttctcattggctaggtgcatctagaacatagatagatgaaaccttgattcatgaaatggacgaatggttaatgaatctcagtctttgttttcttttctccaaaatggggccaatgataccagcctcacagggttgcagtgatgattgggtggcatagcacgtacaaagtgcatggcatgagcccccctcatttccagctctccagggcattgtggccatcgtgaacatacactgtttagtttgtaatgggttgttcattgttggtgaatattcatcttagaataaaaaaacagataagcaaatctggaagggtattctaagaagaagaatggtaattatggaagagtaaatgaatgctgtggaacaaaatgaactcaggtcatttatgtggaaaagagagataaaagaaggtcatgcagtatatgtctttcagtgttcggcttattctgtttagtataatgcccttcatgttcatccatgttgtcacaaatggcaggacttccttctatttaaggctgaatgatatcccattgtgtgtgtgtgtgtgtcacattttctttatccattcatcaatggacacttaggtttttccgtatcttggctattgtgaataaagctgcaatgaacatgggagtgaaaacatctcttcaagatactgaaggatattatgctgagtgaaataagtcagaaacagaaagacaaatacttcatgatcccacttatatatggaatctaaaaaagtttaactcatagaaacagagtaaaagagtgatttctagggaaggggactggtgtggagatgttggtcaaagggtacaaatttgcagttgtaagatgaatatattctggagacatggtatacagaatgattactatagttaacaacaatgtattgtatacttgaaatctgctaagagagtcgattttggtattctcaccataaaaatataaagtagctatgttaagtggtgggtatgttaattagtgtgattgtggtaatcatttcacagtgtatatcaaaacattgctttgcacaccttaaatgtgtacaatttttatttgtcaattttactgcgaagctgaaaaataaaatgtaagaaaatacaaaagaaggatggttatcaaagttgacaaagaagtcaagctgtaacagaaccagaaagcaaaatccctgagagagtgttgagcaaacaccacacagagtaaaagggcttgatatggtttggctgtgtccccacccaaatctcaccttgaattgtaataatcctcacgtgtcaagggcggggccagatggagataattgaatcatgggggcagtttcctccatactgttctcatggcagtgaataagtctcatgagatcttatggttttataaatgagagttcctctgtacaagctatcttgcttgccaccatgtaagatgtggctttgcccttccttgccttctgccatgattttgaggcctccccagccatgtggaactatgagtccatcaaacctcttttctttataaattacccagtctcaggtatgtctttgttagcagcatgaaggcagactaatacagggattgacacagaatgtgaaggaatccccacctttaaggccagttgtgcttgcacacttttttttttttttaatgcttccctggtctttcaggctcaataaccagttttagaaagtcaactccagaaaggcatggaagaggggatctagaaaggcatggaacatgactaaatacagaagtttttctcagattggtgacctcatgattcgtgtggaatagatttgaagtggagagagttaaaagagacagaacaattggattctgaggtcacaataagaaatataatggggtagaacaggaagttgttttcagacaagctatatttggagtttcagatcttggtgatttagtgtcaagtgataatgatgccatatgtgaatgaataaagtgaaatgtgtatgaaaatatgttttctgctgctgaggatctgtgactcagcacacaggaagggtgatcaatgggaatgctcaagtcatttaggaaagtaattatgggaggtggaatgttctaccatatccacgggtattttttacctttaatttttatttctcagggttttaaaaattcattcctttacttatttaaattccttagtattttttttaaagtcttggattgaaccacagtctataccttaaaaaacattcagtgatttctattttatagggaagacatgaaatttagatgtgggaatatggctcagtatttaagaataactatttttctttttaatctatgaaaacttaatgttttaagcagtatattgaaatatatttattaagtatttcaagcaattttcaccttctggtgaagggctaatcatgtaattaaaaaaagacgaagattcttcatattaatgcatttatgcataacacagcttctaataactctttgctggttttttgtttttgttttgacgtggccagactggcatgtatagtaaccctgggagagagcttgtcagcattagcatggggctatctaatagtaagttaaaatgagcattggcatttataagcaagggagaaattagtaaaaatcccagattctcagtagggctaatggtgacaacttgaaggtttgaaagtcgacagaaaaatggtcaagcacctttgagaaactgactgattctatgttgcttacattcttctcatgccctgattctcagatgactacaatttttcctccatactttttttttttccatgatagattggctacatgcttcacgtccttctctgaaaatcctttcctagatgttctgtctgttccttgctctagttacttggcatcgtgtttagtcttaactctgagaaggagctggtagctgaacatttatcgtaggaagagatgcatttggctgagggaaacttccattgagtgtaatattcgcttccagcatgaagatttttcagtgttatttctgtagtcttcaaataaatagccaagccattaaatggaagataaaatatatacttccaaataaatcttaaatcatgacaagggagtgccaaatcatgcctaacgttttttaacagctaggatatttttagagaataaatttattgagataaatcagggactttacataacattccataatgctttaatgggcatttcatgatttcaaatcaattttgctttggtatgttaattactatgatttatattttgatgctaacttgtttcaaaattatttttaaagaaattgcatatgtgagctgctctcaattcattttttactatcatgcctaaattaaataggaactgctggtttcttttctacccaaaaacaaatgtattggtcatttaagcctaaataataacttttttataaaaaaagtgttcttaaggaaatgccagcaatcatactgttttgcatatccttaaatccaatcaatctttctccttttctccttttattctttttaatgattttggaagaaaaggaattatattgggagagaaggtggtggaacataaaacagatgtcacatttttcacgtttttctttcagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggtgatttccatatgatttctttatgcaagaaaaagttcatttaaaaaaattaatcactcaaagtatgtatagctagccagatactgaacaagttagtgcaatgaagtaattaaataaaggtttgttttaatgaaacgtggtgtagtcaatataatcgttagtattaagtcaatgcctttttgagttattttctgtaatggaccataagtcatgtatattttaattttataatcaaacagagacacctgttatatggggaattaattattattccttttaaaactatatataagtagatattctattatcttaaaaatatgtttacagccaaagcacatttcttcaatagtctacctataaaagctttaaaattatcaacttagaatttactacaattattttaacatgcaattgttttatatttttaaaaagacaaatcataccacaaagaactaatgttctgtggattatattttgaaaaaatagatctgtaacattttaggaattttaaaatcaaatttaaaatattcctctaagcagagaagaatcttatgcatgtgttctttgtctgaaaagtttaaaaaagacattgatagtatttgagactagagttggcatgtatactgctcttatttattatttgtaaagtgaaaatattttaaatgtttatatttacatttcagcataacgtatatgttacattgctaagcaactagacctgtacagaaggcttatttttaacaaatattcatagtcaatctggatgtaatatgagtgattttgttacacaatgcatactgattacagtgataaatctgttaatgtaggtcataatttgaattagataatatttcatttagttaggaaacatcaactaaatcccatcacatcaactaaacatcatttagttgggaaactaatatttcatttagttgggaaacatcaagattatgttatatcatacatcaagattatatcatacaacagattatgttatatcataaacatcaagattatgttgtgtgtgtgtgtgtgtgtgtgcgtgtatttcttttagaattgcacttacttttagtgttacatgtttggtatgaagaatattgtctctcttacttaaactctcatttttcaaatttctactccctttggaaggcacccttttcttatcactactttcacaaaaaaatacctacacagtaatactgtattttaaaatgttcataaaatgctagtagtaatgcttagcaacaataaaaattacctaatcatcaataactctccaatgcctccataacatattgctaattaaaaatgacttttaaaaataagattataaaacttcttgtattaaattccgctaatggtgaagtaacttgcatagagctaacccttctcagataattgttgtaaatccaggaaaaaaatgttagaaaaacaactacttgaaataagcagaaagtaaccaaatgttggcagaaactgcccatgtgtttacagcaaagacaatatcccagatatagagataggattgaaaattaagcaaaattcacacaggctccacctaatgaactatcaaaccaaacaatggcaatttattgtgataaggctgtgatttaactgcctatgaaaacaaaaatgaaatctttaaagaataacaaaagattctggaatctttacaatgtatccatgatatccagcatgttataacatttactgaatattcaaaaaagagtacattttcatctaaagtcaagaaattaagagcagttattacaaaccaaccttggggtactgatgtttgaattggcagaaagaaactttacagcaactattataaaaatatttgaagacttaaaggtaaaaataatcacaatgtgtaaacaaagggtattttaagtagataagtgagaactgtaatatggaaccaaaggtaaattttagaatagaaaagagcatctgaaataacaaattctaatagaaattcttcaggctaaagagaaataatggatgaaaactcagatcttcaggaagaagtgaaaagcactggaaattgcaaatatgttggtaaatataaaagccagtgtttaaattattttcttaattaaaaaattaaattcactgtttacttttattataaagtttataacatatggatttacaatatattacagcaatagataaaagaatatgtgtgtggaggggagcagcgttaaatgaattatgtcttagcaagcttctgacatttcacattgttaaaaaacataatgtctaaatagactgtgataaattaagaatttactttgtaatctgtaaagcaaacattgaaatacaataaatatagctaaaatgtgaataaagaaaataaaatgaaatacaaaaaatatggaataaaccaagaggaggcagcaaaggaaaatggaagtacaagaaatcatatggggggcagccataaaaaaggatgagttcatgtcctttgtggagacatggatgaagctggaaaccatcattctcagcaaaataacacagaaacagaaaaccaaacactgcatgttctcactcataagggggagttgaacaatgagaacataaggacatgggggggaacatcacacactgggtcctgttggggagtggggggataggggagggatagcattaggaaaaatacctaatgtagatgatgggttgatgggtgcagcaaactaccatggcccgtgtatacctgagtaacaaacctgcatgttctgcacatgtatcctagaacttaaagtataataaaataaaataaaatgctacaacatttcaaaaaataaaaaagaaatcatatgggggaaacaaaagaaatagcaaaatggtagacctcaaactgcagtatcaatcattacactaaatgttaatgtattaaccaattccagtaaaaaggtagaaaattgtccattgaattaaaaaatctccaactgtgttctatttttaacatatgctatattttatattctctattacatattttctacaagagacatttaaatgtcattatgttttggccaggcccagtggctcacacctgtaatccccgcacttcgggaggctgaggcaagtggatcacttgaggccaggagttcaagaccagcctggccaacatggcaaaaccctgactctaccaaaaaatacaaaagttagctgggtgtggtggtacacatctgtaatctcagctacttgggaggctgaggcacaagaatggatttaacccagaaagaggaggttgcattgagccaaaactgtgctactgcactccagcctgggagacagagtgagaccctgtctcaaaataataataatagtaaataaatcaaatgtcattctgtttttatgtgctccgatgagtgactggatccatactcttttgtaggtgcaaatttagttcagaacatcttggttttgcaatgcaataaggactattaaaagttcttaagaattttgttgttgctattgttttttaggaccaatgacactggattgcttgcttataaagaacatcttccagtaactaagatcgtgattacagacacaggccgactgcattcagaagcagcttataaactggggcctctgctctgccagggagacagtaagtggttacaatgtgttgaaaccgtatttgagaaaagaaccatgacttaaagtaccatcacttaagcatcacgtttctatcatataataactaatcagacttctattgtgaacattttttttgtttgtttccacatacatgaggtgcctttagtagtcaaattcatagacagaaagtagaatggtggtttccagggactggggacaggaaagaatgggaagttacagtttaatgagtacagagatttgggagatgaaaagatgagttttagtgatggttacacaacagtgtgaatggacataatgcagttgaactgtaagtacacttaaatggtaaaaatttcaaattttatgtatcttttaccacaattttttttttttttttttttgagacagagtctcgctctgttgctcaggctggagtgcagtggcgcgatgttggctcactgcaagctctgcctcctggattcacgccattctcctgcctcagcctcctgcacaatttttttaattaaaaaaactctttaactatctgaaggctactatcatgacccttggaataatcttcagagtagacacatttatttccttcaaccattcttcatgtgacatgattaaagtccattcatacctccagtcactcacctctgaatgttctccagccactatacccctgtttgagactgtagacctcaatatgacactgaccagttaagaatggaaaaggcctatcactgccctcaatatggctactagatttggtaattcagccagacttcctactaatttattacaacgctgtttatttctatagagctaattttctagataaaactccaagttcttttttatttatttatttatttatttattttagtatttattgatcattcttgggtgtttctcggagagggggatttggcagggtcataggacaatagtggagggaaggtcagcagataaacatgtgaacaaaggtctctggttttcctaggcagagggccctgctgccttccgcagtgtttgtgtccctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaatagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctccctgacggggtggcggcggggcagaggggctccgcacttcccagacggggcggctgggcagaggtgccccccacctcccagacggggtggcagctgggcgggggctgccccccacctccctcccggacggggcggctggcctggcaggggctgcccccaccttccggacggggcggctggccgggcgggggctgtattgtgaacatttttaagtacggtctgaaatactctttcagtcagtcaacaaataagtactcctatgaggtacaaagctatgatggcaaactttgttaaggttctaagagaaagaaaccactgggcatctcaacttgattagttcatgagtacattccagcattcctgaatttctaattgctgttacccacataggaaagcctcagtgctaaacacagttattaataattcatgtgaatttcctactgttaggcctgggatgaaattagaatgtcaatggaatcatgtcattttaaccccaaatatatttcacctgtaaatctctttttttttttccagtttgtgtgtgtgtgtgtgtgtgtgtgtgtctgtgtgcatttactttaaaccagtggtgcatgctgttttgcatatgcaatgcattaacaccttaaaccagaattttaaagttcaaatatagttccactatatttatgttccatatatacatatatatgttttatatatatatattttctttgatcagggaatgaaatgagcatatgtattcatttatagattgttaacctctctgaaaatagttagattagcgactagtgcattaaatatgtatgcttttagtacttccagaacttaaaatggaaatagatgaaatatttgtttacattaacaccacgccttaaaataaaattttatgctaggggcacaacagaataagagggaatctgataattcagtggatttatggagacacagagcagaagttgcttagttaaaaagcaaagatgatactggccttaaaaattatatatacattgtaaatactgtttaccattatactcaccatctctgatatgtatcacctctacttcctgttctaccagtgagccttacacaatcccatgaagatgatataggatatttcatgggaagaaaaattatgtgcaaagagatgaggttgtaaacttcggatgcatccaggagagtgtaacgatttttcatggctgtagagaagttgttttatacatcacgtgtacctttcacttcttgctctgatcttaaccctgcagggacccaggctggcttcctctgccttccttatttcattagccaaaacccctgcctatttgtatgttttaagtgaggtccctaccaactctctcccttagactttctttctcccagacttcctgtcatcattttaagcacacaacatcattccacttagagcagtgattctccatccaaggcaatcttgccctgcagtggacatttggcagtgttcggagacattgttggttatcacattgttggggagtgggatgctactggcatgtagtgggagaggtcaggtttgctgctaaacatcctacaatgcatgagacggctctccacagagaagaattatctggccccaaatgtcagtagtactgaggctgagaaactagagctttgaactactgtgaccatgggaatacagaggggagctactacattagcactaagaatttacggccgggcgcggtggctcacgcctgtaatcccagcactttgggaggccgaggcgggcggatcacgaggtcaggagatcgagaccatcccggctaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaagaatttacaaatagtttcaagtatttagagacccactaattaatctctgacttattaattaaacagtaatcaagtgattggtcttcttgcctcctgtacctatttttagcgttgaggttcatcgtcacgtgaggttattttctgcatgaaggactaaggactaaggactattttctgcatgaagcgttctttattttctcagttggatgagcagtggcttcagaacagcgaatactccttttttccatatgggaaatctgtaccacttaagttacaacgccataggtactttttttttttttttttcatttccaagtgaggctcactggacagatataggactaacagatagaggatcatgcacggtaggccttataagcagagaaaagctgcatggacattactttgaaggcatcaggactacacattgaataatttaagactgagaaataacttaattctcatgattcagttgaaagcctgatgatcagttataaatctaaagatcagtcaagtgacctctgatgtaagacaaggaaaagatgagagcttgaactaggcaatgattggcatggagctttaaaagggggatcaactacgaggtaaattcgatatgatttagatgtaagattgagagttaaagccttggggatgatctccagctttctgatttgaataaagccattagtgtcattcattgagacaggagattaacactttttttttttaacagaaaaaaaagtgagaatgaaaaaagtagtattttcattttctcacacaaacgagagatattgaaaaatgtagatcagccatgtttttctaggaaagaaggtgaagttgtgggaaagcaggacaaataaaacatgactgttggacctactagtaccggttatgaggttaccccaatttatttatgttgtcttttttcaaagctttcttttcgttttgttttcaatttcattttactgctgctattattgttgatatcagaaatcaactagcaaactaggaaataagagaacttcctccatggcataaaggacatctgtgaaaatctgatagctaatgtcatactttgaatagtcaaggatataactgctttccctttaagttcaggataaaggcaagaatgtctgctctcactactcctattcaatctattactcatggtcctagcacatgtaataagtcaaggagaggaattcaaggcatttattaagttgcagcaaaagttaatcaacctgattttaatggcaaatcaggttgccattaaaagaagtggcaaaaactgcaattacttttgcaccaaccttaagtgagaatgaatgaaataaaatgtctgtttacaggtaacatgactttctaggtagaaaatctcaaattatatttttaaaaagtgagtttagcaaagtcacaggattcaaggtcaatattcaaaagtgaattatatattttttattattatactttaagttctagggtacatgtgcacaatgtgcaggtttgttacatacgtatacatgtgccatgttggtgtgctgcacccattaactcgtcatttacattaggtatatctcctaatgctatccctcccccttccccccaccccacaacaggccccggtgtgtgatgttccccttcctgtgtccaagtgttctgattgtttaattcccacctatgagtgagaacatgtgatgtttggttttttgtctttgcgatagtttgctgagaatgatggtttccaaaagtaaattgtatttctatatgctaatgataaaaaattataaatgatattttaaaagtaccatttttatactagcaccaacaacataaaatattttggtgtaaatataacaaattattaagaaaaaattaagaaaattatatttaaaaatttatgaattaaaagatttgataagatgtcaatttttcccaaatttatatatagactgaaaactatcccaattaaaatccagcaatctcttttttgggaggggagtagaaattggaaagcttatctttaaatgtatattgaaatgcaaagaaagtagaatagcaaaaatgttttgaaaaatataaacaaagtttgagatacactactagattataagacttactgtaaaactaacagatattcaaggaagtgtgatattgacattacaatagacaaatacatgaatggaatagaatagagagcccaaaaatagacccatgtatacatggttgcttgactttttacaaagctaccaggggaactcaatgatgaaaggatagaatttttcaagaaacagatctggaacaattcgaatccaattgaaaaagaaaagcagaatgaaaaaaaaaagagtgtcaattcatacttcaaagcagatacaaaaattaactcaagattaatcataaacttaaatctaaaaccacaaactataacactgctctaagaaaatacaagggaaaatcttagtggccttgggttgggcatagatttcttagatacaacactaaaagtacaattcatagaataaaaataataataaattgggtttcactaaaaagcttctgcctttaaaatgacactgtcgagaaattgaaaagaaaagctacagactgggtgaaaatctttgcaaaatacatgttttatagaggctaatacccagaatataaaagtaactctctcgtggtgcaataatatttgaaaaatcaatttacaaatgggcaaaagatttgcacatacacatcacagaaaaaatatggatttaaataaacacagtaaagatccttagcatcattagttattaggagaatgcaaactcgtaccacaatgtgataccaatatgtaactgttaacatttaacaaataataataacaaaaaaaccccaaaatataacaagtgctagtaaggatttagagcaactagaactctggtacattgcactacagatgcaaaatggtacatactgctttggaaaagaatttggtttcttataatgttaaacccacatttaccatatgacccagcaatccccatcttaggattttatccaagaaaagaggaaaatctatatgcatatagtcagttttttgttattattattggctttattccatagtcccctaaaaatgaaaaccactcaaatgtttatcaactagtgaaaggatacacgttccattttactgtggtgtacccacaatacacagtggaatactactaaacaattaaaaaatagactattgataacgtgcaacaacatagatgaatctcaactgcattactctaagtgaaagaagccagactaaaaagcctacatgctttgaatgattcaatttctaagatattctggaaaagtcaaaaccataggaacagaaaaaggatctctgctgcaagaactttgaggtgagaggaattttacacaggggtacaagaaaactttgtcaggtgaacaaaatgttccatatcttgagggtggtggtgtttttatggtttcaggtccttttcaacttctagagctacacacaaaaacaggctgagttgtactctatataaattaccataacattaatatattttaataagtaataaatgatgtcttattcaacacatctgactgaaaaacaaaacaaaaacgttaataacagtttgcatagctatacttgcttaattttaagaattggaggctgagtgcagtggctcaaacctataatcccagggctataggaggtcaaggtgggaggattgcttgagactgggagctcgaggctgcagtgagctatgattgcaccactgcactacagcctgagcagcagagtgagaccttgtctcttacaaaacaaaattgggtcatcaaaacaaacagagaaacaaccgaccactagaagtaaattcatggaacagtaaagatttcagtaatatggatattctccaattctccagcacatttctggaatcgtgctgaatatgtttctaacttatattgactttagaaactttagaaaaagagtcaaaggaaagaatcaaggggaaacatctgggtttatcagttagtagaaaagtcatgagtaggaggagtcacctatatatttcctacgtaatcagcctgccaagagcagtgggaacgtatttatttttgaggaaccatccaaagtcttttagaccaacagttcctccactttagcatgtataaaaattacttggagagcttgttgtagcacagatttccactccttatcccagagactgtgattcagggggtgtgggggtaggagaatctttccttatctccctccctcccttcctcccttcctcatttccttctttccttctttcctcccttcctcccttccttcctcccttcccttcccttcccttcttccctccccttccgcttctcttccgttccttttttttttttttttttttttttgacagaattgccctctgttgccccggctggaatgcagttggctcattgcaaactccgcctcctgggttcaagtgattctcctgcctcagcctcccaagtagctcggattacaggcgtgtgccaccaggaccagttaatttttgtgtttttagtagagacagggtttcatcatgttggccaggctggtgtcgaaccccagacctcaaatgatctgcccacctcggcctcccacagtgctaggactacaggcatgagccaccccacctgcctgggtatgagaattgctaacaggcttccacatgctgctgccggtccatggaccactccatgtagtgctgcccccagccagtgaggttcacaggctggtactggtctgcacattctttgctaccattctgtgaggaggctagtacaaaaatatagagtatttcagaatgacttctgccatttggacagagtaatttatgtctgttggacataatagtaataaaaaatggactggagatagtattttgtatacctttgcttttcccattcatttttctagcaatttacatttttaatttttaattttaaaaatgtaaaattttcgtgggtacataatagatgtatatatttatgggatacatgagacattttgtcacaggcatgcaatgtgtaataatcacatcatggaaaattgggtattcacccctttaagcatttatcctttgtgttacaaataatctaattatactatttttgttattttaaaatgtacaattacattattattgactgtagtcaccatgttttgtcgtcaaatacaaggtcttattctttctaactatttttctgtacccattaaccatccccacctcctactggcctcccattctctttgccagcctctggtaatcatccttctactctttgtctccatgagttaaattgttttcatttttagacctcacaaataaattaaaacttgcaatgtttgtctttctgtacctggcttatttcactttacataatgacctccagttccatccatattgttgcaaatgatggattctcattttatatggctgaaataaaaagaggaaaaaaaagcacatttttctatataggtagtttaagactcacagctctaggtcaaaggttgggtatgaagtggaccaatggtgctgacatagggcctgcccaagtgttctaactgtagttgcagtatgttcagaaccagaaacagagtttcagagtagaagcctaggcattcatacacagggttaaacctactttcttgacacacagcaagaagaagtctacagagactttgtgctacttcagtgaatcttgcaacacaaagggagttcctggaccacgatggcatctggctctacgtccttgtcactcactctcccttatctgcaaaatctccctaattcttttaccaaaccctttcacactcagattaaaactcttccaccatgatttctagatgacctagtcattctgcgttctcaaaacatgtttagcatattacaaagatatctttctcatactggcttttaattatttttgagcccctcaagagcagggtacattcctcatttattcttgtgttcctgataactaatgtattacctattgcacaaaagataatcaatgaataacagttcatgaaataaagagaatgatttaatatatgcatgtaaagaaacctacagcttatgaattattagtaagagacatgaatacatttttggttctataagcaattaagtaaatatatacttttactaaaaggagtttagactctattgagttattgattctgatataaaaatcacatagtagaagaatgtctagttccatctaagccatttctcatcaatatgcctgaagttgtaatagtgaaagtactttcaaataagaatataattttagttaatattaattttttttaacttttcactcaatacagtgcctttattaaactgaaatgattgccccttcttggaaaatagattattttatggtctattttgctttttttttttgttcacttttttattaccaaccaataatttatatgcaagaaacttgatcaatgtgagggaacaaaaattgtttttagtactttcaaaaggttttcactttggaaccctgatagttgtcaggaccatggtatccttttgggggaattttatacatatgcatacctttagttaattgtcttaaatattaatgactgacttgatacaaaatcataactttttttttttttttttgagatggagtctcactgtgtcgcccaggctggagtgcagtggcacgatctcggctcactgcaagctccgcctcctgggttcacgccattctcctgcctcagcctcccgagtagctgggactacaggcaaccaccaccacgcctggctaatttttctaattttagtagagacgtggtttcaccatgttagccaggatggtctcgatctcctgaccttgtgatccacccgccttggcctcccaaagtgctgggattacaggcgtgagccaccgtgcctggccaaaatcataactttttaaagctatatagaaataccaaaaaagcaagtaaaaaagacaccaagaatcacataactcagaaataatgattaatatcaattgaatatcattccaaatgttggtagatatctctagtgcagggcttcccagtctcaccacttttgacatgtgggctggataattcctcatggtggttgaggaccgtcctgtgcattgttggagctaagcagtatccctggttcctacccaagagatgccagtagcatccttcctccaaatgtgacgaccaaaaatgtctccaaacattgccaaatgtcccctgggtaaagaattgccctaggtggagaatcaccactttagacaaaataattttaaaaagaggttgagaaatgaatttataaaactttattcattaaaattgagaaagaaaacaccaaatttaagccaagatggctcatgaaatttatatatctaacgaagtatattcaacgtaagtgatcccgctaaacttacaaaaaaagattatgcgcgttttaaaagattgtagagtcactacattttatattaaatgtatttttaaattataagcagcatttatctactgtgagaaatggaaaagctagcactcatttcttctttccccttctttatctcccccttcccagtttttgctagttatgctattatttgtatattgttacttttaaaggctaaccactagttctattctccaatgctttttattttgattaatttctttttgtcagttagttgatattttacctttttttttgtctttagaaagattcttgagggttgcatttttttgattttgtatgtgcttgagaatatttgttgccttaggattctaaaactctgatgctttaactttatattgtctattgggaacagcttaattgacatataattcacagcctataattcacccttttaaaagtgtacagttcaatcaattttagtatatttaatcattttaatgtactatacagatttgagcaaccatcaccataatcattttgaggacatttttatcacccccaaagtagacctgctcccattttccagacactgtccatttcacgcactccccatcccagccctaagcaaccagtaacctgcttttttttttctacagacttgcatattctgaatatttcatatagataaaaatacaagatatgtgatctcttgtgactgactacttttacttagcatcatattgtcaaggaggttcatcagtgttgtagaatacatcaacgcttcattcttttttatgaccaaataatactccattctgtggctataccacattttgtttaatcactcatcagttcatggacatttgggctggatccactttttggatattatgataaggcttctgtggacatccatgtatgcttttttttttgtggacaaaggctttatttctcttcggtatgtacctaggagtagaatttccctacatttaacctctttaggaactggcgtaatttttatgtggcatgctgtgtaaccttcagtagtttgcatatatgatcccatacttgtctgtgctgaggaatgcagttgtctcgtcttctactgcttttctaaatgtctttttagttgactgtatttcattatgaatataggttttgtttttgaaaaattttctcaacagggctcttgtatgctttattttcagaattctttcagacttgaaagtgtctgcctattgccttaacacttcagaagtaaactagactggataaattttctttctctcaggaatctatggacagatttcctttattttatgccattgagtactgtgaaggactctgaggccatactggtttttttcaccttgtatgtgacttgctttttctgtctgaatactcgaaggaacaattatccttaaaggtcactaatttaacaagaatgtacctgaatgttgttcatttggtattactttttctggaaatagaagtgatgtgataaaaggtatatacacattttataagttgttaaaatttttgcaaatgtggtctgaatttctgctctcagtctctctatctgagcaaggcagtatttttaactctttggcgtttgaatttttcaacccattttatcacatgtatttcttttcaggtaattcattacattgaaattttatgtttaatcaaagcaccctgaagccttcatagttagaaaagattgctgtaagtttctcgttccaaaaaattcttgagtcactggagttagtttcttcattttgtctgcatcgactagtacagctgtctgagaaatcacagctgcccagagtgcattaaataatcaaaggtgcatgtaggcaataaataactttgcagaagtgagactcttcaactggaaaaagatattgactagtgatttggttaatttctctttcatttgacagagttctcttccatttggcagactacatataaaccgttaaaaaaagtgaggatcaattccatttcaacacataataaaataatgtaactttgttagctccactatgcttgataattctctattataacatttttattttaacttttatattttactttatcttattgggtttatctttttcaatttcacttttgtatgccctctttctcttcctctttttcttcttcctcctcttctcttgtctctgtttttccacttttcttccctctttccacttgtgggaaagagcaaaagagcaatgaacaaaatagataaaaatatcggtattcttggagcttatattttcttggagagagagagagagagagagagacaataatcaattgaaatatgtggtacagtagaagctggtaagagctatgaggaaaataaagttgaggcaggagtggggtaattttaaataggatggtcatttaaagctcaggaagaaggtggcatttgaataaagatttgaagaaaacaggaatgcaaggcacatgtctacctttggaagagtactctacacagagggaaaggccagataaaccacacagaaatggggtgtagatggtatactcatggaacagccatatggtccaagtgtttggagcagagtgggcaagaaagagagtggtagaagtcagagagaaacctggtggtcagatcaggaaagattttgaaaatccattttcaatctgaatgaaattggagaacattagagacttttgagaagacgagtgatatgatctaactcaggttttagtgagattaaatagggaaagctcaaagcaaggaaaccatttaggggaccatatcaccaacccagctgagaaattatggtagcttgagccatgggtgcaatgatgagagttgtggtgtgggtagagttgaaaggaaaaccagtaaaatttcctgatgaattgttgtagtttgcaaaaggaaaagtcaaaaataacaccaaggtgtttgatctaatcaattagagggaaagaactggcattaattgaaatgggggagattgctgctggggtcagagttgtagagaaatataaagagcccagttttaggacatattaaggttgagatgtcattaaacattcaggaagagatgtggagttgtcagttttcagcatgtttaaagccacaagatggaacagcaggagttattttggatgaagaaataacaacagggctttggggcaattaagtatggataaattgacgaggtgaagaggaagcaagaaagaagactgagaatatatcacctatgagaaaagaagagtgtgggtatcctggactccaagtgaagaacgtgtttcaaggaggagagagcaatcaactgtgttaaatgttgttagcttaagtaagataaaactgagaactgataatggctttagcaacatggatgttatagcgaccttggtgatggtttgttttgtcaagtgtttggggataaaagcctcagatagattcaaggaatagtgggaggaaaaaatgtgggaaaatgtaatggtaaatgggggagaaagtatgatcacgagagtggggtttctgagatgagagaattaatagcatgtctgtgttagtaagagagatccagtaaataaatccctgcattgtggacggttaattcattctgacaggagaaaatggagaacacaggtgatgttgcaggaaggtgaacaggtgtggtggtgggtgcttagaggaggtcacttctgtcttctgctcttttcttagagattactagaaaagttaaagaatgagaaatgagatgtattattggggagaggaagtgtgaagtaatcctctaagagcatgggacagtgaaggcatgaaggaaatatagtgtgatcgcagaggagcattgagtgtgcacacttggcatcatattacagcacgtgtacttacctgtagtgttctttaaaacccgatgtttatacacagtcccacataaggatttgtaactaagttctgtatgcaggtatcaggcaataagtatattatgaataatttactagtttttattttcaattattttagtctaatactttaattaatatttaaatgtattttctatacatggaaaaatattcaacatgccagattacaaatgggctgtaacagaccagtgtatagatgtgcctacttaaaaacagtaatgtgtatgctgtaaagactataagtgtgcaaatgcaggaagttattaagaacccttctacttactgttaattgccgagttaaaataattttttaaaagacagtaatctgaatatcaagtgacttttgactttaaccgtgtaaataaaggaatcgcacttttgttagtaaatggccaataaaaagctcaaaattctgattgggcacttaattattttgtgttgctgaaatcagaatcactctatctcatgttttttgaataaatgaatttggtcctcttctctgataaataactggactcaaattttattgcatgatcatgtgtgttcatggaggacatcaatcttggattgaccagatttaccttgaatttataatatgttctccttttatattaaatgatcgtcatttgctaattcagaataggttacttcaaatagaataaggatgttacgcttgggaggctctctcgtctgatgcccaactccacacctctttgttgtcactctgaccttcgtaggaatgactgagggatgatgcagtggcaaacttagataagtgttacttatctcatttactattttatatattctcttacatccagactaaaaataattggatgttgctccaaaattctgttcttccagtttcttctaaaataaaattatatgtgtgtatgtctttgaataattaaatacacaagtctatttctttgctattaatatcaaaacagttttgtgcaaaactagtataagactaatgaaaagaaatatcttcttcagtgatagtttgtaagatcttttgattataaaaacaagttctgctctgccttcataaaaggaattttcactttccatttgccacatctatcttactgtatgtgcatgtgtgggggtggttagggggtgtttatggaaacatctatgaacagctttgttctcttttatattgctctgcaaaccacaagctataattatctccagccagattttattttcttcatttttattttgcttatattgattcctattgaggttaataaatagttgaaaacaataatagatgtgctaaaaagaggaaccagtgaattatgaaaccaatacataggttattgtgttctgataatataacatataatttaatcttagaattttatttctgttaaaatctatatttttcagcttatttaaaaataattcatgtgtttagaagatgcactgattactaaaatattcttcacatcagcatttcaacatttaaagcatttttacttttaagaaaaggcttgttggaattttatatgcatataaaatttcctgtagggctaggaaatctaaaaatctaaacattttttagacttgacatcgaaagcacaatccgtaaaaggctaaattgataaatgagactttatcaaaatgaaattttactttgtgaaagcttgcatgaagaggaagaaaagtcaggctacagactggtcaaaaaacagttgcaaaccacctatctgagaaaggactagtatatagaatatatgaagaatcctcaaaagttgacagttaaaaacacaattaaaatatgggtgttacgtactaaattgttttcccaaaatttatgttgaagccctaaccccaatgtgactatatttgaagatagggcctttaaggagatcattaaggtaaatgaggtggtaagggtggtgccctaattcaataggaccagtgtccttataagaaagagacaccagagaccccactctctgtgctgactcagaggaaagaccatgtaaggtcacaggatgaaggcagtcatctgcaagccaggaagagaggtctcacaagaaaccaatcctaccagcaccttgatctttgacttttagcctccagcactgtgagaaataaatgtgttttttaagccacctgacctgtgagattttgttatggcagcctgggcagactaacacaatgggcaaaagacgtggaaggaggttcaaccaaagaaggtatacagatggcaagaaagcacatgaaatgatacccagcatcatcaactgctaggcaaatgcatattacatcctcaatgaggcaccactttacacctctcaaaaggactaagatttaaaaaaaaaatagtgccaacacaaaatactggtcagtatattgagaaattggatcactcatacactgctggtaggaatgtcaaataacaaaaccacactagaaaaccgtttagtagtttctttttgttaattttctattttactttaagttctgggatacatgtgcagaatgtgcagatttgtcacataggtgtgtatgtgccacaggcgttggctgcacctatcaacccgtcatctaggttttaagccccgcatccattaggtatttgtcttaatgctgtccctccccttgccccccaccccccaacaggccccattgtgtgatgttcccctctctgtgtccatgtattctcattatttaactcccacttacaagtgataacatgtggtgtttggttttctgtttctgtgttagtgtgctgagactaatggtttccagattcatccacgtccctgcaaaggacattaactcattctttttcaaggctgcatagtattctgtggtgtagatgcgccacattttcttcacccagtctatcattgatgggcatttgggtgggttccaagtctttgccattgtaaatagtgctgcaataaacatacatgtgcaaatgatttataattctttgggtgtatgcccagtaatggcattgctgggtcaaatggtatttctggttctagatccttgaggaatcaccacactgtcttccacaatggtttgcaactctcatacaatccagtgattgtactcttgggcattttccccagggaactggcaacttacgttcacaaaatatttgtacacagatgttgacaaaagctttattggtaatagctgaaagctacgtaggtgtccttctgcaggtagatggttaaataaattttaatatatccataccatggaatactactcagcagtagaaagagatgaactattgatacagaaaacaatatgagtaaatcttcaaagagtaattctgggccagaagtggtggctcacgcctgtaatcccagcactttgggaggccaaggtgggtggatcacctgaggtcaggagttcgagaccagcctggccaacatggtgaaaccctgtctctactaaaaacacaaaaattagccaggcatagtggtgtgcacctgtaatcccagctactcaggaggctgaggcaggagaatcgcttcaacccgggaggtggaggttgcagtggccaatattgcaccattgctttccatcctgggtgagagcaagaatctgtcaaaaacaaaaatgagtaattctgattttttttaaaagtaagccagtctcaaaagactgcatattttatgcttttatttgagagcattcttgaaatgacaaaattatagaaatgaggaactaattagttgtgccaggaggttaaagaaggggtaaggagggaggaaagcggttttagctgtgcgcgggaaggatgaagaatactgtggcaatagaaatgttctgcctcttagcgtcagtgtcactatcctggttttgacatcctgctattgttttgtaaggtatgatcatgggggaaactagataaagggtgcatggaatctttctgtgttatttcttacacctgcgtaagaatctacaaacatttggaaataaacattttaattaaatccgtatttctggcttatttctttatgattattaagcattcagaaagactcatttgaatagtgaatgattccttgcttcggcatttctaaatttcattttattttgcttttaagaaaggtagtgttagcatgttatatgcattttgattttaaaagtacaatgtattaccttgaaaaacaatgtgttttttaaatactgttcctttataaacagctttattgatatcaaattcatatattgcacaattcagtaatataaagtgtgctattgaatggcttttagtatatctacattgtgtaacaatgaccacaccaattttagaacatggtcattaccctgagaagaaaccttacccctctgagccgctgctctccctcgatcgctccatctccctaaccctgggaaaccacaaatctactttgtctccataagcctgtttttttttaaaaaaggaattctataaatgtttagcaaaataaattatttttaaaagtacttatagtcctagcatagtactaagttaattttcctaaattgacttcatttttaactttctatatgaaattcaatacttagtacatcttcctcttttacgtgaatgactatatggatttattcttttatataatttcctttattctggtaagataaaaggtagggtttctagaaaattattattttatttatttattattttttgatgcagagtctcattctgtcatccaggctggaatgcagatgcataatctgggctgactgcaacctcagcctcccaggctcaagtgattctcctgcctcagcctcctaagtagtgggggttacaggcatctgccacaatgcctggctaatttttgcatttttagtagagacagggtttcaccatgttgttcagactggtctcgaactcctgacctcaagtgatctgcccacctcagcccccaaaagtgctgggattacaggcatgagccaccgtgcctggcctaaaaaattattctaaaatctctagtaccctatattgaattgaattgacaatgatgtagtttagagaattttatttttacttttttatgattgttatttaaatttttttctagatacataatacttatgcatatttatggggtacgtgtgatattttgttacatgcatagaatgtgcatgcatagaattacatgcatagaatgtgtaatgatccagtcaggggacttaggatatccatcaccttgagcatttatcatttctgggagttgggaacatttgagtcctttctcctagctattttgaaatacaaacgacaatgttcttaactgtagtcaccccagtctgctattgaacatgaagcttattccttctatctaactggaattttgtattcattgcccaatctctcttcctcttttccccctccgccatttcctgcctctggttactatcattctcctctccccctccatgagattagggaattttaaaccacctaatccatagaatgctgtcttcaaaagcctgcagctcctgctgctgcctgcctgctgagctctgtttcctccctctctttgcccttcctttctctgaggtggcccagattctggtgggtgtctcttagcacagggggtaaagggctgggataccacatgccattaacattatttgatcatggaaatattggcctttgctttctttataattgttttgaattagcagcaatttcttaacccaataaaacttccttacctcattttctaccttttgtgaacgtataaaataaggtctcctaactaaatgaaatagacattattatgtatatgagagtgctgaatatgcctaaagtaataaattggtttcattgctttaaagacattcatgtacagatagcagcaattcaaagaattgttcatctggttcaagcacttccttgaagccttctatatgatgctttattgagttagttatgatataatatgaaaaaaataaatgttatgtcataatattacctaatttaaacctttaagtaattatgaatgttcctctttctaatcagacaaaataagatttaataacattccataatgtgaagcttatttttatgttaatgtataacatttaaacaaaaaggcatctaattccttctgaaaacagatcagctaagaacttctaagaatgcaaatgtgttgttatccctgacttgatattttacattttcttgcatttattttgtcctagagatccaaaggtctagtacaggaatagctgtaaaagggacaaaaggaataggcttgatgtgactctgataatatatggtttcatttgactctgggaggaaaaacttcaaagtagattattagttgaataaattcagctctaaaattgtccacacacaagctgagaattgacttttgaatcagatccaccagaaaaacaaacaaaaatagaagcattattcggtctagaatttatacaaagtaaattaaaatttaagaaacacgtataagcaaagtcaagtttgtgatttttaactctgtatcttggtatctgttctctgctaacataacaaactgttgttttgaaattgctgttttccaacatcagaggatcaacacatctttcttccaggaaggtaatttagatagaattttatccatgtaggtaatgtgtgtagaggcagttgcttaaaactaaagatgtatattcgtatttgatgtgcagagaacttgctagtggcagcagacaatacagagtttgtttctctgattttactcctcatcaacctcctgtatccagtcggatttcactcctgtcagctcatgctgttgcatttatatttgattttccatagtttttgctatatatggttcataatattttttcgaaagaaaagttgtagatatgaaaaaaggagtgagaaattaaagataagtggtatttgggcagcaattataattaactttatagtctacatttttttcagatctcttaatttatatcccaaccttttcaacattttctgcccattttgaacatttgtaaacattttgagaacacttttaatttgctgtcatctacttcattcttattggcaaagtaagagataattttgaataaaaagagcattttcatgagaatgtcagcttggacagagtaagctgcatgttggtttgtaattagacaagactatttagaatgccggtctcagtttagaaaatcacaaggcccattaaagaaaacagtttatgtaactctgtgaagtgtgtgtgttagaagtgttagaacaaaaaatactgtgagcttctcttgggtttttgtttaaagcaggtaagtgttttaattttgaagttataaaagattgcctatttatcaatgtttggcagatcgtataatatcactttggtggaggatatactattgaggctgaggatatttgttccgtataaaatataacatttagaccatttctgtaatgatcattcttactctctattggaaaaaatccaggatttcaattcctgtaaaatctcttatgatatactcatatcttgtatactacatagttgacagaaaaaaagagcagatttgtataaataacattttaaatagcaaaagtgctaaaaatagaacatgtaattgtcattcattttatttcatgaatttgttttctttctgaatttttttttctttttttttttcacaaaacaggatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctgtaagtctccttttccagagaagtgtatgagattctatcatttagtagtaaatcttttaactaatttttaaactactcatgtgtctactttatcatctgattcttttcattgcgcccctttgaaaaactcaataatattaacttatcctgtttgtaagaaaataatttgatacttaacatgtgataatttggggaaataactggtagtttcttgtaccaatttaaatgcagttttaatttcagttaattaaaactaaaacacaattttttagttaattacaaattacttaatcaaccactcattttgatatacttctaagctgctcttatcttaatatcaaatgtgtatagcatgccttaaaaattatgtaaactttgagttactgtaacagttatttttacgtacaatgccagttgctatttagtttccttgccttggataaatagctttactttttatcgataggaaaaattagctctgaggaggactatcttagaataccatttttttttcaaaaacatgaatgtatttaactgtctcatttcacatcagaagacctagctctgtgtcagtgtcatgagtttcaaacaatagcattgaaaccatctatgttcgttatctttctgttcagcgattgttacgctgtagtgtgttcctaagtatattggagactcggcacttcgccataggaactcactagaacaatctttatgtgtaatatttccagctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtaagttctctttttaagcaatcattttattgtatgatatgtgttcagaaatggcccaagataaaataataccaactatagaaacaaggataataacaacaagcaataataacaaatcaccatggattcacaaactgtgtccaaatgcttcatttcttctgcataaccagcctgtgaaatgggtgttatccgtattttacagatgagatagctgagcttccagggttgacttgcctacagaaattcatctcataaatgagattcagatttgtgtttaactaattcctatttgcctgcctgcctgcctgcctgccgccctcctttctttctctctctctctttcttttctttatttccttccttccttccttccttccttctttctttcttttctctctttctctctttccttctttctctctttctctcctttcttttcttttcttttcttttcttttcttttcttttcttttcttttcttttcttttcttttcttttcttttcttttcttttcttttctttcttgacagagtctcgctctgtcacccaggctggagtgcaatagtgcgatctcggctcactgcaacctccgcccccagggttctagcaattctcctacctcagcctcctgagtagctgggattacaggtacctaccactacgcctggctaatttgtttgtatttttagtagaaatggggttttgccatgttggccaggctggtcttgaactcctgacctcaggtgatccacctgcctcagcctcccagagtactaggaagacaggtgtgagccactgcacccagccttacctgctttcttaatattacaggttacatgattggtttcagcttatttatttattatcttattgttttattatgataccaggaatgtttatctctgttctcagaattgttgaggaagccttctttgatgaggaaatcatccagccgatgccaaacattgaacactcccccggcccccccgccccaccaaccatcacatcaaaaacaggccaatagcaaaaagaaaagaaaacaaaacagatacccagtgtgtatagaattcatgtttgacagtttcaccagttcctctgctattttccctcattttgcccatttttttttctgatattttctggtcaccttcttaatatttatatcagaatgttgttcctttatttcctaaatccattcatgtggcatttataggtttgatagtggaatccttctggatgtgtttgttttactttgaatctttgctaattcgtttgtagaagttatggaccatgaattatctcttacttgatcacttctcatatagtttaacataaatgaagacataaaacactataaagcagaataaatgataagttattagaaattgtacttcaaggccaggcatgatgtagtcctagcacttttggagaccaaggtaggaagattgcttggggccaggagtttgagaccagcctgggaaacacagcaagatccatctctacaaaaagtaaaaaattaaaaaaattaggcaggcatggtggcactcgcctgtaatcccagcgttcaagaagctgaggtgggaggatggttgaacccagtaattggaggctgtggtgaactatgatcacgctactgcactccatcctgggtgacagagggagcccctgtctcaacaacaacaacaaagaaattatttttcaagaattctcaagagttacacttttgaagaaatttgatcagatccccattacaccttttatttcttaagagtctgatcttattaaccctctctcactggaaaggatgaagcatatttttaacatatttgaggaagacatttttgggatttccaatatatttgtgtaattactgttttgataatttattatttcctttactcaaatatttaatgaatagcttctatgagtaaggcactataatagacaatctaatcatgatcttgtgaccacttgattgacttacttaagggtatgaaaataataaagaatgtatgagaagaaatatataacttttaataacacgctagaagctcagtcaggaaattgacaaagctatttcttgaattacaaaaaaatgagagatggccacaacaaaaggtatggcaatttaaaatctgtcagtagcttggaaatagccttactattcttggaaattgagaggctgaaatagtcctcaaatttttcagtgaaatatgctgcagtttgcctgtggatgacctttcattcttggtatgaatttcagcttcatgagatggagtgactgtgtgttgtgccgtgtaggaatcttggccttaacttgatttcagacagaaatgaagcactagtatgtcatcagaaaactgctttaaaacagacttgagtcttttaacatcgatcatgtgatacaattttaataaggatctgaaagattttgtcttcatggaggcaattggttaggcctttgacctcactgtatgtgttgaaatgtaaggatgggtgttattccaatgttgtataaaaaataactgttgattatatttaagtcaagtcactgaaaataaaaaagatgaggcaacataaagatttgtgaaaaaaggtgacatatactgttaataaaaatctgtttatgcattttcctccttcctgctcacagataactgtgagcaagctgacatgatttagtgtggtgatactaagggaagggctcataaaaaagaaaaaaaaaacacttgtagtcttgggtagagaaaattactggctgtcaaaacaccacatgaggggcttgggtttatcttcacctccaccagagtgaactagtctgttaggaaagggcttcaatcaagctgataaaacagtgcttgcaagacaaaatattcatttatcaatttacaacattactatcacacaaatcagaatttaagaaaaattgtaactggagatattttttttttccctgtaggcagactcagtgaaagacacattataattgaaaagtttatactgaattagagtatggtgagtgaaaaactaatttaaaaaatcagtagtaattagagctaatttaataaaacacctactaggaccaaagagttctgtgtcttcctgagagtatatttcagtggaagagaagagacaagcaattaaaaaaatctgtctatccatctatctagaaaaaaatctatatagagagagaaaaaatgtatataatatagagaaaaaatatatatataactatatatagtttttatagtttatagttacatagttatatatttcagtggaagagacaagagacagccaataaaaaagaactatttgtatatataaaaaattttatataactatatatagttttatagtttatatgtagtttataactacatataaactataaaattatatatagttatataatttatatataaacatattataaactaatatatataaactattatatacaatatatataaactatatattgtatataatatagcttatatataaacagtataagctatatagttaaactagttaaactagtttatagttaagctaaactatatagtttatatataactatatataattacatatataactatatataaactatgtaactatagtttttgtatatagtttatacatatataaaatatatagtttatttacatatagttcatatatggttatatatcatcatatgtatgtatccgtacatgtatgcatgcatgtgtgtgctcatatatatatacattttcaggtagtgataaataccataaagtaaaaagggtagcatggaatcaggcagtgatttgtgttggggacttctatgtcaagtagggtggtcagtgcagtcttctctggagtcctctctagcgacattagcagagtcctcctaatttgagcagaggccagatgaaacagaagagaaaaccctgtgaacatctgaaggaagagaattccaggccatggctcaaagtggtgggaataagctttagggattcaaggaacaaggaaaaaaacaatgtggctggaaagaatcagatttagggaaagtatgatgggaaacaagattgaggtatatatcggaccttgtagggccatggcgaggactatggattttactctaaggagtcagaggagtgacataattttcatttttcaagctctctcttactacccagaagggtatggatggaggaaatggagggcaggcaggctatcacagtggtccctctgagagatgatggtgctgcaggctaaagtagacatgttgaaatttagatgcacccaacttgctaatgaattggtcattgatgttagtgttttaccacttatctatgataatatgcttggggatgaaatgcttctttgtagttctttggttttctcacattatttgccagtttttgtttttgtttatttatttttgagacagagtctcactatgtcactcaaactggagtgcagaggtgtgctcactgctaactgcatccttgatctcctgggctcaagggattctcccacctcagcctcccaagtagctggcaccacaggtacatgccaccacgcttggctaatttttgtattttttatagaaacagggttttgatatgttgcctaggctggtctcaaactcctgggctcaagggctccacccccctcagcctcccaaagtgctgggattacaggtgtgaggcaccgcaccagcctagctttgaatttcacttggagttagcttttcttgttttctcccttcatcttaatttatagcagtgattaaagctgtttcctggctccacaatccaaattatataccacaagccataagcttgccaggctgcaaagagtctctggtccttcttcacaggccagagaaaatatttaatcttcttcctctcctttaatgagacacacctgctctgtaatcaccttctcagcagtaaattgggcttctttgtttatagattttgttccagcacatgtcatatgtagaaggacccttctcccattccctcgcatattaataccctgaaatatgttagggttaagtcttgctctattctcagagctggtgactccgtgggtgactggtaatctctacttcaatccaatataattgattttctggttacagttttaaagggtaatttaattccccttacttgcaagttcaagaatttaatttgtggttcatctgtccatcttaaagataattatagctaatcagcattttcggtgtgcatatcgactatcctttgtatctggatatggggcaaatgaatgaggtaaacgtgattctgaaaagtaagtacagttttcagcatgactttattcttctaataagaatgttttaaatacagagactgatggtaataataataatgtttaaacaagtttagagattaaacatacaacaggaggactatagttaataaaattgtatggtatttgagatttttgttaaatatagtagatttgtcacaaaaaagtaactatgtcagattatagatttgttcatttgctttattacagtaacctttttactacctctgtgtttcctgtaacatcatgttgtaaacctcaaatatacacaataaaatttatcttaaaaatgaataaattacatggaaacactgtttttataatataggacaagactgaaagactgttagtgttactcattctaagatagatgatgttatttttccagcattaagtagttttgttaaaaatgtaccttcttcttggtaaacaaatttggtagaaccctattgtggaatatttcaaataacaaagttattttaaaatataaatatgaaatgttagaaatttcaataacatggaaatatattaatttgagatactgtgcttaacactttacctgcaaataaaatgtgtggatatttggatatataatttggatttaaattatattctccatcttactaactgggtctatgttggtaatatttattagcattaagttttttgagattaacattttttaaaaatttgagatggatctctctctctgtcacccagactggagtacagtggtgtggtgcaatcttggctcactgcaacctacgcctcccaggctcaggtgatcctcctgcctcagcctccagagtagctgagactacaggcacatgccaccacaccaggctattttttgtattttttgtagagacgcagtctccctatgtgcccaggctggtcttgaactcctgggttcaaaagatccacccgccttggcctcccaaaatgctgggattacaggtgtgagccaccacgcctcacctgcagattagcattgttggtaatctctcagaagtggctgttgcaatgagaccacgtgaaagaatccagtgtatttactccattgcttcttcaccctctctgctaaaagccggtcataaagtgtgttcacatctcagagtgaaactgtgaggaaagattaatgctttactttctgagaaaaatcagtaaaaataaatagaaagcacttttaaaaaatgtgatccagttgggcagcagttatatatgacaattgaaataggaataaggaaatgataaatggagtttcagagatgcagctagcattagcctacatcacccgagcaatacagatcagaaggcttttgagcaatccctgacgtttcaaatattagaacaattaacttcaactaatctaaactgtaggatgtcatgcaaagtaaaggaagaataaaataatgcacaaaacccttgtatgactaagtgataagaattaacatcagcgtaatgtgatagattagacacaatgagcagcaacgcaatgaacatctcctcctctcctccagataattccagccatcacatcacattgctttttataataaaatggattcgccttctctttgtagcctgtctttctccatttttgttcttagttgtgacattgggtctttactatccttttcatgttctttcactttgtcctttgtgtgtgtgtgtgtgatttatgcctatcttaaagagtcctattcagaactgcctcttattgtcttctaaaaaatgttttaggacctaatgctaatcagtgtattgaacacgtgcccttgacttgctaacactgaggacttagcatccagtcactgctgttatcgtagactcacaaacattgtccagccacagaaatgatggagagaaaagaatcaatcatttttaaagctgaaatgtgacagtggtcattttctattttggtttgtaaactcagcattttcgtagaagcttcttaaattagccttgaattgatttttattcaaccagctccgcaatttttgtttccagtctcaattcttttactgacaggttttcaaacggggctaaatttatttcagtactttgtgactctcacctggaggagaagtaaggacccctgacatagtcagaagtaacttgctttgcatttgaattgcatggaatctataaatatttatcgactttttagagtgaacaatttctaaaaaccacatgcaaaggttgatgttgaactctaaacatattgaagctctgagactgtagtgatgaatctcagctgtgtgtgtgtgtgtgtgtgtgtgtgtgtaaacatgtgtgtatttctgtgatttcacctgggagtgaaatttctaggtcacggcatatgcataggctaagcacaggaaatagtgccatatctctattcaccattggatagcttcctttataaagtggctgttcagatctgttgcccgttttctatgagattgtcttattttttttaaaaaaaacttcataagaattctttatatattttaggtgagtccttttcatataaatttattataagatcttcgacctctctgtgagttgattgtgctttcatattgttaatagtgtctttgaatggacacaagttattaattataatatattccagatttttatttttttaatttcggttttttatatgctaaaatgtagttatgggaagagaatatcaagcagccttaggtttgaattcagtacaatagaggtcgcatttctctttaatataatcaaattgtttatcttaattacgcacttctcccatccttgaggcatctttttcatgattagcctaagacgccccgagtgtacttttctatatccagtaggtaaatcttagcgatcattgactgaggtcagaattcagatgggatgtctggggacaagagaatgtgattattcatcagtgaacaacagctgatttctctaaaataggccttagcatggtcaaactagagactcgctctggcttcagtgtgtgcgaagtctaaatagactcgttctttctgctgctactacgactggggcacgttttcacccctgactttggttcagggaaaagtgactgaattttcttcccatgacactgtcacttgcaacagctgcctctttgaaccacgatagttctttgaacacaaggaagaatagtcctgttcctcccctcctttccaggactttgcttaatgaagaacattgcgtgacaaacttagagctgggcctccagattccctaccttctatgttaaccaacagcactatttctgcaaggcagagttttccaccaggaagcgaacagggttgacggtccaatgcttgacatatagaagacaactttttcccttcaatctcctgacttggtcctgggcccagcctgcatgccctgtcactattctgccccaagttaatttgtggttgaggctttgcctgtttttctttgccatagtgtcaaagtcaggcagtgtccttgtactgtgccaggcaaatctctatagctttgaattttaaagagaaggttgaggatcttgatttctttatttctgtaaggcccctgggtgagtgggtgagttatgcagttgttcccaattaattctcaataatattcaagcacagcacatgaataatttgccattaaaaatttaaagtgtaatctcaaaggtctttctgccacaaaaatagtggaaaattggcataggaaagaaccagcttctactccatgacaataacgtctgtcgcttatagtaatttcctgagaataataaacatgaggaaagggtttggtgctgggtctctactcagcacccagagaaattattcagatgcaggccctcaataccattgcataagtggacaggttcagttaaactcaataaacacggaaaggttgggcatttgtttcacaggatactcagtgtttgtgaagtcccgaaattcattatatctgatataacatggcaggtaaattgatagaaaattaattggaagacagttccaaacgtaatagctcagtggaaacatccagaatcaattaaccaaactgcaactcattttaattggacacactctaaccctgaaaaggcactggaatctttaattaagctttcaagcccagtcctatttacattagccacgtttttcaaatagttacatctgaaaataaagttactgacttgaaacctaacagtaaaggaaaaattctaaatacatgtatgacacaacggtttgtgtctaattagacattatgttttctggtcatttagagtgtggcttaaaactatttggttaggtaaataacgaaagtacagaattaagatgtcatgtttttaaagttgtgtactgattttcttctcactcttacaaatattatctaagcatatatttcacatgtatatacatttattttcttctgctactcaccccacactctgaccttcttctttactgtgtatttatttttattatcttgtagtaatcttgtgtttccccatctaaatttattactagagctttttgtcagcaagattgatttcatatagtttcataccttcagtgcccagaaagagctgctaaataaagcttggagagctgaagtgttgttcaatccaaagatgagctgatgcatacaagaaaacggataagtcttcttttaccagatagtggtgtgaagtgcaaagaaacttccttggaatggaaggctatctgtgggtctgaatcctgcctctgcctctaacgaaatgtgtttattctagtatttcctcagatggacctgtggaccaatctttgaaattctctatgcccctagtttcccatcatccaaaacaaactaaacaaacacaaaaaaatcagaacagctggaaatggactttagtcagttgttggaccccaagttatttagttacgttgttactggcagaatgagataagcctgtgagttagggagactgtgcatgtttcagagcagcaaatgtataacaatgtgatttaatgttactgtatactgtagactgtataccatgatttaatgtgggataatacaaagtaaattaaatacaccaagagcacacctttaattcagagttcacagaatgtggcccccctgcaaaaagttcctgtgccaaagtgaaaaccaagatgtgagctggaccttacccagggaagaaatatccaacaaggacgccaaaagaatcctggccaaagactttgagccctgggagctcactgagttgagtcaacagagtggaagaatagggaggtgtgaagataaagaagtagcagctctggtaaggaagaaaaagaaaaatcctgaggataagggcagaagagagacttcaagaacggcaggtcctcaaaaaactacaaatagaactacaatgtgatccagcaatctcaataatgggcatttatccaaagaaaagaaaatcagtgtattgaaaagacagctgcacccctaagtttattgcaacactattgacaatagccaagatgtggaatcaacccagttgtccaataacaaatgaatcgataaaaaaaaagtggtgtatatatgtaatggaatacaattcaggcataaaaaagaataaaatcctgtcactcacagcaacatggatggaactgaagggcattatgtttagtgaaataaaccaggaacagaaagttaaacacagcatggtatcactcatataaggaagctaaggaaagggtgatctcataagtaaaaagtagaacagaggatactagaagatggggagggtacagggaaggggcacagagatttgttaaaggatatactattacagctagacaggaggaaaaagttctagtgttgtatgccactgtagaatgactatagtttacaataatatgtagtttcaaataactaggaagatattgaatgttcccaacactaaaaaatgataaatgtttgaggtgatggtgatgctaactactctgatctgatcactaatatcatgtatatcacaacattatgtaccccataaatatgaacaattattatgtgtctattaatttttacaacagaacaacaaaaaggaataaacaactcaattgggcacccatattaaaaatcttaaaaaaaaaatggcagaagtaaatgtaaatgtaggaggaattaaacaagaagatttccaggcattccaaaactctgtgatgaaattaactccatgcctaccatgcccacttgtgacaatggcaatatgttgacactctctagatttataaatagatttataaatagaacagccaacacccttaagaccttggcatccttcactgaggagaaaccaagtatgtaaatggaaacattttgaatagacatttaaatacagcaatttggatatagttatagctatgaatctgaattctgaatagtgttagtgtccgtaagtccagaattctcaggaattcttagaggttccttttcatagtctttcattatttgcaaagagataattagtttattagaaatgttcattaaattcgggcctcattctcagtctcagagacccaagcatctctgtggggcaaaaggggtccccctttacccttgaagcactatgcccatttctcccatttctatgtatattgtggtttaacaaatgaatggatggatttcatagttataacacagaaattatttgtctaccactgttctttgtgctggatatacagtagcaattgaagtagcccttgttgaatgaaggctaggttaaggagctacctaaatgatttggaagaaacgaagtgaacatgttttaggaaaagagaatttatatgtaaagagtacatacaaggtcctggtgatgagacaccatcatttatccaaagatggagcttctttttagaggcctcataaccatctaattgcctctcaatagaattgccaggttatttaggttagggtactcttttcccgcttcaagttctgagcattaacttaagagtattcctggacacaaatttatgtatgaatctacccagggcttacacttctatcagggtagtgcttatacaatgatggtctagtgatcatctgaattagaatctcctgcaagctttgttaactgttgagattcacaaccctatttttggaccacagaaccagtatttcttggagcaagctaccgagtctatttattagaagctctccgtgtgattatgtgttacccatatttcttaaagtttgagaaactctaccttagaataatagggtctgattccaacccaacattgtagacctcttcaaggatgacttgataggtacatatggttatgtattcaataaacgttaccgttacatcacttatttctgtatcgatccccttttgcaattttgttaagaatctttccaagcataaaacactgaacactagactaatctttagaaaaacaatcactgggaaatatgtcagccaaaaacaaataatctgacattcaattaccatcttttcaatgaatggataacaaccaaaggaccatatcaatgcaccatcagaagatctcaaggactccttcataattctcacaaagttaaaactgtaccagaatcaagatcaggtttaaatatgaaggacaaaccacacttacccagcaatatatacttattcaaattcccagaaagtagtttctacattaaaataacgatacatgtcactgttattttcaatgagagtagtgtatgacctctattttattcctcaatttaaagatcaataaatattttttagaaaaaaaatgtaacatattcaacttttaaaaaaattgaattaaagttgtatctttcttggagtctatatttgaccatgaattgtgtttccaaaattatatttgctcatccattttttttgccgttctctgtaaggcctcagttttgtttggtctttaaaccctgaataaaacacctaggaacatgtttccatttgcagtatttcccttttaggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatggtaagtgtggcatggaagactgtaagaggaaaatttattcaatgtggattaaatgtctggcagttcttttctatgcagctatttgaaacaaaaaaaattcaatttctgaattgctttggcaaagtatctgttgaatgtaaagaatgagtacaagatcctggtgatgagacagcatcatatattcaaagatggagcgcatcatatttcattacttaaatatttgactcatttatgaaaaactagtgtttgttgatggtaaatccattaatagtcacctttatgtattataaagtgttagttgctcaatctgcttttttctacctagtgttgatgctcttaaataatatggctgtcagcaacctgccccatggggcaattctttattttaaaatcatttaaagcattacttttttttttatttgagactgagtcttactctgtcactctgtcacccaggctggagtgcagtggcgcaatctcggctcactgcaacctccacctcccaggttcaagcgattctcctgcctccgcctcccgagtagctgggcttacaggagcccaccactatgcccagctaattgttgtatttttagtagagatagtgtttcaccatgttgcccaggctggtctcaagttcccgacctcaagtaatccacccacctgagcctcccaaagtgctgggattacagacgtgagtccccatgcccggccctgttactattgtatttgttgaagatattcaacaatgcaaggatatttaagatgcattgttttttatttgagtttttcagacatagtttttccagaaatataaacaatataccattaaatatcgatgcattacaaaaatagacacatttatacattaatcatacattttattgtatgatatgttgaatatctgctggtgaaataaaatagtagaatacttttcagcttctctcattatctgatatgcctcatggaagaagaaaagaacagttgtaggattaagtgttctggacagacttccatgaatatacaaacatttattactctttcatagttcctcatagaagactgacatccaatttaaattcatttactttatttaaagtgtctcttggctattgaaccttttcctgaaggaggctaacaaaacttggctccagattaaaacaactcctgacttacaaagaaagcatgggatgagttaataaaaagatggccaaatgctcttttcaagtcatctgcttttctcaggaataatctataatttacaaatcaacttgtgatcataatcatatactgctggtaccattctaggacacttttcatgtttaaagtgatcattaagaccacttcattaaaataacatgtctttgttttctggatataaataatttccagttcatcttgctaagtgcaaccgtaaatgttactctgtatgcacatattatattgaatataaaatgcgtgttatagataataaaataatgaaacaattaaaaactctaagatgtcaagggagcctaaacattactgtatgatccagtaagtatcatctacaacttgtattcaataaccagtcctttttcagtaatggagagaagcagattcagggatttaaaactagttatttcttctgccatcttcttcattttcatacatatgtatttggtgtgtgtgtgtgagagagagagagaggaagacagagagaatttgggatattaatctcataccaggaaaatactacacttttgtaaaatgatttaaaagaggttggttagttctgtttgttgatcctgtttccctgtatcatgttaatactagacttagctttctttttatagtacacaataactatgagaaaatgtttagacataaaggaaaatttctgcctcttgatcctgggaaagaagagagtctctcaaacatccttccttcctaactattttgtagataggaggccctagacttcctttaagatacacttcatttaagattgtactatctgcaatataacagatgggagttaaaatttaaataaaaaagtagatgatcaaggagatagaagacaagcctggtttgtgtttgaactcagataagaaagcatttaactttcaactgtaaaattatactagtgcattaattatatgtcattttaacagaaagccatttcaaagatcattttgaaagctctattaacttactttattatttgattctattttggggttggttcttctatctatgcaattcattaaagaaactaaaatataattattgtaactaaaacaaaatccttgtacttaaaatttttaacaaaaatatatatatatattatttcagagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgagttctttttagatgagagagagaaaattaaattagaacactagctctgtaataatatggatcattctcgtgttctggcttctcaagctacaaacagaaaaatggagtgtgcctgttttttgtagtcatatttttagtactatcctataagtataatctaaaaggattatttaaaatgattaagatgcccttatctctttatgattttgataattttacatattcaatgtataattttatttatataaaacatttattatattattgttagaagctccttgactattccatatggctatcaatatttgtttcatagttcattttgaaataaggtgtcttgttgtatgtaactatttcctgcaaatcaaagtaaagaaacattaagggagtgttaataaaccagcattttgagtaagaatatgtccacaagatgaccttttagttgtacttttagttaaaaaaatcatcatgggaaaaaaatgttatatccatgcagtgttaagggaatgtagattaggaaatgtgtttcctacagaaaaccatttactgctatttttctctttcccacatctagattaaaggtaaaaattttggaaataacttctctggataagaaaagcaaacatacaaacatgtgactatatcatttcaactgattcaaatatatcccaagggtactgtactgaacaccaaaataaaaataagattgttcgataagtgtatttattcttactgtgcattttgagcttgaagcttatttatatattagggcattttctttgtcaaattgaaagatatcctgtgaaataaattaactgacatctctgcaggcaattaaatgagtagtactaattgtgatggtaaatttggcttaaaatcattcatcttaccattatttcatttcaaagtctatgaccatgactacttggacatatttcttctctttagtaaaactacatttgtgtttaataatttcattaattgttgtatttccagagtgtgagatatattttttaaatataggaacagaatattattgcaatattaagcaataggttggcatttcagaaatacttaatattattttttaagtgagaggcaagtgcagagatttgcatatgcttaatctgagttgatgttaaattaaaagatttgcaggaaagagagtgcttgtgtgcaacatacttggtcatgattttgcaaatacattattgcaatttcacttggaaactgactcttggggattataaaaaggtatcttccaatttttccctcgaaatgaataaatagcaacaaaaaatcactctgatttttaagtaagccgctctcaaagtacgatttttactaaaagaatcacaatttttccccactctaggaagtttgcagatcaggtacaagttaaataaatatcaagagcctgatgttgttaactttgattttaaaaacatggctgatggacaacttcaccacataatgattaacagagaagaaggagtggtctttatagaggtaatgtagtaaattcagcagaagcaatcattttaatgactctccagcatgaaggatctcaagcagaaatttgataatgaacacaataagcagagacactttcattggtcttcttctgcagataatagacctcaaatgtagtcaggattcttttaagcaataagattttgttcattatattattaacatcggatactttaaatgccaatcttttctaacttgtttctgctcagaaggaaaatgatgtcatagtgtgctactggtaggaccattgctatgctaatgaaaccggtttactttagataaatgcagtaataaatctatcagaaaataatgattgtaatatcagaatttttgttaatgatatgagtcacagcaaagaaaatggaattattcatggagccagtttttgaagaaaagcactaataattttttggttctctgcctagaagaaaatttcttagctgcctacctcaaataaaaataccaagtaaaagtgttaaggtgaaaaataaccttttgtatctttttgttggcttcatcaattttggattccttatccagtggagaaaaataaaatgatacaaggggatagaaggtagggtgcactggcatctgagggtagtatagaaataatactaatattgtattatatattaataattatataataacacttagaaaaacctttctaagtggctaagcttttaaattttgtttttttctaaatgtttggggccatgctaacaactgcttaatgtatctttttctcttgtcctctgttgcttcctgtcttctcaacaaaacgtcatccatttggatgtttttatcttgtgtaataattttgtagattgacgataatagaaggagacaagttcacctgtcatcaggcacagaattcagtgcagtcaaatctctggtattgggcaggattttaggtaagtgaaagaaacaacctttcccctaaccatgctaatcatgatacataagcatggatcagaaaagtcatattacacacacccacttcgtcatggcaaaggaaatcccttgcctattttgattatgaagtgagtgataatcaagacagaggcatatgcaggcatgagtaggggcgtcctgtgtgatgagcaagcatcttcctttgatggtaaggtcactctggtctcagtcctgtctcaataaagtataatgaaatatggtattattctcacatttcaaaaatattaaataattgaaaataaaaaataacaaagtatgtattaattaggtgccaaatatacaaactttcctctaatgataaaactaagattagatttaaaaaatggaagaagaatgcaattactttttcttctagttagttaatatgtttcaggttatgacttggattctatttgctttgttgcaatgttgcccttggcagccacgcttgctcagatgcaatctaaatgccttataatgcttatttatttccatcaattacctttaattacagcactggagtagaaatgcactgttgccattttaacatcagaatatgtttgcatttttttacacttgccaacaaggattaaattgaaaagtaaattttaatagatatttattttttagttatacattaatcattaagagtattggaatttcaccttatttgaggagaggggggctcttgtagcctaatttttattcctactctggtatttgacactaatctgaaatattttgtccaagatagtaaatggaattttattttttgacctttgcagttatttgtacctcaattaatcattccttatgttgcctgtagctaatctcagaaccttgagaatgtttgattaaacccataggtgaatgatcaaaatattggcccctgaggttaatagttcagcaaataaatatttacaggctttcaagtgctatgatgagcaccaagattatgtgttcttattctccaaacaaacaggggaaataccatgaattgcaatgttcttccattatctatagtggacagaaaaaaatatgtgcaaagtacttcttagatgtttggaagcttaactgaaaaattccaagggagtctcacagtgttattatataaatccagctatttaagactgacatgtgtatcatttgctctaagaatatgtatatagccaataacatatttagcatgaaatgacgattctactttattccgttgattcaagtcttgtcctctgatgtataattaacagataagaccgtgtgcactcttaagtctgtgcacatgggtattagctttagacaaaacttcagatgcatagaaaaacatggctaggctctccctttgttaaaaacaaaagagaatatattcagttatttcatatttagtattgggaaatatttatagctatttcaggccactgtggaggtaagaacattagtgtctaggagactattcagctctgggtatgtaactatctagctctgcctatttagctttggatatgtgactaaggtatttctgaacattattttttaataacattagagggtcttattccatgtatagctatggcatagcgtaggaagccaaagagaattgtaaaagtctaaacaaacaagcagcaacaaaaacaaagcctcaactgttttaactgtgggacccatctacttccctacagatggctctcagctttgggggaggtaagcgtgcaggtggctgggaaagggatgagagccccagagagacccaggatgaggcaaagatgtagggatcatagggtggagccccaacctctgcaatgaggcaatctgtctaaaaacctctttgctgaacatcaggctcacagaagactcagctccttattctgtcctcacttaagcctacctgccacataactattgttatttacagaattaaaaatatgtgcaactgtgatttggaagagtcctcgtcccccaaactctacactagtacagtagataccattaatgagtggaattataagctgatactatgtcaagatgtcaagaagaaattttaagtaggttttctgtgcaagatattataccactgtgagtagaaatatattcaacatattataaaacaattgggaagctgattttcatcctataaggaggattgtattaaccaaacagtagaataacattcactatataagtcctcatttccctttttgtaaatgaataagggagattcctatagaattaaagacgttaaggtttttactcaagagttgcatattatccaaatatgcatatcatatatgctgaaaagtgaaagtccaaactgagcaatgaactttatggtctcagtcaactgactctcctaaaagtataagtgataatttatttggcatatgtctaaggtatggatcttgattagggactaatcatttgtaattcaaaggaaacccataacttgtggtcaaattttgtgtggtatatgaatttatagcaacatgttacatagtatatccttatattttaatgcagtatatttatagtgaaatagatcaacaagagttattaatatttcaaagagaattgttctgtcttgaagtcacttactgtgttagtccaggtcctccaaacaacagctgtgaagacaggattaagcatatgaggattttattaagggaacaatcatgtaagagaaaatgtgaaggagctggctaaggcagacaggaccgttagatgtccatgacactctgtctacagggatggagaaagagagggaaaattagacagaagcacagaagtgtctcagaccaatgtgcagtctaagaaagatttagcaatgttcagggagccattgagttaaagtcagcctccagaggagtcccttgtttgccagggatgagcctgtcttggaatgcctgctgtgacctgccactggctgggggcagtccttgggaatcatggccttggtacaagcatgaggatggatttcagagcccagcagtggggacccttggtcaattaatctccctgtagttcgtggtctttgaggcacattctcacgtttccgcacttatcaaatatgttttgcatttttgtaagcccaggtgactccttgattcatatattaaatacataccttgtgatcacctaccatgtaaacagagaacgccactcaacaaggtagacgttacatctgcccttacagagcttatggcagtggggatttcgataatcgtgataacaaaatgtgcctttgtatcgacatgagtgtaatgtgccccaatattgctttagataaagtagtcccaaattaccctccaaattaaaatatattaaaattcttctgtttttataatgtctggatatttcttctaagggagtagcatataaacattgccttttttttttttggagttgtaatttgcctacaattacaacaaacgacttaagtatataactgtcccatgctttttcaggtggaaaaagagatataaaggaaatatctcccctctcttgaatttttccagtactcatttcttaaatgtagaaaacattctaggggtaattttgaattgctgaccctgttaaaaaatattactagcagatattgagaaaggtgggtgaattttaagaaacagtatcaaactgtactctgatgacatggtaaccatttctaactacctgttacaattaaaatatagaagtacttaataactttggcaataataatatattgaaagtttagagctatagtgggaagataaaggttttagttaaacagctgagttcagatcctctcataatcagcagactacattgcatttgctttttatatttaattttactataaaattaagctcttgagttctattcctggacacttttatatgttagattagttttatgatttatttaggtaaaaactgagagattgttttcactctttctcagcatatagcttttctatattagatacggtggtccataataatcatttctcttttttggggctgcagagccaagatgtactttcaaattactgcagtggagatttaggccagatgtaaataaagtgtgtaggcagcaaggaaaaggaagtctactcagtctcctctgatgagctataagagaaatctccaatgtatcagaaattctttatgtaaaacttgcttcagtgctcagaggtgagacaaaaggtgacctaggtaaattaagggaactgtgattttataaatatatcatgaaataattttcaaaataatggattggttattttaaaagcatgttttaaaaggaaagtgcaagttagagcaagaaaagtaaaatcaaaatctatcttacaatcttttaaaaaaatgtatcaggtccattgatttttaatttttttaataattaaaatgtcatagactgtcttcagtgcgtagcatgactttcttcttgtgaaggctttagtcgattccagagggttagccatactgtattgagctggccatacctagaagcttattctcgtaatcataatacatgaaagtagatcagaggtgtcatgttccaaatccaaaaagtattcatgacgttgaaagaatcacattacctgattttaatagtagaacaaatgataacttggaagttgagattttgtcataagcacgtatagtcataggcaggtggtccccgtggagtgggcaagtgtattcctctgacaatgatgtcacctgcaaagctttttatttggcagccaagcataataacacatagagctctacttacactaaaaaaaaataccaaatgataaaagcaagagtcaccaatccaaaattatatattttcaggtgcctcaaatctacaaaccttcatacaatgataaaacaagaatttcaaaaataaaaaggagaaagggattgtttatttctttaattactaacatgccttaaaaggtacccagccaggcacagtggctcacgcctgtaatcctagcactttgggaggccgaggtggatggatcacgacgtcaggagattgagatcatcctggctaacacggtgaagccccatctctactaaaatacaaaaattagccgggcgtggtagcatgcgcccgtagtctcagctactcaggaggctgaggcagtggagtcgcttgaacccgagaggcggaggttgcggtgagctgagattgtgccattgcactccagcctggtgacacagcaagactccatttcaaaaaaaaaaagaaaaactaaaaagtgcccacaccaggaataagtaaaaaataaagccccgattaggcactgatgataatatgtgagtgaatttattaaagaatagtcatccatgtaaggaagagaaaggaagggattggctggggtgtgaacatggaacctgtgaagtggagagagggcactatgcagccacaacaaggagatactgcaagatcagtatgatcgggggttcctaaaccacgggccacggacaagtactgtgctgcacagcagtaggtgagtggcaggcaggcaagcaagcgaagcttcatctgtatttacagctgctccccattgcttgcattaccacctgagctctgcctcctgtcagatcagccacagcattagattctcacaggagtgagaaccctattgtgaactgcacatgtgaaggatctgggttgtgtgctcattatgagaatctaatgcctgatgacctgtcaccaactcccatcacccccagatgggaccgtctagttacaggaagagaagctcagggctctcactgattctacattatggccaattgtataattatttcattatgtattacaatgcataatagaaagtgcacaataaatgtaatgcacttgaatcatcccaaagccatccccccactcccatctgtagaaaacctgtcttccttgaaactggtccctggtgccaaaaaggttggggaccactgaggctgatgatattccaaaggactaatcagaatcagagcagagaaatttgaatgctaccagcattgtctgttaaatgtaatggggtgttagagatgattctcatgccatcatagtacaatttaatattattacataaaaattatcccccttgcttgatatctgcttctaatgcttgctaatggtgattggagtgaaaaattgtcactatagttcatcctcatttgtagaaattagtactagaggatggggaagaaagcatttcatttctttctggtcttccctgtgaaaaggcagatagtctgatgtcatgtctaagtactttgttcacaatgtacataaattccaatgccgaagtgactgacttgtcaatcagcttccttaagataaatatttactagaaaattatagaaaaagaaatctctctaggatgtaattaattaaaggaaatatacagatacaaagttgttttgccaattcattaagctattactggatcacaattccaccacatggggaaaaagagagatcgcaattaagatatttacataatcttattaaagttgtataaaacctctcatgggaaaatatgcccacattttgaataatgatgtaatttaacacacagtaaaaatgactgaaaaaaatcactactcaaaagttgaatgaaatttataattactatttgttattttttgtgtcaaatacataatggcacaagaacactaacaataatgtgttgataattcatggtggtagcagtaaaaaccaggttgcatcaaattaacttggttgacattcatccatcattaatagggtgtgctacatttgctttttatctccaaaactcattgtaaatttcagttctgagttctgttcatttttatgttataggagttttctataagcctggagattattttcactcgttccgagtagtagctttggtgtatttagaggcgatgacccatagggatcatttatctctttggagtccgcagagctcaggaagcacacctcaggtttctgcagtggcaatttaggccagatgtaaataaaatgtgtggtctgagagaagaggatgtctactgaatctccccagaagagctttagagacaatcttccatctcaaggatattttaagtaaaaccagcttcgaagccaaaggggtaaaaaagaaagtttaattagcttacctaagtacactgtgatttttgcaaacatcttgtaaaatgacacttaaaatgagacaggttatgctgaaagcaaaagggaaatacctgccactgtaagatagctgcctgtacataacctgtgcattaatcaggctttcaagtttataactcagtacagtaggtttggttggcaaacaaataccttttatgataaactgcctctttatccacatagtatttttttgtctgctttgccattttactttcccactaaccctttttgtgttgagtccctggtggaattgcataaaatagtaagagtgcaccattcagttccaaccctggctctcttgattcactgcaccttttttttttttttttttttttttggcaagccttcttaatggattccagacattgagatctttctttttaaatgactccttctcataggtaggacatataaagtacttcgttttctgagtttttatttttttgcttacgcctcaggaaatttcataaagcactccttgtaattgttcttacatgtattgtcgtatctttcaaaaaaacagtcgtttctctgtaatagaagggcacttcaccaaattctaatttctcggtactccatttttcttgcaggccttttgttaaaaggtttcttctttcgacaagcagaagtcactccctttgttggaaattgcacttgagggttactttttaacaggcacaaacacccagaaatccgagtcagttaaggattattatcacaagaaacacctaaaacatgactgttttatccagatttctgtgaagcaggagacatttgtcatcagtctctccctccacctaccctgttctaactcattacactgtgttggcttttggggagtcagataacaagaaaaacttatatttttgcccattggcttattagcacaattgtcaaagcagatatctgatgctatgtatttctaaggccagctttgcttatgagcaacttaatatagctgctaattttgtttggactcaattctgggaggacggcggctgagttgcttgtagtttccctccacttccgattcgaattctaccccaccgacgcttctgaaatgagttgttggtccaggcggacaggcagggggatcctggagggaaccagtgaggaggctcttgtggggcttcctaccttctgggttggaaggaagtccgggggccagcctagaagaatctcagggggggatttgaattgtttggatcttgtggattgcttgccttacagaggtccctgggccccatggggaaagataagcattagaaagtattaatgtgcccattttctctgtttctcaaggtgctaagatgacctgaaatttgggccatgccctctctgtcccaaagctgagtgaggagaggtttcttcttagggctgtggcctgcagctctgctcctggtccacccagatcaccacactgtctacttgccctgggtgtgagccacctaaggtgatcagtggctgggcaccggcaagcagattaaaaagtaaactaacaaaccaactccagacttaaaaccattcaacatcaataaaaggagaaaaaaactaaaccaaaatgattttctatcaaaataaagctattcaaggagacagacaacaacatgaatgaggcttagtaagagtactttaaggagattctcataaagcaaaaaaaagaccttgaggatctaaaaaatatgattttttttcccaaacaaaaaatataacaggaaagaatgatcttttttgctacttgaatttgcatctggaagatcaagtgaatgaagtatttgacccacagagatgtaagtcctaaataatagaaatcaggatggaaataaaatgaatttagagaatatatagaggagacctaatgtgaaaaattggcattctaagagaataaaaaggaagaaggtgaaacagcagtagtgtgcagattgtatgaaaaattccaagctaaataaaaactttgtgtctgcagattgaaagggcttatcatgttctatgcagaatactgagataagatacacacttagggacaatctgatgaaaattcaaaaatcacagggtatcttacaaattttgaaaaagaagtaatacagccagaagatgctggaataatatccatagtgtactaagggaatagggctgcaaaaaatgtcacccttaaaataaacacataaatataacctaatccatcagggtaattttctgttccagttacaaccatcatattgtctaatttgttttcttcatagtattatcagtctttaaaattctcatttagtttttgtttctatgtttattgtctctctccctttccctgctaacatgtaaaatactcaaacatccgggcatttgttttctgtttctttagctcataaaaggataaatattaactgaccatgtgtccattttgagttttagcggtcattggtttttgtacaataattttgaaataggtgaaatgttttcagtttgtaagtgtgaggcttttaaaatatatctcatatcagattattaccagagaagtaaatcttgtctggtggggtggggctgaaaagggaagattttttaaaggcctatggaaattttattcaacattttaaccttgtagaagaaatgtgaaaagcactctcccaattatgctcctatgagagtttttctttttaatttttattttctttttaatttctcattaaagtaaaaagaaaaaaaaaactccaaatcaagaatgcggtctttttcatgtatatatgtttaaatctacatatattcaaatgaatgattgccaaggtggactaaatgatttctttggttccatacacattgatgaactgcctcctatataatgacgttatgctggatgttggcagtcatctttatgtttgaggagctcacagtatcgtatgtaagcagcagagtgatgctccctcagtgctatctttgggtaatgaagaagagcaaggtgggtcagaacatggctcaataccagatccctcacaacaggaaagtgatataatcgctctgattttccattttctttttatagaggatgatattcaaaatactaaacattgtatcaggatttttattattacgtagaaaacatgaatgaaaatagagcccctcaaaattctttaaaaacttagatataactggccaggtgcggtggttcatgcctataatctcagcaacgttgggaggccaaagtgggtggatcacttgaggccaggagttcaagaccagcctggccaacatggcaaaactccatctctactaaaaatacaaaaaatttagccaggcgtcaatcccagctactcgggaggctgaggcaggagaattacttgagcctgggaggcaaaagctgcagggagctgagatcgtgccacatcactccagcctgggtgacagagtgagagtctgttaaaaaaaaaatatatatatatatatattagagctcagatgcccagggttagttaaagtctagctctcaagcaaagatgatttaaaaaataaataaataaaagccactacagagactgaaagcagagtaaaggaaagagtatctcaaccagagagtggtttataaacaaaagaagctcataatttggaatacagtaggccagaggtccagtaatgccaacaactgtgtaacttcaggtgaatagttaaaattctgaacttaactgttccatttgtgtgacttggataatatactccagtgtctactgtaaagttttatcagtagcatgcaaatcttttagaacactggctagcacataatatacactcatatatacttaatatccattgcattgtttttacttttaatttaacttaacttcctgggaacgtagattcaagttgccctgaatatacactcccatattattatattttcaaaagaaagactaaagtgcacattttgtctttccctacctatatacagtgcaggggagaatagttgtattagtccgttctcacactgctataaagagcttcctgagactgggtaatttataaaggaaagaggtgtaatcaacacagttccacatggctgggaggcctcaggaaacttataatcggaaagcaacttataggcagaaagcaaattataggcagaaagcaaaggggaaggagaagcaaaaaccttcttcacatggcagcaggagagagaagaaggatgaacttccaaacacttataaaactatcacatctcatgagaactcactcactatcacaataacagcatgggggaaactgcctccacgatccaatcacctcccacagggtccctcccttgacacgtggggattatggggattacaattcaagatgagatttggatggggacacagagccaaaccatatcaatagttgtgctatttttttttatcacactgggtggatggatgcattgtattttgatgacatctgagccttcaaagcctatgataaatttctcttgtttagatttcatgcttgctaagcaaggagtatgtataatatattcctaagttaaaattataattaatatcccagcattaaaaccaatctccgttccacaagagtctcatactaactaaattcttattaataggaggaagagattatctgtctttagagggcacagatatttctgtcccagtgacaagttgtcattgaaacaagaagaaaagacataggggtataaagggttttattgctgtacatgagtaattagggaaagaccctaataacttcgaggtatggcctccactgcatgatagtatcatcctcctgttatgtttgggtggggccataaaatatcagaaagctttcagccataacaaattgtcgggttgggcatctgataacagaagtccagaggctcaattttctctctagtttctgttactttcagggcataagtcttgaaacctgtactgaacttgttttcaaatccaggatgtacctcttgatattgactacaagccctattgtaaatacattgcaataatctatatttaaattaaaagtatcatgacaccctcatcacttcttaacctgacccattcttatgctttgtttctagggagcttaccatatcacttttaataatccatgcttaaaaacttgacttcattaacattggaaatcttaccaatagtagtggaaagaataatggatttttatctttttagtaaagataaaattaaaaaggaatttagtaactttattgctattgcattagctcagaatcctcaatttctgcatcatcgcctattttcacttttcactactaatatttcggtgtttctttgaatttctagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcaggtgacttagagttcttcctctactcagtcacagacgtagcttgtccatggaatttagaaaacttctcatgtggctttcaggctaccttctcaagatggcttcttaaagttggttttgtttgtttagcttttagttctccttcccatatcttttctaggtgctcaacttcttatttatgggggtcattgccattgacattgcttaaattgaaaataacagagatcccacattcgcctccataattctctgtggtttaaaacatttatgatgttttcaaaatttcttcttttacttgcctatatcaccttccccctttgttgtgctttaactgcagatcattctggaacaatagatgacagagagccccttgctaatgcaatcaaaagtgactctgcagtaattggaggtaataagaagcatgaatgagctcttctttggttgttcttattaataatgatgatgaatatttagcattgtagaaactgtgaagaatctgcacatactccaagtgccaggcactgaatcctgaggtcattggggtgatttactatttgtactggattgtctttagaatctttctgaattctctgcttccttggagattttcagtataaataattgacaatttcactgaagcatggcactcaaagattaattgctaacatgtgtaataatgaatattatcaagcttgaacatagccacaggtagtcactagagaattgtgaatatatttgagtaaatttcgtttttcttcacttcttggacatatcactgcttctggaaaggttcatgcaaaaagtaggaaaaacctgagattaacactagaagcatatattttgtattgcctcaaggcttaataaagatgctatttgcatagtaaactatttaaagatgcttctatcaactaaatattacactttcagttgtatttttatcaaatattagattaatgaactaaaagtgattagtagtaactttaaattgcagaattaacacaaaaacttttaaagtatgtctccctggaaatgtgacagcatattctctgatattttttttcaaaagcaactcaaaaaacaagctttttttcttcttgattaatgctcttaagaatgttattaatcagattattgaaatgttaacttgttcacctttctttacactctgaatatgatacggatatagaaagtaaacaattattctgttgcattgccagggagatacaattttaaagtttttgtgccagtaatatgattattcatatatgaaatatgaatatttcgtttgcaggtgacttagagttcttcctctattcagtcacaaacccagcttgtccatggaatttagaaaacttctcatgtggctttcaggctaccttctcaagatggcttcttaaagttggttttgtttgtttagcttttagttctctttcccatttctcttctaggtgctcaacttgttatttattcatatcatatatgaataatcgtattactggcacaaaaactttaaaattgtatctccctggcagggcaacaggataattgtttactttctatatccatatcatattcagagtgtaaagaaaggtgaaccacttaacatttcaatttgggcaatttatgtggctttatacctgattcatttggatgtattttttctattcatctagacatatattgctttcaagtagttaggattttatttggacagcaaataataccagtcaaatctttgtgtggatattaactcccccatgctatttcagttgcttttctgtttctcaagttaatgatgtacaaattaaagttataaaaaataggattcccatttaatcaccaaacatgcaaaacaaaaaacccaaaacaaacaaaaaaactctatttgaagaggagttaataattgtatgtctaaaagaaacacgttatacagtaaaaactcacttaaagctatagtatttacaatgtgtccaagagtttaagctagaattcctggtcaagcaagttgtctcagtcttataatattgctttttccagacattcaaccaggatagattcaggtaaatacagatacagagacagatagaaatatagagtggtatatagtcatcaagccaatgctagaacaaaatatttaatctctagactattgttgttttgctcaaacatcattggcaagatttacagagttaaacaagaagtgcattgataagtcatcctaaagttattctagaatagaaacaagttacagttcatctgtgaaattctcacttagctcaaattcacaggacagaaacaatatggaaggtttgtagttcaggggcttgccagggtccctgaaactagtgatgtctggttttggtcattgcagagactaaacttcagaagcagagcatctggtaatggccatgtaacctctgaaggccttgtctgggccacacacaatttatttgctaaatcataatgtatcgtcctccagtgtgttacacaatctggtagaactgtggtagaatcctttgttcattgtctagtcactcataaattgcacccactatgtaataataattaacccatccaaggattttccaaattggctaatccccctatgttctacatcttagatgatttttttttacttgcaaaatgaatggtataagatgggataatttatttaataatacatttaaaagtggtgacccagatgtggtagggggtttctggccaggctacccagatacagatagatttagccagagagaaagctatatatatacatcttcataaaagcagattcacacagtgctttaggtgcagcatcatagaggctggccacattttattcataataactaatttattttttatttttatatttttggtataacacgtgtgatcaaagtttttcttgagcacaacaaatcctgacatagcactttccccaaattaagtgctaaattacatacatggaacaaacaagttccagaggccatccctgattttgactgtctggatattctgtctcggccaatgtaacattcattttataattgtagttgtctgctgtctatatcatatttcagaatttttcacattgaaattgttcagaatctttctcttcaagccagaggcctataactagcctgtagaaatatttatagcaattcaactgtttattttttctaaaatgagaagcaaaatatgtaacaacaaatattctgattaaagttattcattaattaatatgactaataacaaaagcaatcatatttattaatgaattcttcagatttcatgtacagaatttggttaccacatttatattaatcagcaacgattttctacctgtctcaggtaaggctgacctagccaaaaattggcttggctattggacgtgctctaattggccagggtgaatcggcctagcaggttatatgcacaggaatctgttgtgattaataaaaaccttcaaatctttgacttcctcgcactccgttacagttgtatacatttgctttagaatggagtcttagttttaccatatgagatttgattcacattgctattttcatagtacctatttttgtcttaagaaaatgacattagtttgtaccttcactgatcttatcagaaaattctttaagtattaggcaactctcacactcttggcggcagaaaatagttttccaaattcaatttttcatttgaaaacttgaattttatctttcacaacatatgctgtgtaattgtttttcttgaagtgacacatttacttcattcattttagagaaaatgtccaccaaatacccaagtctgaacaaccatagtttgtctgttagtcattctttcaaataaaaatggtgttacatgaagcaaaaagcaactaattcagttcacaactcaaaggttcacgtaagtgcttttcctggagacaatgatcagacttcagagtgcaccagaagtactttatttctgtttcccattttaacacacaaaatgttagaaagtcttgcagtcaagggtcaagatttaattaaatgaagagtttttacagcttcattaaggagattcttaaataaatttggctttttattccttttcctacaattgtctggcagtgtaatgttttctacttcatgaattcaatgattattattattgttttgtgtccttgcgttaatttgtgctaagtaccaggaattttacctaactttgttttataccaaatttggttccgtattaaaatggaaatggaaatgtcaacagagtgaaaaagacatcttagaattatcatgaaatagttttgagcccctgtgccctctcaaagtgtcccagggaccactacacgtctacagatcacactttgaggactactgacctaatataatgccagcgttggtaaccattgacatagttaagaatcgcagtacttagaatttgtatttacaactagaagtgttaaaacaacattcctcatatagaaataatttaggcatatttgtatatgtgttattggtcagaatgatttatttacataacccatttctgctgttcagcagtataacaattgaataacaatttcattaaaatgtttacatatttaatcacaaaacagtttaatcattttatgatgttgctactactccataatttcaaaataattaaaactaatatgaagtggccacatggccacatggtcctagagacatatagttaataccttgtgttaaatataaatgcaccaagtaaatccgatataatatgcattcataataaatgtaggtgaacccacaaggctgatagaactcagaaataaactcaacatacaataatactgcttgagccagaaatacctgaagtttttatatttccaatttatatgtagtagatgcttaaagtggaaaatagtgttatgatgacttattaagcaatgaagtcagcacagtttctatttggacagaaattctgactttatatttcttttctctctctaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 1225 - DNA, 87220 bp, Homo sapiens
cagttgaaataactccttcgtggaggctggctacattttcacaacgtctggtcccaagctagatcttcgggaaaagggatcaaggaaatgactattcctccaaataaaatgtaagtatatcctgataaaatgttcacttttttggagaataaagagaaatgttctttccgggagaattgtgactcggaggttatgccttgcgatctctacctatttctcactacttcttttatttttctttttccttcattgtttattttccacttttctcctaatgtactttttcttctacttattagctgtgtcccctgggcaagtaatttttccactctgtaatcaaatgctataatatggggatgataaaaaataactccacaggtcattgtgcagaatagagataatgaatgtgtgggtacatatgtgccccaaaactcagctgtgtaagaaaagcaactttctttttatatttttataactcgacttagtttctattttgaatccctatttggcttcatcgtggagatgtaatctcagtcaaagcaagatgctctcatcaaaacctacatgacatctacatggatgtcagatccatgtagctttccaccttcagccctgcctggatgttccaccattgccctgccggttagccaggctgcaggcaggtgctacacgctaggactccttcctgggaactcaaccatcacgtcaggtttcttggcttccctggatctccttctcaaatttgaaaagtcttgtctggtctggagaaaaagtttcccagcttttcatttaatcttccaaatctttagtttatgaccagaacctgccatttgagactcaaaagctaaaaatatgactcctctgttatctttgtttcactggttttcccttccctgaagctttacagaaggcctagctgcctaatggggagaaacacgggaaataccaaggaaaacatatgggcaaatatctcccaagaatttcccaccacttgtatgaagcaccaagaggaaggcctgacatacagtaggaagccagcaaaggtgactgcacctttatatgaaggttccaagtctggttccatgtttctgggctctgtgtccttggacaagttgtctttctgtgcctcagtttccccacctgcaacatggagatgataatagtacttacctcacaaggtaatatgtgtataaagtgttcaatgaattagttacactattattgttttttttaccactagtacaaacttctgtccttgaaagccattagcttaatactatcggcaaccataatagtgttgatgcagttgacacatagagtgcatcccacagaggagaaggtaaacatatcacagggaaagagggagctactggtcccaagtatgaaactgggatgagtttcctggaaatgcatccttctgggtaaaatctgggtataatgatgctgagtggtgagttaagaagcaatcagccaacttcagtcaaggcagttctcaggtgctagcaaggagaggcagattcttgaggatctagagtctgaatcagaagatggatccaagcttgtaacccaggggacaaaatggagtcagaagaaagggatgaggagcaaagttagagaaaggcaggctaagccaatgtgagaaatagatctggttgacgatggccagcagttgttggagaacagaatacgcgtggggcctctcctgagatgtgaggccactgaggggttttgctgagggagataccacttctgtgagcaaggacaatgagaggaaactgcgggagagagaatggtccaccagtcccaagctaaataaacctttttctctggcccatccagctgatgagcatgagaatgagaatgtgggacctccacccctgcacctgcctaccctccagtcccagagccagtttggtctatgtctttctcaacccacattctgccaggacaattgagcccgaatgggacagtggaaagggcatcgcatgggaagtcaggagacctgaactccagacccaatcaatgaccaactagcctgagactttagacatattccttcacctctctgaaccttagggccctcaatgaggaggtaggaccacataagaacagagctaaatgggcatagttagcggtatgggagccagagggccagtgatatgaattctgtctttgccatttaccagatgtaggtcaactaatttaatctctctaaactccagtgtcttcatgtataaagatggggctaatagcacacccctcacctgattaattggaagatgaaattcaagagtgtctgggacatgtttagtagtgttgtgaaacactatgcatactcaattgattgttgccaatatcactatcacgattatcagtggaacccaagatctctattaggtcaggggcaactaagatagttgagtgggagaattcaagactgcagaccctgcttcattaggaagagcagaagcgtttttctctgttttatttatctctctctctctcttttttaacaaaattaagtatttctcactgaataataataataatgttataaatcactggactaggccaagggttggcaaacttttttttttttgtaaaggaccaactagcaaatattttcaggtttgcaggccacacgtggttgtccactgcatattcttccggttttattagaattagggttgagttaggcttagatagagaataacagcatctattagggtagaatagtattatggtaactattataacacaaaacccttacctgtgtgtaacagaaatctcagtgcctaaacaatcaaaacgtatttctcacatcacagtaaagtgtgagtagggggttaggttgtctatgccacataatcttttggggatctaaaaatccttccttctagtggctctggaaacctctggatagaaggaaaaaagagatgggcccacattcaagaacatttcaaaaatgtaaaagctattcttagctcagggtctgtacaatcatgccccgtcagccgcttttggcctacgggccctagtttgcccactcccggatcagaccatctctcaggtcctttccaaagatgaaccaaacttcactgtgagcaatctctttctttctccatcaaagtaacctggcagtgaactctataacatctcccactatctttcatgtgataatatttttcatatttacaacagttgtcatattaagtgtttttgttacattttatgtgtaatgttacacagagttcctttgtgaacagttttcgtaaaggtggtgtattaattttcaagggctgctgtgaggcagtatcactaattgggtggcttaaaacagcagaaattagccgggcacggtggctcatgcctgtaatccgagcactttgggaggctgaggcaggcggatcacgaggtcaggagatctagaccatcctggctaacactgcgaaaccccgtctctactaaaaatacaaaaaattagccgggcgcagtggcgggcgcctgtagtcccagctactcgggaggctgaggcaggagaatggcgtgaacctgggaggcggagcttgcagtgagccgagattgcgccactgcactccagcctgtgccagagagcaagactcggtctcaaaaaaaagcagaaatttgtttcttcacagtctggaggccagaaggctgcattcagtgtttgaagggttgattctttctgagggagaatctgatccatgccttcctccagcttctggggatgaccaggactccttgatgccccttggcttgcagacacatcactcgggtctctgcctccatcttcacactgcattctcactatgtctctgtcttcacaaagccccttggattggggcccacactgatgatgtcatcttaacttggttaaatttcccaagaccctatttccaaataaagtcacatgcacaggtactggggcttagaacttctatcagtctccttgatggacacgattcggcttataacaggtggtgaaaagcatggggttgcctattcataactaagaactgttaaatattagaaatggaaaggactgttggttcccctgtgctgctgcagggatgagtaagattgatggcgtgtccaaacagcttaagttttacccttcactgtaaatggcagagagaacagtactactgctgctgctaccttgaagaatgtaaaatttgccttttaaaagtgtttttgttttatggacatggaacaatgaactagaaaatatggcacattctgtacccttcttctgcttttaacttataaatgctgtattcaaaatactggaaccgtgtggcttgcggttactaacaaaattaaaaataaaagcaaaaagccccttcgcatccatgtcacccactgagggaaatgcagcttggtgccctggagaagaaatggactttctggtgaattctcacccctttctgcaggggtcaggatttgaaaattactaccagctggttgtaattccatcctattttgaaacagatgacttagactgctaaaccatcatggggctaagatttattttcccctacttggactaagtcacaaagacccaatttgcacagtagagaaaaggaagaaaatatttttttttggtgagctcacctcacctctgccagtggaaaacctaccaatatctcagaatttgcacgagtgaattgggccatgccacgccatctctgatattccagagcaggaattgtttatcttttccaaattttcacagcactttctgtctctgcacctcttcagtggcacttattgtgagacttatgtcccttcctaaagtgcaaactctctgaaatcttagtaattactcaaggtggagaggaaggaccctgtggacagggagtgacttgaaatgctggaaaggaaagaagaagcacaggagcgaatccttcaggaaccaagaaggatggaacaaggttccaaactggaatagtcttccctgcataggaacaccaagcaattgggaatttcctgtaagcttcactggaagccagctaagcctgtaagggcttctgttggaattcagcgtcaggcatagaactctagtgaatgtgcctgaagaaaatcctatccaaagtttttggcataagcaagtcacttaacttctctatgcctcagggttctcatctatgtgataggattaatcatagaatctacctcataaaattgttgtgggaatcaactatcataatcaatgaaaagtactgagcacctagccagcctggcatactgttccccaaccttcccaaatttatccactaggaattgtaatagagtagatttgagttgcagcctgggagtccatgtgttcagcaagcatagttaagaagttcttgttttcaggcaaattcgggaagcaatgctgtagcaatagtaatagctcaataaagagtagttatttttattatgctaccttcatcatcattaacttatcattatcatcatcatcaccaccaccaccaccaggaattgaagataatgttagggaaaagattcagcaacaataacagattctataagcatcattgaatcagttatcttgactttggtctgatacgaagttattttcactgtttgtagaaccagtagacaggtaaccaactccaactcactcccgatttgaatctcaaggcgattatttccattttactcttatttaggtgaggagggatcttaacttagaacaagaacttgggccttgctcaataaattcagtggctataaatctaatccatgattcatttccatttttaccctggggatgaacacagaggagtctacgcagtgctaattaccacgttttgactggggcaccccaaagaaggaaagaatcacaggaccactccttaaagggactgaaaaatctcattgtccagtactttcacgtaggggcttctgccccttttaactactgaaactaccatgtatccattcttagacagccagggcaatgctttttataaactcctatctgtatctgattgctttaatggttctcaaaactccttacgatcagttacacttattttattttctattttatgcgatgttgttttcttgtttttttttcccccaatccttacacctgactcctacgaagaagaaaccaaatcgtgttattcattgtacttactccagtgtctagcatagactttctttctagtatcagtgaaaagattcaattgtatccaactataaggtgtcttaatttaaacttctttattttgagtgtacctgcctaaagcacctgactgttgtttttctacttctttacatatttgttgttaaaataataacaacagtagattgctctaaggggatgctacattaagatggcatctagtccaaagggcctttaaataattgaatttccttcatctcaggggtgccatcttttaaggggaaaaaatgaatagggaacagtggcgaggaaaaacaaagcaactatttttagcttgtcctctggcccaaaatatttatctagagctcccagaagctgggctggattatgtaaaatgctttacctagccccagctaccatatgtcttaccaccaaagcacaacctaaggtctcaaaacttgctactcccgttaagtaaaaattacattctgtagtgccaaagaaaaagcccccagaaagacagagaataacagtgtcttttacttaggatagggcggctctatatcaaagagttacagctaagcaggattaaggctgatttctcacatcaaaatacgatgtatgagttggtagaagaggactcttctccatgcagtgtttcagggatctataattcttctagtgactcccccatcttttaaggttctggaggccacccatgaatggaaggaaagatgtatcatggagcaatgctggggttgagatagtatagatcacttgagaccacattcaagaatccagccacaggacaaccctttgttataagagaggcacctcgctatgtgcacaggagagaaagagaagtgtcttggagaactcttagccagtctctgttacagacagtgagtacatgtgccccaaacctatagagtagctgacccaaccacgtactcaaggttgttgtagaaagtgtggtgtctgcaaaagggaaaataaaaggcagtgtttggaagaagacagagaaaacggattcccacacatcctgaactttcagtcctagtaaaagtggccaaccccagtattctgggatctgaattattagatcaatattctattttttcaaaagagtaacagaattaagagcttgtgggtatggggcagataagtcctttcttcagctagcagaaaatgcttggtttccctcaaaatctgtgttcttaatgtaatttctccctatttctaatttggcttcccattgaatactcaggcacagttctagaagcgagaaatattatctatggtatatataccatcataataaaactatgggttttcaaagtacaattttgttattttcttccctagggactatgtcttcaattcagataatgtgtcaccaggtggacgataatggtgacagttgatagccagcatctacctttattttatgccagaaactattctagacattttacagttacctacttcattcctctaacaacctataaggtaggccttattactattttctgcagcttacagctttggaaattgaaacacaaggttaggtaacttgtccaaggtcacacagtcatcactggggccagaattccaaccaaaaaaagaactaggtcttaaccactgcattcaaccactttggtgccaaaagctgaacatcccctaagagtatttaagaaaggaacatagacaatcgtgattttgtactcaattatttttttctatcaaaaatagagcttttgagtttatctaatcagcaaagcataacactagtgttaccatagcattacatttttaaaagtttagagcaagatatacaaatctaattttctagatacaagtaatcacctttcccaccaatcctaacaagaaatcttaatcctttccttctgtagtttatactgatttaaaacaagaactttttgttccttttatttcctatttatggtactttttaattctttcattccttagacgtttacttcatgaaacttatagcattacatttctgaaaatcacagaaaagaatttaactcctttatttctactttctatcaataacctcttaaatatggaataccctataaaattttttcttccgcaggaaaaaaataatcagagcacattcaaatgccttgcatattttcattattttcctttcattcagaagaatttcctccattgatcagttgctttacttcattatgtctctatgtcatttgagacctaaagctcccatgtttcctgttcgttatttgccattgcactagtgaggacatgcagtgtactgcgaaaggaagaggacatcactttccttactccagatcttctgggaaaagcattaagtgtttcaaccattacttattatgttagtttagtgaatttttttagatgttctttatcagactgagaaagttcttttctgttcctagcttgccgatagttaatatcatgaagggatgtcgaattttgttaaatggcttttctatatcaattgaaatgatcatatgattttccttcttgagactgctattgtggtggattacattgactgatttttgaatatcgacttatacttacatttccaagataaacttcatatagttgcagtgcattctttatttttttacacattgttgaacaaatccgcttttttaaaaaattcagaatttgtgcatctatgcttatgagggatattagtcaatagtttccttttttttttttttttttttcagacagagtctcacactgtcacctaagctggagtggagtgcagtggcacaatcacagctcactgcagcctcaacctcccaggctcaagcactccccccacctcagcctcctgagtagctaggactacaagcacgcactaccatgcccagctaatttttgtaattttcgcagagacagagttttgccatgttacccaggctggtgtcaaactcctgagctcaagtgactgtgcaactcagcatcccaaagtgctgggattagaggcatgagccaccacgcctggcccagtctatagattctccttccttccttccttccttccttccttccttccttccttccttccttcctccctccctccctccctccctccctcccttcttccctctctccctccctcccttccccacccgcattccttccttccttccttcctctcttcctcccttcctccttttcttccttcctctctttccttcttctacttgtctggttttagaatcagagttatgatgatctcataaattgagttgggaagtgttttctcttctacattttagaagagatattgtagaattgatgttcttttaaaatgtttaataaaattattcataaataacatgggcctggagaattttgtcagatagtcttaaactgcaaattcagttatagggctatttaagttgtctattacattttgagtgagtttaggtaatttgtgtttttcaaggaattgatcccttttgcctaacttgtcaaaaatgtgtgtatataattattcacagtatcccctatattcccctattattattaaatgccagtggggtctgtagggataacctctttcagtcctgatactggcaatttattcttgccttctttttgtctttgtccttgctgaaagtttatggattttattgatctttttaaagaaccagatttgggtttctttgaatttctctattatttttctgttttcaattttctctatttctaccactatattatttattttcttatttttgtttgagtttattttgctcttcttaagatggaagcttagataacttgtataaggcatctcttttctaatataagcttttaatgttataaatttttctctaagccctgctttagttgtagctcacaaattttggtatattttattttcatttttgtttaatagaaattattttctaattttttctttttgactcagattatttagaagcatgttatttaatttccaagtgtttggatatttttctcttatgcttcctgttatcctgttcctgatttctagtttatttttattatgattcaaggaaaatactttgtctgattttagattttattttttacataattctaactttttgttaatgtttcttttatgaacaagatatggtctaccttgactattccatgtacttctgaaaagattgtgtgttccactgttatgggtagaatgattttttaatactatttagatttacttagttgatgatcagctcaattcttctgtatccttgttggttttttataagttctgcatattactgagagaggagtgttgaactctccaaatataattgtggatttttaaaatttctcctttcactttcatgaattttgcatcatgtttttgaaagcgttgtcagtaggtacacacatacattggattattatttcttcatgatgaactgacccttatatcatcatataatgtctctctttatccctggtcatcttattcactctgaaatctatgtctgatcagttttcttttgatcagtgtttccacggtataccgtttctttctttctctccttccttcctttctttctttctttctttttttgttttatgatctctgttttaatgtttgggttatttttatttttttttattttagtaggtttttggggaacaggtggtgtttggttacatggataagttctttagtggtgatttctgagatttgatgcacccatcacccaggcagtgtaaactgtaccccacatgcagtcttttatccccctcccaccatttcccctgaggccccaaagtccattgtatcatcctgatgcctttgcctcctcatagcttagctcccacttatgagtgagaacatatgatgcttggttttccattcctgagttacctcacttagaatgatggtctccaatttcatccaggttgctgtgaatgctattattttatttctttttatggctgagtaatattccatggtgtatatatatataccacatttttttatccacttgttgattgatgggcatttgggctggttccatatttttgcaactgcaaattgtgctgctataaacatgtgtttggaagtatctttttcatataatgacttcctttcctctgggtaggtatctattagtgggattgctggatcatacagtagatctacttttagttctttaagaaatctccacactcttttccttactggttgtactagtttacattcccaccaacagtgtaaaagtgttcccttttcaccacatgcatgccaacatatatacatttttatttttttattgtggccattcttgcaggagtgagatggtatcacattttggttttgatttgcattttccctgactattagtaagttgagcattttccatatgcatgttggccatttgtatcttttcttttgaaaattgtctattcatgtccttagcctactttttgatagaattgtttgtttttttcttgctgatctgtttgagttctttgtatattctggatattagttctttgttggatgtgtagattgcaaagattttctcccattctgtgtgttgtctgttaactctgctgattatttattttgctgtgcagctttttagtttaattaagtcccatctatttatatttgtttttgttgcatttgctttgggttcttggtcatgaagtctttgcctaagccaatgtctagaagggtttttccaatgttatcttctataatttttaaggtttcaggtcttagatttaagtctatggtatgtcttttttatttattaaggcctaatttacttattattttgcaaatgagtcttgtaaatagcatgtcattggatcattcaaaaaatatattttgacaatttctgttatttagtttgtatgtttagatcatgtacatttagtgtaattctttatgtttaaagttagatctattattttactatttgttttctgtttagtctctggtttttgttcctctattttctcattttctctttcctatcttcttttgggttttttttttttttacattatttagcattccattttaacttatctactgtattttttactctattttacacatatatttctttctttgtgtgtgtgtgtgtgtgattactacatatttaccttttctcactgtccagttttatagtggaatgtaaaaactttaccattatgtaggtccttttatgttgtaactgtcttgtatattatatctacatacattgaatactccagctgacaatattgtcattgttttcttttagccatttaatatattttaaactcaagaggaaaaataatctcttttatttatctagttatttaccatttctgttcctcttcttttaatccttgatattttgaaatttcttcctagtatctcttttcttcagttgcaatggcttcatttagcaatttgtttagagtagatctcctgacaattttatctcaacttttcttcatgtaagaatgttttactttcaccttcatttctgaagaaaatttttctggacctagacttcttagttgatagttcttttctttaacacttaaaaatttccactaccatttggcttacatagtttctaaagagaaatatattcttatttgaatctttgttcctctagttagaagtagtatgccatttttctctggttgctttcaagattttttctttgtttttagttttcagaaacttgagatacccctaagtgctcatttctttaattaattctgtttggggttctctacacttatatctctaggtttatttctttttttccaaacttgggaagttttcagccattgcttcttcagttttttttccacgccatactccttctccttctaggactacaatgacatgaacatgagattttcgttattgtcccacaggccctgagagtctgttctatttttccaatctttttttctctctctcactcagcttagattgtgtttattgatttagctctatcttttttttctaagtaaaggtatccttagatttcatgagatggtgataaaaatcccaattgatagacaggctgatttttaaaatttatatgaaaaggtgaaggaacaggaactggaataaccaaacagtattgaaaaaagaaaactaaagttaaagaaattgttttttcaatttcaaaaattttgttataaatctacagtaatcaagacagtagtattagagaaaagatagatacaatgatcaatgcaatagaataaaagtctagaaacagatccacgcaaatatggacaaatgatttttcacaaagatgtgaagacaattcaacagaaaaaggacagtattgtcaacaaatggtggtgaaacaatttagcattcatatacaagaaaataaacgtctaactaaatctcacaccttattcaaaaactaactgaaaatgtatcatagatgtgaatgttaaatgtaaaactataaaacttttagaagaaaacagaaaaaaaatcttcatgacttttggttagatgaagagttcttagatacaacaccaaaaccataatccctaaaagaaaaaaaatgatatactggaattcattaaaattaaaattttgctctgagacagacactaagagatgaatagacaatctacagacttgaaaagaatgttttaaaatcacatacctgacaaagaacttgtatcccaaccgtataaagaactctcaaaattcagtagtaagaaaacatctaactgaagcaaaacatgggcaaaatatttgaatagacacctcaccaaagcgagtgtacagaaggaagaaataagcacatgggaagatattcaacatcatttgccattaggacaattcccactggaaaccagagcatttggattcagatgctttaccacattagaatttcacttatggaggaaatcattattatcaacaggtattgaaatattaaacttgcgccatcagaaaagttgttaacagagagtagaaacacaaattcaaaattggttactcaaagagggaagagaggctggtgctggcagcttcttttactctggagaataaagcccagaaggtctgatttggacccaagccaaaacacctgaaaaactaggattcggcatctaagcaagtgcactagtactagtcaaagagctcttccaacaaaaatcaattttattataaaattctgtcaccttctaaaaccaagttctcgggagatgtcttctagggtctcacaggataggtgacttgagctacacatacataggagcaaatagatgcagctatctgaaggaggcaaccaactgacaaatggagacccctataaactctgacacatcaattgcatggctgagaatccaggtatagaaagttggaaaaaagaaaaaagtagacgcaagagagcttgtgatttgtaaagacatttttgaatacagtctccattttctcagctatcttcctcaagaaagttagaagttttgggccgggcgcagtggctcacacgtgtaatcccagcactttgggaggctgaggcgggcagatcacgaggtcaggagatcgagaccatcctggctaacacggtgaaaccccgtccctactaaaaatacagaaagttagccgggcacggtggtgggcacctgtagtcccagctacttgggaggctgaggcaggagaatggtgtgaacccgggaggtggagcctgcagtgagcggagatcgaaccactgcactccagcctgggcaacagagcgagagtctgtctcaaaaaaaaaaaaaaaaagttagttttgtacctgtataaacctaccagtgtaggaatatgcatagtcataaaccccttagaaaaatgatacaaataattacctatcacaatatctggattgctatgtttttatacaatgctatgttttatgctaactttcaatagtgtagtaaagagtgaattctcaggaatcaggtagcctggaatggaatatcaactctatcacttcccaataatgtgaccttgacttttcttgggcaagtgacttgacttttcctcagtttcctccactgtaaaatggccataataatacttactacatggtttaatagttataaagcacttggaataactcctaataggtgctggctcaataaactacatcatcatcatcatcctcatgtcatcccaagacaaccgtgcttttatatttccaatagagacttttatgttgcccttagctgtgattaactcgctacacaggaacatgtcagctgagtgggaggcagaaatcacctgcagaaatagttcccctaccttgtaacttttaggaagagagagaaaaattgcttcacttacttaattgtaggataccctgaaaaccttcctaccaggaaaaatgaaagccttccttctttccatctttcttaagtgtgcatgaaattgattctatatgcttattaaatctgaaagagaaatttcatgatacaagcacttcctgcaattgaatggtctttgagaactcatattgactataattcatctggagagtggccacacagtttgacaagaaaccccggcctgtctgtgcaggctgctgaagtgtgtttctgcacctgcctcacacaagactgtctgtttcttttttaaggcaattaaaatatttgtaatacacatattgaagacacacactgcacctttgggtcttgagctgtgtggggtgtgggagaatgaaagagcatcagagggaaattgtgtgtaggggagagcccggtcttaattaagacacggacatgagaaaatatttactgaagaatgtggtgatgtggaggagcttggtagtcaggaaaagtattgttttgtgttttttatccccaaatggtagggtgaaaaggttttggggagagagagatgggagactggctcaggagggaggaagcacagagcaagtgaaaagaagtctacagatggccagagggtgtggtgggcatggctggactcaagagcctaagggttcccctggatggtgggacattcagactagctgtggccctggcatggggcagaagggcctcagcttacacaagatggatgggcctggggggtggggcagaaaatgcttttctcttacacccagggacacagacaaaagtgggagtgaagatatctgatgttcaagatgggagtaaagaagcaggggcaaaacctaaaagcaggaatccttgctggtcctttgcagtgcctagattgggctgtcgcccgcatttacttggaactgtgtgttggtctcctggcagctctctccatctgtccttgctccctccctctcactacccccagagggatcattcttgtgtgtgagacagatcacattacagaacccctccacccatcctcggtccctttgggcagcggctcctctgtcattcatgggtgctgaaccagtttctatgctccattcctcaggtggcaggtttttatactttttattttctgcacagtttctgtaaatttggaccctgaatctataataacaagttgaacagggctttcaacttcttataagagctgtttttttgttgttgtttttttttccatccaaggcatcacatggaaggcgagccctctcttcactttgctggaccagtgagccacagcctttatctggcagggccctcctagagactccacactttatggaggggtctagttctagcttccttgccttggcaatgaataaagctgtgccttctttccccagctcatgctaggatcccagggtcccggcccctaagctctgcattcggatctgagctttccagttactcttaccatttggatattaaatttcttcttttttcttttggcatctagtgatttcctttattttttatgagttcttctatgcatgtgaaattttttttatattctatgcattatttctaatgcttctactcaaggaagaacattcatatcggtaagtcaccacaagttccatggttcccaggcagatttttcaggattgcatttctgacacttcactccctgtgtttgtttatgtgtctgtctcccttcagaagttactctgaggttgacagcatagcttatctgggtttatatcctggtgcctaatacaccacatggaaggtgctaattaaatcatgggatgaatcaaagagagagagagggatagtttaacatgtgttaggctcaaagtggaacttttgttgttgctgttattttgttttttgagccacactattgaaagctattactgtttgtttaatatgagatagagtcagatcagtgaacacagttttgagaaacatacaactgatacctcatcatagtacttattaagggtagcggtttaagaactgcagaaagtcaaacataaatcctctaagaaccccactgttttaatttgtgtttgcaactgaagtcagccacacctccttgggctgatcttaaaataattctttactcaaaaagtcacagtatcctggcacttaacaataacataagagagccccagcccggagcgactgtttgttttgataggaacagaaacaactcttttttaatgaacataaagctctcgataggtttgggggttttattcagctgttttctgaatctctcaaagctcgtcttatgaaattttagcaagatctgacccgtcccctccctagcctggatgcctccctgaggttgctgttcaccaccactgagctcagacagacagacggacaaacagatgggccttgctgaccagggagcttcgatttcctctcatttgctttggatccctgcagcaaaagtgttctgtcccagagccttgtctgtgtaccagaaatgacacacaactctcaaagacgtggtgcttgtctgccaggacttgaattcagaggagataacaccagccaaggcacagcagggcctggagacccttgctctgtccactgaagtatggcagacatttaatcccttcttccaatgcaagaaggaataggcaggggcgggaaggtagaagagcaggtgtctgaaacccccagaggacctccgtggtgagtgggtcctgaaccagcatgccaggttgacacaaggccatgacctccacactcagtcctctctgggcaactctgaaatgcttgtttttcaccagagaagcctagcatgtcagctgggcagccagcgaagaaaagccagtgccgtctctggcagggaacttgaaaaggtacaaccaaaaccatctcctggtgtccagctggatcagatgcacctgtggagatctcgctgcactccagagcctggtctctccacaaaaccagaaagcagagagaaaagcagagaaagggagtgggttcctgtctggtagatttccataatgtggtgtctgacgataagtacacagggtgtgatgaaatagctctaccccgtatgtgtcaagtggtgtaagcacaaatgcctaaaactcagttcttcagagttaaatctggaattcagccagagtctctatggaaggtggagtccccccgactgccacttcaggcccctccgtgaagcgattcatcctggagcagtaaataagtgtctcctgctccctgccacaggccaaccaggagtgctggagggtagagcccactgcaggaaccagatctctggcgaaacaggaagcactgatttactcattcgatgcttgtgaatcaggcacctatgctgggggaggtacccccctaggctctggagaggaggtatgagtgaaggggtactgctcagggagccctgggtgtctctgtccatgcaccctaagccgttgggcttagactgtgaggcttatttgcacacaaattgctgctttcccgtggggtgcacagcacagccacctgtggtgaagagctctctcaacagcagcagggcaggcgtgctacccatctataggggccgactcagcaacagggctccctctacccagcatcctcacttccagatcctctgagaggccctgtggttgcttgtctaattgacggaggaccactaaccagagatgacaacactccagaagcaaaacagaaattcacttgcactgagcccattcaaatattgagacacacgcaaatgcaaaagtaaatgagaccacatgtgagccaaactctgagtacaattaagctaaaagctagagattaggttctaattcaggcttcactgattaaatatgagaatacagcaagtcacaagacctcactggtctcagtttcctcatctgtgaaatgcggatagggagaggagatggaggaaataatttctgcctagggttgctagataaaatacaggaaacccagttaaacttgaattttagatacatttgaatttttttgttttgttttgtttttgtttttgagacgggagtctcgctcttttcgcccaggctggagtgcagtggtgtaatctcagctcactgcaacctctgcctcctgggttcaagcgattctcctccctcagcctcctgagtagctgggattacaagtgcccaccaccatgcccagctaatttttgtacttttagtagagatggagtttcgccatgttggccaggctggtctcgaactcctgacctcagttgatctgcctgcctcggcctcccaaagtgctgggattacaggcgtgagccaccacacccggccgaataattttttaagtatgcctcatgccatttttgtgccatgcagtatttttacttgtgaaatctggtggccctgtgctgtcgacattcacctgccacgaggtagacgatgtgggcgtcatctttgtaaactgtgatataacattgtctggtactctgggcgagtctcttccatttgcttgccagctcctggaggcagggctgtgtattaccaaactgtaactccatagtttccacataaggtaagtgagctaggtatcatgattaaatgacatttaggtattctttttggcagatcagctgatgggaaaggtggctaaagaggatattgcaaagaacccacagcaactgcagcctgactgttgctctgggctgctgtctgctgacaacagaagtgaatggcagaacctgggcaccaccacccaactgggcggagaaggaagccgtatagcagtgaaattgagtctgaaaggggtcggagcagagagagggagaacattcctggtagtgagttagtggctaagtgacaatgttactacatcacggatgcacattttccccagattataaaaataatttatgcgcatttgaaaactggaaaaaatgcagaaaatattaagaaaattgaatccataaccttgcaacccagagctaaccacaattaatatttaattctatacttatagcatttttgttaagatacatacatatatcttaaatataggtctatgaattcagaaaataaagtccatactatacttttttcttttttttcttgagacggagtctcgctctgtcaccaggctagagtgcagtggcgcgatttcagctcactgcgacctccgcctcccaggttcacgccattctcctgcctcagcctcccgagtagctgagactacaggtgcgcgccaccacgctcggctaatttttgtatttttagtaaaggcagggtttcaccatgttggccaaaattgtctcgatctcttgacctcatgatccacccgcctcggcctcccaaagtactgggattacagacatgagccactgcgcctggcctatactttatatataatttagctctttcaaattaacactttattgtgagcattactctatgtcctttaaattctttgagtgcataattctaatagtttcctattatcagtttctagatgggccctaatctattaaaccaagccctaaacattggaaattcaagctgtttttactgtcttcccattgtaaataaaactgttataatcggccgggcgtggtggctcacgcctgtaatcccagcactttgggaggccgaggcaggcggatcacgaggtcaggagatcgagaccatcctggctaacacagtgaaaccccgtctctactaaaaaaatacaaaaaattagccgggcgtggtggcgggcgcctgtagtcccagctacttgggaggctgaggcaggagaatggcgtgaacccgggaggtggagcttgcagtgagccgagatcgtgccactgcactccagcctgggcgacagagcgagactccatctcaaaaagaagaaaaaagaaaaaagaaaactgttataataattaaattgtacacacctatatacacatcccaaattatttcctcaaggcactgcagtggaattactggatcaaagattatgcacatgagattttcatttatttttatgggtacatagtaagtgtatatatttgtgggttacaggagatactttgatacaggcatgtaatgcataataattacatcatggtaaatggggtatcacctcaagcatttatcttttgtattacaaacaatccaattatataatcttttagttatttttaaaggtatcgttaaattgttattgactatagtcatcctgttgcgctatcaaatactaggttttattctttctaactacattttttactcattaaccatccccacttcctcccaccctgccactgccctccccagccttcagtaaccaccctgctattctctatcttcatgagttcaattgttttcatttttagttcccacaatgagtgagaacatgaaaagtttgtctttctgtgcctggcttatttcacttgatataatgacttccatttctacccatgtggttgcaaatgacgggatctcattcttctttatgactgaatagtactccactgtgtatgagtaccataatctctttatctattcatctgttgatggacacgggttgcttgcagatcttggctactgtgaacagtgttgcaataaacatgggaatgtagaaattcctttgataaactgatctcctttctttggggtatatacccagcagtgggattgctggatcatgtagtagctctatttttagttttttgaggaacgtccaaactgctcttcaaagtggttaagatttttgtttaagtattaacatttactgagcacttactctatccctttcactattttaaatatttaacattattatgttaatgacttaattattaattacttaactactaattattagttagttattatcttcatctcctgctcccagccccatctcacagatgaggaaactgaggcttagtgaggtcttgtgacttgctgaattctcatacctaattagtggagcctgaatttgaacctaacctctagcttttagcctaattgcattcagagcctatctcatttggggcctcatttacttttgtatttacatgtgtttaatattttaatgagttgaaatttcatgttgctttttgttttgttttgcttctggagtggggtcacctctggttaatgatctctgtgaattagacaagcaagcacaggagttctcagagcatctggaagtgaggatgctgggtcagagggagccctgtgactgactggattcttgtattaaaggtcactactattgttttcctcgtagtagagaggagaaaattgcagcacagaaaaattaagtaataaagtttcaccctcagaaaataaaaaggagggaccaacccagtcaaactccagtgaagctgtctaattacccttgactgtggctttacccactttcccactgttgctttacccacggatagtttatgaatgctcatctcatactctgagaaatacaggtgaaatattttatctttacctttggtatattgacaacataggttgtttcatttgtatttttaataactatagagattgaattttttcatattaaaactttgcttttttgtaaactggcaatttttggttagcagtgattgccctttactctttggtatgtgtgtataaatatatataaatagcatataaatacacacgcatgcttacatacatacatactttctatagtgagaacagtaacgctttggctatcataaatattctgttattcccaatgtgtccttggcatttaattctatagtggttttgatgtctttcatttttctacacctaaactaattttttaattgtctgttactttaaagagttttacttaagacttgcttctgtctttaatactcatattttcttttagcctgtcataattgtagtaattttttcattcaaatatttgatccatctggggtttattttgtaagcgtaatttttgtcattataacatacataactggtttttagaactaaccaattttctcagtaatatttactaatgaattcatcatttctccaattatttaaaaagtttcttctgtcatatatgttttggttgccacttctttcattcctttatctgtcttagacactatcgtattgttctgattattgcaattttataaacatgttagcagtgtctctacagaacccttcttttaaatcctgcaattatccatcttcattcctctatgtttttgaatactcctcaaaatcactttttcaagttaccaaataacatcattaggaaattgattgggaaatatcttaaacttacatcttatttaggaaagaattacatttataactaatgtctttccttctagaaataaaatttatttcacttttgtgccatttttaatatatcttgataatatattggagcattttttacacagatcctgatttttaagcttgttcctagttattatgtatattttcttgaataaaatctctttaaaaatgttctttggtttttgaaatgtctaaaagagttattgtggcttttggtgtggtggctggtgcttgtttactttgtttttagccagctttctgtgtaactcactagtctgaatatatttttactgcctatcttgattttccaagggaaaaaaatgaaaaaaaaaatcatatatcacctgaaaatgacaactttgtcttttcgccattgacccctaacaagaggggtctcttgttagagtagtttgttttattgcgttgactggaacttccaagaaatgttgcataattgtagtgatggaagatatgtatctgacacttctgtgaaacagttctcttcactggtttaaaataaatagattttttatctcatgtcaagaattacctttttcccaattttctaatattaatatttgatttttatctaatacatttttattatggtgattatataatatttttctctggcctatttatgttatatattttaataacagctctcctaattttctttctttagaaaaaatgcaacttggccatgggacatgatgtttttgacatgatatcagattcagcttctttctatcttctttctgattatacaaatgggaagatagtttgtgttttccttctcttgtgctagtgttgtcattttagagccagaattaggatagcttcataaaaccaatgaggaagctttggatcttctatcctctcagttttatagagcagaagaatgatttgttcttccaacttggaaaaacgttcataaaaacatttgagccagagccatttttggaggtaagcctttgacaacactttcaatgtcttccctagttattttttctattcaggtttactgctccatcctgagtcaattttggtcatttgtattttcctagaaaatcatcccttccattgagatgttcaggtttattagcacagggcggcatgcagtattctctcgcagtacttttacactcttatcaatagcatcattctcttgtaactaatttcgtatatttgtgttttctttttttatttttagtcagacttgtaaagtttgcttatactattggttcagatatgatactacaaaggtccagatctcagattttttaaataaattttaagatttccttctttgccaatgagtttctgctgctttcttcattttctctttcctgctttcctaaagcacttattatgccattctttcctcatatcttagttaaatagttatttaatattcatcttttcttattgataataagatatttaaaactgtgcaattgcccgtgagtacaactgtggcaacattgcatagtttttcataagcagccttctcatcaatattttcaaagtgattctgaattacagtttttcttctcatagatacaaaagctatttatttaggacatcgtctttattttatgaggttgggtttgttttatttaaactggcatcagtaatttatatatatttttaccacagtatgtttagatcctgctattataaaatttctgctttgggaaatagaaggtttattttgtaaataaatatgtgatcagtttatattaatgtttaatgtgtatttttaaataaaatgaattccatttttagggctcaagtctgtactaccaatgtctattatagtactttcattagctttcttacttaaattcattataatcttcattatttgtgactttttgtatcttttaaaaaccaagagtggtaaattattttattgggattctattcatttctccttgtatttttaattggtgttctttgtgtactttgaggtaatgttgtttagttatgtgtatgagttatatctgcatagtgaagtgtgccttttgaaatatgactcccttttttaaagtaacattttgtgtcttgcattttgatccagtataaatatttgcacccatctttctttgagtgtttatgagtaaggctttaactatcaatgttacttttaactttcctgagtcattttgattaagatgtgttttctttaaagaaaaataatattaatatgtgcttctaatagttgtttcaaagattaaatataataatacaattaaaacaaatagtgtagtatttgacatatagaaaatgctcaatgaataccaactaataattgcgtgaaaagcatgcattcaattttttttttttttttgagatggagtcttgttctgtgacccaagctggagtacagtggagcaatctcagctcactgcaacctccacctcccgggttcaagtgattctcctgcctcagcctcccgagtagctgggattacaggtgcccaccaccatgcctgtctaattttttgtatttttagtagagatggggtttcaccatgttggccaggctagactcgaactcctgacctcaggtgatctgcccacctcggcctcccaaagtgctgggattacaggcatggcattgaatttttaaagcaaaattgaaatttaagaattataattcaagactatagtctttattgttacatattttattttaggcattcttcttgacatctgctctcatcctttctagttttcatttgcttttcctggttctttcttgttaagtctactttacttcctcaggccctgtgctaaatgtgatggatgctgcagtgagcaaacctcagggcttacattgtagaaggaaaggcagactcaagtcaaatcatcactcaaacaatcatgtgaaattacaaccatgatacatgctttgggatacatgagagtagacttgcaactgtcaccttagattcatataacatttacaaagcacttttcatacattatgtcctgtgagataaattacagccatagaagatgtatcccttgaccctacatgattaaagggtagatggttaattctttcaaaacacacatttcttgtaccaaatgtcatgtaccactcactctcagaatctgtcattctgagaatacagagaaattttgcccactaatgggattcaacattttcatgggagaaaggcaatagaacattccatttcttaggtaaaacaaccaagaatgcgggctgcaactctaccactttgggggtggggggtggaactaccgagcgattagatgttcaataaatatgtattacctgtcttctattgactaagaactgtgctaagctgtgtagatacaatgaaaataagacatagttcctgtctcatggaccaagctacctatatgagaagttccatagtgaggaccatggaacacagaagactcagaaattggacagtagttggggacaattgtagccctctccatatattgaaatacagaaaagctatatcttttccgcagtcagaactgtgtaaagatggaatgagttttctgatgagaaaatatgtttttctcccaccggtgtgtggactttcaacttctttatctcctattatgtcaatgctagatgtcccatatgcgtgactttttaaagtgtttattataggaattttcaaatattcagaggggtgctaaaaataatatcataattatccatgtacccaatctccaacatcattaagcgataacatttatccaaatctgctttagatctctaattaagaagcaaaattttaaagatgaagttgaaacctcatttgtcaccctactgatcccattcttcttcctgcctcagagtttgtgtggccctaaagttgatgtcactctttttcatccatgttcttgtatatttactgcatcaatacatctgaattttttttttccagaaactttaaccccaaaccaccttcttgctcaaaacccttcagtggctcccaactgtctacaccaatgatccgcaaatcaagttatcttctgaatcttctcgggagtttcaaaattatatagattcttgggttgtccttggggactttgcaaattttcagggtttctcaactttcatcctgttgagactaggggctacataattcctcatggcagggcttgttctatgtctggtgggatgtttagcagtgtcctggccttcactcattaggggtctgtagctcccccactagttgtaagaaccaaaaatatccccagaaactgtggtattagccctgccttttattttctgtattctgaggctttgagacctagagcctggctcaccctgaaaggctgctcttcccagagttagccagttcctaggtataataaatatgattttcaaatacaaaccaatccatctggagcccacacaccaaccacctcctctattgggctttcacactgcaggccactctccacctgacctaataacctcagggccaggaccagacaactagggacagccccatgccccagagccactgaaattatccaaactagccaatcatgaatctgcttactcgcctcacctgttccttgttgcaggaaccccaagaaagcttttggcccacagtccgcactcccctgactcctgatcgattgaggtgtttccacacttggccctgtgtggtgtggcctgccttcactgtcagcaacaactttgttgtcactggcagctgccttctgatcttttggccttattacatctcaaattttcttcaatccccggtattttattttatcttatcttattttattttttgagacagagtctcgctctgtcgccaggctggagtgcagtggtgcaatctcagctcactgcaacctctgcctcctgggttcaagtgactctcgtgcctcagcctcctgagtagctgggagtacaggtgtgcaccaccacgcccagctaatttttgtatttttagtagagatggggtttcaccatgttgaccgggatggtctcgatctcctgaccttgtgatccacccacctcagcctcccagagtgctaggattacaggcgtgagccacctcgcctggccaatccactatgttttaaagcaattgccaactgtcttgctccagattgagaatgactaggttaatctgaaacctggaaatctgtatcttaaaaaaaaattatctaagtgatgtgagatcattggatttggggaccacgaacctttagactctaggcacaagagttgagcctggccttcatggcctctgacgatctagccccatcacacgtgtgttccttctcctctcttgccactcatgttgctgccttgccccttcgtctgcaaaactgatccttgaggatgtgctgatccctctcactttcaaacctttgctctaaatgcagactccggcttttccaatgacctcttagacttctaatctcacgggcatttttaaaaataatacgtttgtttactaaaggaattaactcaccccttcattgtgacacatctgaaacagttaaaacgctactctcatgccttaaagctttacaaaccctcatacaaatatgaggcagtaattacaagtttacactctcataacacaggctaaggcccttctctcagtttaattttgtatctgttgctatggttatttgattcccgtctctctcccacactagactaaagatttcccaaggtcaaagatcaagtctatttttgctcatatccacattactttacaaagtgtctggcaataaacatttggtgcacaaatgaattaattgattaattacccgactaattaattactatcttatgttgtcttttcaactggatttcaaacgcttgaggattatttcgcttccaagtttcctttcaaccctataaacatagttatgtttaaacggtacatattgaaacaataaatgattactattatctgaactacatagtgttatcagtagtactttactgagcctaccgacagaagccaagtactcattcgatttatgtttttaaatgagcagaatccctttgaacaaaaaacaactgcatttgcaaagaaatatgatgttatttatgaccattatgtcatcgcctattcagaaaggacagatttaaactgagtattagtgcctaaaaccaaaaagtatcctcccgtttgatgaatgtcattattgtcaggataattccaaaaattgaattgaactagcagaaagtgttttctgacattttttatttctgtttcatacacagagatgccttgtaacctgaggaaaacaaagtttgtttttccatattggtgttttccctcctcggtgtcttcatttcttacttacagagaagaatgctaggattttctttttctttttctttttctttttttcttcagagtgatacatgtgtgtgcttaggaaacactgacttgacagtttactgtgagaacgtggaattcccagcctcagccccaacccctgggcaggtggggtctagaagctctgtgtagacagttacaccccgggccatggtggggaggggatggccttccgagggttgaagagcaggagcagtgaatggcttattcccaaaagacttctctctgtcctttctgccttcatcattttaacacaatgaaaacctaattgctccccaaattttagatttagtttgtacctacagagcttggaacactgaaaataaaatactgaattacagacagcctgcaggcattctagaacagtctgtctacctctctcaaagaataactatgaagcagctcctcagggtccagggaatttgtccaccatcgtttatataataactgccagtgcagagatcctgaaaaaaagtctctgttctttctatgatgtacgaacttccttaagaaaataaacctgtacttcaaaatttatattccaaggcttgaaaacaaaagcacattgccgtttctcaaagcaagaaaagatttgttctaagtggctccagaagtgattgctgttcaaagagccgagataagaacccacaaccacttcacatcatcagcagacaggagcagttcacgccagacagcaggaatcagctcaaatccactctctgtccttgctgactctttctgtctggctcccagtcccaccccaacctccgtccctgcctgtatcccacggtctcttcctcttctctcactgacatctccccactttcttacctagtatctgactctccctcccttcctttctttcagctgttcccgccctctctcctcttttctgtgccccataacaattcttttctctcctttcttccttcctaccttagaactgtctgcatcactgtttaaggtttggatctgccattgatctctataaaattagatacactaaaaatagatgtacagaggcgccttgaagccaaagtggagaaatctaagaactctttctctttcactatatttgagccttctttatcattaataatggccacttagaacaccttagaatggatgtaccttattttgggaagttttctgagagtgggatttcccaccctctaggaattcaagatgcaaacactcaccctcctgttggtctctaataagcccaccatgcatttgctacaatgggaattggtttctctagagaatacatgagacaaacaggactctcaatgagtccaacagaagtgacagcccaagtgatagggacacaaggcagggaaattctgggcagaagtgggccagtctctggcgagggccccaccctcaagcctggaagtgtggcccaaagtgagaacttacattcctgttttcctgctcgaatgtttcctttcccaagaccacctgtgcccctccccacccccatcctgtgtcaataaaaaaccccaggctcagccagcacagataggagaagcagttggacatcagagactacttttggatgttggagagaggtggcttgacttcagagggacagcttgatggtatagcttcagagaggagtctggccagggacagctggatttcaggggaagattaccttcccactccatccccttttcagctccccttcccaccgagagccactgtcatcaacaataaaatttcctgcatttactaccttcaatttgttcttgtgacctcattccttctggagcctggacaagaactcggtgccacaagtgtgggtgcaaaaggctgtcacactgaccctccactgagctgttaatacttaagctgtctgcagacaacaaagctaaaagggtacgctaacactttttctcgggctttgggggttgtgggcaccctcccctagatgctggcatggggccattatggagttcgttcttgccagcacccaaaagtgcttaccctggctcctgcacctgatcacccgtgctccccctcctgcaaggagtgaagcagtgagtgagtggagtttgtccctgctggcacccatgcactccagtttccacccaagaatggggtctgggaaatatcctgcttcacaagcaccaagtttggtttgaaaaaccactaagttaaatggaagaagagggagtagaaagagcaggaaataggggttcaaggctaggccttcccagccaagagagagcgagccacagcacccagacacttcattgacagaagccctctcctcccagggctcttagattccctcccccaatctggccccaagtatacctctgccagccccttggaactctgcattggtgatccagtctgaaatttactgtgcagctcgaagctgaacaagctgatgaccacagcttcttccttgtccttcttccctgtccttgcccagcccaagtcatagcagttcacggatattttgaacaggacgagagcttcagcgtcttcacctgcctttatcactttacatccagagatcagcttatgaaagcctcataaatgaacatatgtataagcccattttgatgacagatcacttttaaacaacactttgattgagatataattgaaacatgataaactgtccatatttaaagtatactattggataagttttgacgtgggtatatactgtaaaaccatcacaaaatgtatcttatacaattaagataataaatgtatccatcacccataaagttggtttttctgtttgttttgggcttttttaatagactttatttttagggcagttgtaagttcacaacaaaattgagaggcaaatacaaatttctcttacatcatcgtgtccacacatgcacagcctgaccccttgtcgtcattctccgctggaatggcacattagttaccgctgatgaacctactttggcacatccctatcacccaggtccatagtttaattagggttcactcttgctgtcacacattctatgactttgggcaaatggcatacaccagtatagtatcatgcagaatagttttctgccctaaaagtcctctgtgcaaatgaataggataagtggagcacagatcactttttagtaaaatgttgcctggttttgatttgacaaagtaggcaacactgtcaatcactggagaggatgtaaaaatagaaaaaagatgacctgaatccaaatctctttttcattctgaagttcattgttgattccttagcctccccctttctttcttactctatttataaagtttttactttctaatacagcctgtcaatattttaaatttttttcattagcagcacactgcatagtgtggggaaaatatcattatttcaaagctaattgtacatataatccatttttacatacatgtagaccataagacagttcaaatattttggggtagtttgagctcaatctgatttcaggcattcgaaaccctgataacccagcagaaagttaatgctgggttataggatttggagtgcctgaaccatgccactgccctccccctccatcaatttgccccctcactggttctctttcagttcctgtacatgtcacgtattctcctccctcaaggcctatgcattttttcctttcagtttctaatgatgttcttccatgtcctttacctagatatcctcttcttaccttttatgtctcaaataaaatgtaacatctttcttgtgcaacacccttaactaaacttcctccctgttgttctatctcataccccttgtcctttccctctagaattgcaccatccagtaagtagtcactacctgcacgtgtgtgtttaaatgtaaattaattaaataacatttgaaattcagtttctcagcacattgcctgcatctaaagtgctcaataatcatatgcaattagtggctaccatattggacatgtaggtacagaagatttccattctcacagaagtttgcactggagagtagtccatctagatcatttagtatagttcctaattttacataaattttgtgagatgtttttgttcggtcggttgatgcttacctgcttctggactgtatattttatgcgtgcaagaattacaaaatattgatcagggctctggcactgaaagggtgttccatacatattttgggcatgaaagaatgtcatgaatcaagtccaaagccagtaagttgcaagaatacacaagagaggaaacaaatgtgcagatgggaggcaatgaccctcatatttccagctcctgttagcaaaaaccacgaaagtatacagagggggataaaaaggataccaggctgtccaattaacaatggagtaaaaccatgttttcccactctccttcctaaaatcaattaaaggcaacaagaagaatgaaaaaacgtagaagagaaagcctcgtgaaactgagaagcatctgcaaccacaaactacaaaatgtagctgctaaacaaaatgaaagttggatcaaagtggtggcaaatatcaagagtgaatatactccacggcagagtactgcaaatgtaagttccatcaccttaaaaaggccagccaatggctccttgctggaatgtctggatgtggggactgcttgggcactagaaacatctccaagtcccattccatgttatctagtgacagggagagctggcgctggatgataaattacacagacacagtatctttgtgaaaagccagtgctctgtatggcaaggtagagaggtggcagtcaccatctgctgaaatgcgatacacactaaatcccgttccgtaagtatgactacctgttacacacaggcgaactatgtagtcattcttagcggagaaagggggaggaaattgagctcttagcagaaacccactccaaagttcgaggaagagtgccttgtcccctgtaaaatgtcctcctgtactactcctcctccaattttttagcaaatgcttgacccaggaaaaaattgctcccatttagagataagtaataatcagaaaagagccagcctgagaaatatgcatggatataactggctggaagaaaggaacatgccaaacaaagccagatggaggctagacctcagaagaattactctgcaagcagaacaacagtacacacaaacatttatccagagtcaaagaactgatcatggtgcctgggaaatcagagctcagaaaagagatatagggatcaaagaagatatgataaggcaatacaaagaaataaatgtgagctgagagagatctggcgaaaatgcagaagagaaaaataatttaaagctaaagccatgctgaaattaaaataaatattgctgagaaagggaaacatggaggacaggctgagttagaaagaaatgaacaaaatatgtggaaaagccaaagagttacagagaaaataagacatagtgaataaatatgcatgtaatttgtgaacgcctccccaaaggaaactgaacaaatgtggcagaaataaaatatccaaacatatgagagaagacattttataaaacaaaggtagatacatgtcttatgattgaaagatcacactgtgtcccaagaaaaactgatcaaccaaaacatagccattaaattttttggtttccatgattacgtatcctataacatccagcaactcctctgtatagtctccccagcctctcaataaataaataaccaagcaaaataatcacatatatttttcaaactacctatggggcaaaagaaagaatcaaactaggttcaaagttctctatagcaatgtctacaactcctcagttaaggaatgggaccaaatgttttacagcaagacggacatatttaaatatgcaggaacaaaataaacataacatccttaagttcttgtgggaagaaaacaaagtatctgataacttaattgagattttcaagaggcaaatgaaaagacatgataaaagattgaaaatgtttgttaaaccaacttaaacaaagaattttgaaaactatagccacagaaaacaatgtaaatttttattaatgctgaaaaagtagaaaacataatgaaattttctatttggagggtaatcttttccttaaaaaatccttgtaggccgggtccggtggctcacacctgtaatcccagcactttgggaggccgaggcaggtggatcacctgaggtcgggagttcaagaccagtctgaccaatatggagaaaccccatctctactgaaaatataaaattagctgggcatggtgctgcatgcctgtaatcccagctactcgggagactgaggcaggggaattgcttgaacctgggaggtggaggttatggtgagctgagatagcatcattgcactgtagcctgggtaacaagagtgaaactccatctgaaaaaaaaaaaaattccttgtaaggtgaattatcaaaataaaaacataattataattgtacttcattcagttacaaataaaacatatctactcaatgtttgagtaattgaatctttaatttaaataaaaataaggcccggcacagtggttcatgcctataatcatagtgctttgggaggcgggaggatcgcttgagcccttggcattcacggctgcagtgagctgtgattgcattactgaactctagcctgggtgatggaggtgcgagatcctgtttctaaaaacatgaaaatagttaaaaattaaaaataaatagtaggcagggcgtggtggctcacacctgtaatcccagcactttgggaggctgaggcaggcggatcacgaggtcaggagatcgagaccatcctggctaacatggtgaaaccccgtctctactaaaaatacaaaaaattagccaggcatggtggcgggtggccgagtagtcccagctactcgggaggctgagacaggagaatggcgtgaacccgggaggcagagcttgtggtgagccgagatcgcaccactgcactccagcctgggcgacagagcgagactctgtctctaaataaataaataaataaatagtaaatgaccctcaaaatcagtacaaacaatgcaaataattcacaggatcatcaccactacaaactagcaaatcatggacctgccagggcttactaaaacctgtgcaaactatactactgagaacgtggctgcatagtggcgctcactatggctgagttgctcttaaatgtgcttgccaggagatgtctcataatctgaatttctcacatatcataattcccatgagtctcacgggaccatcttaggccataactttaacaaaatcagatagacgtgggcaggagagaagctaaagaaagtatcctttctttgatttccttacctttcatagaaaccatcaacagctactgtctgaagatgataaaaataaagatatatgcgtatggttagacaattgtatgaacatatgtatcagatggaaaacacacacagcaaaacaaatacccatcacaaaagaagaaaacaaaggaagtatatataatgaagtcattcaaaataaacatcaacgtgactccccgagtgacctccctaaataaatagcactccttcccataaccatgcttcttattcctattttcctactttattttttttccacagcgcttatcaccaccactgcatatttatttgttgttattatcataattttttgcctctcctaactagaaatcaattctacgaaggcagaaattctatttggttcactgctgtatcccagcatctaacatcgtacttagtatactgtcaatgctcaataaatacttttttaaagaaatgtatgagtaaaaacagagaacatgatacaaaaggaaactacagaaacgaagccaaacaaagataacataacaataaatgtgaataaaataaattcagctatccaaaggagaataatcagagtatgggtcaaaaacattaaccaaataaaatatactggttaaaatatgtaagctctgaagtaaaaatgcaaatttgatttccaaatcaaggtcttatcaatcctcttttaagatgacattctgaggctataggcagatcatctatgtaaagtaagacacacaagagtgcccagtacatggtgcacagtcagtaactattagtgggcaatggtaaaagcagaagtgagcttggttgtaatattggtgacagcagtggtaactcaaaccaaatgactttgtaagactgcaatgaaaagaatcagtgtcaatcagaatggctattattaaaaagtaaaaagaaaaaaaatgctggccaagttgcagagaaaaaggaacacttatacactggtggtgcgagtgtaaatcagttcaaccattgtggaaacaagacagtgttgtgattcctcaaagatctaaaaacagaaacaccattcaacccagcaattccattactgggtatatacccaaaggaatgtaaatgattctatcataaagacacatgcacgtgtatgttcattgcagcacgattcacaatagcaaagacatagaatcaacctaaatgcctattgatggtagactggataaagaaaatgtggtacatatacacagtggaatactatgaagccatgaaaaagaatgaggtcatatcattggcaggaacaagggtggagctggaggccattatccttagcaaactaacgttggaacagaaaaccaagtaccgcatgttctcacttataagtgggcgctgaatgatgaaaaacatggatacatagaggggaacagcatacactggggcctacacaagggtggaggaagggaggagggagaggagcaggaaaaataactaatgggtactaggtttaatactgagtgatgaaataatctatacaacaaatgtccatgatacaagtttacctatgtaacaaacctgcacatgtacccctgaactcaaaataaaagttaaataaagaaaggaaaagaatcagttatcatgacagtataaaagagtgagtctgttgtggtctggagactgtgagaaatattctccaaggaaattatatttaagctgagacctaaggatagatgggaactagtgggtggagaaaatggaaaacgaaatttgtgtatgtggtagggaaggagaggaatagcattctaggcatcagcaacagcacatgtgagcggaatacattgcagagaagtgccaaataccccagccttgggaaaaagtctcatccccgtaacacacactttagttaacagatactgcaatgggaatttttgttgttaatttattcaattgacttaacaaatacttacgtaagctcttatgtgccaggcactctaaatcagttgctgggaatagtaccaaggtatgcagagccccttggcctcacggagcttccagtgggaaatttttaaaaatagatgaaaagtaccctgggttttactatgaaaaatagcagagtgccacagaagcatatagcaggtaaacctaatctaattctggggtccaaaaattatcctagaaagcgtaacttttaggagaccactcaaaagaaaattaattgctcttaaggcgagtgaggaggaatgaacaaaacgttcgtgaaggtaccgaggtaaaagaaagtgtagcagttgagcatttgaaagaaatgcattatgtctgaaacaaagagaagcagagagagagagagaggagagcaaaagagtgtgagagagagaggtgcaagcagagagaagctggagagagagacaaggcatgatagcctgcattaaggattgtatttccggttgggcgcagtggctcatgcttgtaatcccagcactttgggaggctgaggcgggcagatcacgaggccagaagttcgagatcagtctgacaaacatggtgaaaccccatctgtactaaaaatataaaattagccaggcgtggtggcaggcacctgtaatcccagctactcgggaggctgaggcagaattgcttgaaccgggaggcagaggttgcagtgagccgagattgtgccactgcactccagcctggcgacacagcaagactccgtctcaaaaaaaaaaagaaagaaaaacaattgtatttcctaagtccataagaaatcattgaacacggattgactaatccatttttcatataatttgaaagattgttctggttattgtgtggaaattgtttggagcagccgaacatggaagctgcggaggccacatgtatttgtcagtgtaagttttgttgtcctatggtaataaatatcccccaaatctcagtggctcacacaataaaaatgtttttctcactcaggctgcacatctttcatggattctggtccacctcgtcctcacgcggggatgcagactgacaagcttccaccatgaagggttgtcatttgccatagcagggagaggaaaatggagcaaatcagtcaccagctcgtcatacagaagagtgtcccacgtcatatctgctgatatgttatggccaaagtacatgactatctccaaggagctgagaggtgaaattcggacatttgtctggacggagtagaaccaagagagtcgtaaacatcctgtggactacacaccgtttaacaagatgcaacagtattctgggtaagagatcatggagaggcatttatgaaagcatttttaaatcaaatacaattattacaatttgtcgattaattggatgtgagaatggagggagatggaagagtcagggatcatttccctgtgatggaaaggacaactggataaatgctgtaaagtgtcctgagttagagaatgtagaagatattttggagtgggagggaacattcaaacagagatgtctagtacatagctggaaatgagatcagaagagaggtctgggccgaataaataaattttagagcgtttgacatccaaaaggtacttgaaatcaatggaacaaagatttgtatgggagggtaagcaaatcattcttctttgagactttctcgattttggcactgaaagtcgtatgtcatgggaacattctcaggcttgaacaaactgcagtagttggtcaccctttgagagtgtgtgaataaaaagaacaccaagacagatttgtgaggagaaaacacgtactggtcaggttgaacaagaggggctgtcaaatgatactgagaaaaatagtcatgaagatagaaggcaagtcagaggaatatcagagacccagaaagcaaggaaacagtttcaagaaggagagagtgaggggccaacggggccaaatggtactccaacattaggtaggactcagattgcaaatgcccattgctgagggaccggaaaacagctgaaataggactcccagttgtttacgcagccaagcagagatcaggcagggaggggatggcttgtccaaacacaagaggctgacacatcaggaaggggtctgagcttgtcctgggtgtagtgaccagatacagtagatagcatggcagcttctcacatagcagaaaacaaatgatgcagatctaggttcttgacctacagttcactgcacacctcctcaggctgctggactgcagaattcaaaaggaattcatttaacacataagagaaatcaaaaaggatactcgccaattatatgaatgcaagacacggataaaactctcctttaaaggtgaatagagagaaaatagccagctggggcctgtggaacgactctgaaacataaatgaagataaactataagaaacataaagaaaattttaataaacatgatttttttctcagtataattcaagaaagcatgaatcagttattggggtttttcctatagagttgtagaaattccttacatattttggctattaactccttattagatatatggtctgcaaatattttcttccattccacaggttgccttttcattctgttgattgttttcttagctgtacagaagctttttagttaatataattccacttatctatttttgcttttttttttttttttttgcctgtgctctcttggtgtcttatagaagaaattattgcccaggccaacatctagaagcttttcccccatgttttattttaatattttatttatcatgtcttacatttaagtctttaatccattttagtggatttttatatgtgtcatgagatagtgctctgatttcattcttttccatgtgaatatctcattttcccaacacaatatattaaagagattcttttttccatagtatattcttggcacccttggtaaatataagttgaccatatatgcctgggttccgttctgggttctgtattctatcccatttgtctatatatctgttttgatgtcagtaccacactgttttgattactgcaggctttgagggtctttagtgtttccaaatgaataataggattttttttctatttctgcaaaaatgccattgggattttgttggagattgcattgaatctattgattgatttgggaagtaagaacattttcttttcttaattttttaagctatctcctacaggaaggaagaacattttaacaatattaattcctccaatcaatgaacatgaaaaatatttccatttgcgtcttaaaaaaattttgttcatgttttgtagtttcgagtgtacaagtctttcactgtcttggttaagtttattcctaagtgttttgggttttttgatgcgtttgtaaatggagttgtttcttaatttctttttcagtctgtataaatgaaactaattttttgtatgttgattttatattcttccacttcactgaatatgtctataagttaacaatttctctctctctctctgtgtgtgtgtgtgtgtgtgtgtgtactttagggtgtatatatatatatatatatgactatgtcatctgcaaacagaaatcattttacttctgcctttccagtttggatgacttttattttttttttcttggctaattcgctggtaaagacttctagtactatgtaattgaacggaagtggcaagagtggttatcctggccttgttccagatcttagagtgaaagacattagctttttacccttgaatatgctgtcctggccttgttccagatcttagagtgaaagacattagctttttacccttgaatatgctgtcagctgtgagcttgtcatatgtggcctttcttgtgcgcaggtaagttcctcctatatgtaacttattaagagtttttatcacgaagtgttcaattgtgtcaaatacttttttctgcgtctattgagatgatcatgcgatttttatccttcgttctgttaacgtggtatatcacattgatttatttgcataagtagagccatttttacatccatgggataaatcttacttggttgtgatgtataatttttttaatgtgctgttatattcaatttgattgtattctgttgaggggttttgtgtctgttatcagggatattggcctatagtttgtttgtttgtttgttttttcttgaggtgccttcatctagctttgatatcagagtaatgctggcttcctagaataactttaaaagtgttcccttttcttctatttttggaatagtttaagaagcaatagtattaattcttctttctttctttggtaaaattcacctgcaaagcttactgcaaagcttactggtcttggacttttctttgttgacagtttattatcattattattattccttcaatctccttgttattttgttttgttttgttttttgagatggagtctcgctctgtcgcccaggctggagtgcagtggcgcaatctcggctcactgcaagctccgcctcccgggttcacaccattctcctgcctcagcctcccaagtcactgggactacaggcgcccgccaccatgctcggctaattttttgtatttttagtagagatggggtttcaccgttttagccgggatggtctcgatctcctgacctcgtgatccgcccgcctcggcctcccaaagtgctgggattacaagcgtgagccaccacgcccggcgaatctccttgttttttattggactgtttaggttttctatttgttctttattcactcttggaaaagtgtatgtttctaggaatttctccgtttcttttcggttgtccaattggttagcatataattttgtataatggtttcttatgattcttttctatgaaatcttttgtaatgtttcctctttcgtttctgatattttaagtctttttttctttagtcaatctagttaaaattttattagttttatttattttttcaaaataccagctcatagttttgtcagttttttaaaaatgttttctattttctatttcatttatttctgctctgatctttatttacttatttatttatttttgctaattttgtatttagtttgttcttatattctggttcttcagatataattaggttacttacttgggatctttctttgttataatgtaggtgtttattgctggaaacttccctcttagaactgtttttgttgcatctcataagttttgttttgttgtgttctcatttttgttgtctcaaaatattttctaattttcttttgacttcttttttgacccaatagttgtttgagagtgtgttgtttaattttcatgtatttgtaaatttttctgtttttattctatttttttatttctcgtttcattccattgtgattggaaaagagacttgaaataatttcaatcttaaattcttaagacttgttttgtagcctagcatgtgatctattttgaagaatgtttcctgaacacttgagaagaatgagtattctatttctgttgcactggtctagaaccagacccacaatatctctgatgtatgtctgaatacttatcttgaataattcctctacatagattgagaacctcattagacagtgttacagctttgtgcttcaactgtcaacatatagaaaactcaagaggagaaagtctattgtccttatttatatttttgctcatgtataatttcttcctttctaatgtactgagtctttcttttattctgttctttatgtttagagaactttcttgagtcattttttagggtaggtctgtgggttttaaattctcttagttctcttctatcttatgtctttattttatctctattcctgaagaatattttctctggatataggattctgggctgataggttgtttttttttttttttctttcaacatttgaaaaatattgcagcactttcttctgggctctgtgattattgaagagaaatctactgttatccaaactgtttttcccatataaccaatatgtcatttctctctcaatgctttcaaaaatttttctttgtatttagtttttagaagtttcactatgatgtgttttgatgtagatttcttacatccattttttttttcttttttggtcaatttgggatattttaagccattatttcttcaaatactttttcggctccactgtctttcttctccctttctggaactcaaataatactaatgttacatctttattatagagccatatacccttgaggttgtgttcttattttgttttcaatctattctctctttgttgtttagagtggataatttttattgttatgtcttcaagttctctgattctttcttctattctcagttctgttgttcagtccatttgttcagttgtctattttggttattatatattttagttctaaaattcccatttggttctttttatcttatatttctttgttgaaatgttctattattattatctttttttttttttttttttttttgagactgagtcttactctgttgcccaggctggagtgcagtggcacgatctcagctcactgcaagctctgcctaccaggttctagtgattctccctgcctcagcctcccgagtagctgggattacaggagcccaccaccacgcccagctaattcttgtgctttttagtagaaacggggtttcactatgttggtcaggctggtcttgaactcttgacctcgggtgatccacctgccttggcctctcaaagtgctgggattataggcatgagccgtgcctcacctgaaatgttctattattttgctaaaaagttctttgctcttggtttgataagtgattttttttattgaaaccagtatattttgtgcatcatgatacaaaacactggatcttttttaaatcctattttagcaggtcttctctgacaccactctagtgaatgaaaggggaggctgcctcatttctgcgggtaggcttgaaaggtctggcttctcttctgttgacacgttgcggccaagggagaggattcctcataacttctggatggggatgggagtcgaggctcccactaggaattctctgacactatcccagcaaggagggcacctcattactattttttttttttttttgagacagagttttgctcttgttgcccaggctggagtgcaatagcacaaactcggctcaccacaacctctgcctcccaggttcaagcgattctcctgcctcagcctccagagtagctggaattacaggcatgcgccaccatgtccggctaattttgtatttttagtagagacggggtttcttcatgttggtcaggctggtctcaaactgtcgaccttaggtgatccacccgcctcagccttccaaagtactgggattacaggcgtgagtcactgtgcccagccctcatgactagtctttacatggcctccactgacaccatggagaggggagtaggtggccttgtacccagtgagtgggatgaaagtcctgaatctgtattaagcttcttttgataccagctgacaggggtattttaacctggcaacacactctgggctcttcagttggtctttattgcagagtatagggtataattacagttttttctgtgacatttcgctggagtgggaagttatcgtctgaaagttttctgtcttgtaaggttgactcttttctggtccattggctaatgagaacaggctttcattatgatcgcgcgcacgcgcgcgcgtgtgtgtgtgcttattggtggtttctgggttgctggcttcttcacttccaagtttaggatacatgaggcaaaaaaaaacaaaaaacaaaaaacaaaaataaaacctgagggactcacctctgcgtcattcattgggtctctgcatctttagccagtccctcctctccatccttgagacttttattttgtttcttttgtacagaatatccagaatttttagttgcacctagcaggaagaaaagggaagactatgtctactccatcttttcaaaagtggatgcccaagctgtaataattttagaatgtaaaatattaaagtgtcaaatattgttaacagaaatagatataaatcagataaaaaccacttaaaatcagtaagaatcctagccaattggaaagagtagaattcgacctctgcacatacaatactccaaaattaattccagatagattaattgtataattaattaattttaaaagtgaaataatatataggagaaaatataagcacattatataatcagagaagtgaaattgtaacattctttacacaaataatggttgtctttaatatgtaaataattcttacaaatcagtaagagaaatatgactactataagcaaaaaataattagagaaaggcccaaacagatgatttgcataaagaatacaagtacctaacaaatatgggaaaatgctcttcttttcaaataattgaagaaacaaaaattagacaaattaattccttcgggttttagttcggtttagtttggttcctttttggcttattcatgagcccttcaaataaaatgaaagcaattttaggtgggtctgagctgggtcctaccttgcaaatccagctgtgatgggaaccaaagtaatacaatctttttggcaggaactttgccaataagtatcaaaaatcgcaaacatcatcattttttggaccaaataatttcactttgggaaatttatcccaagaaaaagatgattaacataaagattcatggagaagaatactaataacataagtattaatagtggtaaaaggtaaaaaactaaaaatcctaacaaagaagaattggataactaaagtgtggcatattcatagaatagaataccatgtggttattttaaaccatgttgtataagaatacttaatgccacgggaaaaatgctcataatttaccattaagtaaaaaatgaaagtcaaactatacagtagtttagacactaatgctactttaataggtaaaaatgttcacagaaataacgtattaagaaaacacacaaaaatattagcacttgaaaattaagtacaggaatcatgatgtattttcatttttcttctttgtattttttaattttcaaaatatattattacaaagcatacttttatatttaaaacaaaacaataaatgtatgtgggggatgtctggggatgccttcagctgcttaatgatgtcatctgagacgcaggctctttctaacatttttattctgccatccttagcattttggttttccttgtcacgcttgttgctgcatcattataagatagctatggcacctatagatatcacaaatgctccaggctggaagaagaaagagagcccaccctctgcatctatacctcttttgatcaggactatttgtcagagacccctttcaacagattttgcttacatcccctatgaacatccaaagctacaaaggaagccaaaaaataagtatgcagttttgcagactcttagactagatcatgacaagaaagaagggaccaggaatggatgctgagtgagccaactgcagtttttacatagtatttttatgtacaaaattaaaagcatattttgtagagtgcatggattgaatgtagtgataaccaaactatgcaagaattgtgctttgcaggccctgtaaaaagcattttgtgacatctgaccattaaaagaagttaggagatgtacttgcaaactattcaggctctgatccctacattgcaggagtctgacactataaattgtacattttcatactgagaaaagattagaaggttgatgtagggtacgcatgtcttaaccatcaactcattcacaggcactttgttgtatggcatagggaagagccctttcaagctgtgtttggttacatgaaacctaagtcagccatccagtcattgtagaaaaaaaaatcatcaaaaagcaagattcgtcatacaactgaaggcagcaagctgttggacaaagagcaaacaaagcctgtggaggtcaggagatctgagcgttccatcaggttctgccactaaacagctgtgtgcttttgtgaatgtaattaacattgacaaatttcagtttcttaatctataaggtcaggggtttgcagaaaagattgcttagggcactttgagcataaaatggctatattctattataattgatatcttataaaaattactaactgcaaaggtaatgaatcacattaaacctctcactgtgagttgacaggaaggaacacagagagatctggaggaacagagatgggcagagtcactggctctgtgtcagctgctgtcatttgtggtagatggtacattccacagaggaaatgcaacacatataaacctttagaacccactaaaactctgtcaacattatttttgcataattggaaaaatgggtttgcagtgcaatatattgagcccacaccccaatttcaagacctggtgtccttgttgatttaatttcacaaagcaaaaaagaagatacattaggagtgaaaggaatcacattggtggggaagttgttacaatagtcactaaagtctttcagtccaggaatcagaggccatgcaaatgtatcaacgttcaggttcagatgaaagttatggaaagttgtggttgtcagcacaggttgtgatggggttggaattcttgctccaccatttagagctgtgtgacagtcttcaagttacttaccacatctgtgcctttgtttcttatctgtaaaattagggacaatatttgcacatatctctgagaactgggtaaaatttaaattttttttttagtccagtgcctggcctctaggtacttattatcagagaggtaatttttaattctttaagtaactcaatgaatttgcaactaagcttataaactgttaggtagttagtaacttgtggtggatttcttaatttggggaataaagtttctctatgcagaaatgtatgaaatggcaaaagtagaaagcctaccataaagcttaagggacacttttactggaataccttttaggagactcaggcagttttgcacagagctgttgcctgcaaccctgagccgcttcctagtacagctctgctcctgggtaaaaggcaagagacaagagagctataaactctgtgtagtgcaggaatataaatgtatcattgtattctgcttggactatgtccttcagcaaagtgacaatttaactgaaagtggtcatacagacagaactggcaggttttccactattgcctattcctatttctcttgctggaaatcgctccaggatccttaacaggtggtctgcttctagtccctaaatttggaatgtcaaaatggattctcagatcaatgggggaaggctgggttgttcattaaatggtgttgagacagctggctaagcatttggaaaaacaaagttaggatcctatctcaaaccaaattaaaccacaaatgggttcaatgtttaaagaaaggcagagagatgaaaatatcagaagaaaatacaggtgaatagcaaaatagctgtattatagggaaaggtttcatgactataatactaagagcagaatttatatttataatgggaaaaataatcattgactacattaaaaatgtaaaacttccctttatatatataaaaactactatggagaaaataaggagaacagaaccttaagaaaagtcactttcatgtatcaggttaaagggctactgtcctgtctgtggaaagagctcttataaatgagtgaggaaaaagatgacccgtccgttcccctctccccgccccacccccaccaatgtgggcatacccataaatataatttttttaaaaaagtcaaaagggtaataaacatgaaaaaatttcagcttcacatgtaatcagccacttctcatgtatcaagttgtcaaagatgaaaaacaacaaaactccacgttagggaaagaaatggtcggcaatatgcagttgcagacatgaatgctggcactacaaatacacaaaaactagggccgggtgcagtggctcacgcctgtaatctcagtactttgggaggccaaggcaggaggatcacctgaggtcaggagttcgagaccagcctggccagcatggtgaaaccccatctctacaaaaaatacaaaaattagctgggtatggtggtgggcacctataatcccagctactggggagcctgaggcaggagaatcacttgaacccaggaggtggaggttgaagtgagctgaggtcgtgccattgcactccagtctgggcaccaagagtgaaacgccttctcaaaaaaaaaaaaaaatacacaaaaactttttggagagcttttgggccatgtagataatattctcagtgaaaagtctttgacatcttctagtatgttacccttagaaaattatcaatcacatgcttggcgatttagatctaggagtatcatcgcagcatagtttgtaatttcaatatagaatgttaaggagatatctgtcatctgaggctggttaataaattaagacttagtctacataactaaatactatgaaactttttaggaaagtaagttttaaggtagcatgatgtccgcacatgaaaaaaatatataaaacgggtatagtacaagtcatatttgtattaaaattctatagcttgttatgtttggtatttttaacatatacatggaaaaatatgaatatatggttaaaaataagtatcctccagtccaagaccccttaaggctgtcaaggtcataaaaaaagcaaagaacaactgagaaagtgtcatggatgtggaaagacataaaaattagaatctagtgtcgttccctggattggaacctataacagaaagaggaccttaatggaaaactggtgaaatctggagtttcatcaatagtaatggaccaatgtcaggttcttggttttgacaaatgaaccacagtagcataaggtgtgaacaatgggagaaacggggtgaagggcatatgggaactccttataagctatctttgccatttttataaataacaagtttacttgaaatatcaagccatttggccgggcgcagtggctcacacctgtaatcccaacactttgggaggccaaggcgggcggatcacctgaggttaggggttcgagatcagcctggccaacatggtgaaaccctgtctctactaaaaatacaaaaattagctgggcatgatggtgggcacctgtaatcccagctacttgggagactgaggcagggagaattgtttgaacccaggaggcggaggttgcagtgagccgagttcgcgccactgcactccagcctgggcgacagagcgagactccatctcaaaaaaaaaaaaaaaaaaaattaaacctttcaaaatgtgtaaccctgaggagtgagatttgagtatgggacataatgactttcagattctatgtggaaaatgttgtacaatgaccacacatattacataataaaggatgaactgacataaaaaaaattgtagaagtatatttgtgaacatggaataataaaaaagcaaattataacagtataatcttacttaaatatattttaattacttgcttttgctttcatttatgttccaatttttaaaacaaatatacatttcttataggacaaagaataatttaagtttaaaatatccctggaagtagatgtggggcaggcagaatccccaaatctccagtcttgcaagttagaatcgggggtttcctgatcctgtacctgctccttaaaactctggggccacaaaaagcagatcgtctttgttgatggggactctggctctttattccagtaataaatttaaatgaatatcccttttttttaactatgatccaacacatcttgtctgtgcttagattattctattcaagacacaagggtgaaggtattaattaaaaagaaaaagaataatttaacagtatcaagcattctttcctgctgtgtaggttatttataatatgattttcagagagaataatggccagttaaataagagaaaatacaaactcactacacttaaaccctgctaatagaaaattgaagacaaaatgtaaacaagcattttgccttttttcatgtttatcacataatcacagcactgccatatttgggaaaaatagcctaatatttgaatgcaaattctactgatatttattgtaatattttggacacatatccacataatgcaagattttcatgtatttgtcttactcagaaatgaatttgctggatggtttccaagcagtaatttggatttataagaatgtaaatacattatgattgagttcccagtagcatttaagctcatggatattaggcaatgcctgatgccaagcaacttcggaagccctggagactcagcggctcacagccctttcccacgggccacccactctcgagggccatatttccaaatgcatttctgcgagtctgagagacttgaggatttgcaagggccttcctcacagacacagtggcttatgcccacttcacccagtttctcgcattgttcacaccttacgttactgtggttcatacgtcaaaaccaagtgggagttaccagtgggtcaactggtcattataaaatggagaatgaagtgctgtaattggtgagactataagatttcatgggagcgcaaaagagaagcaccttgaaacctggacccctggggacaggggtggccaagatacaggctggccaagatacacagtccatggaacgtgaggctcggaggaagcagagtcatttcccaggagaatgggagaccagggagaagagacggtgctccaggcagaggtgactgcacctgaaagggcctggtgagggaggggagtgagcgtggtgggtctaaagaactggacagagcccccgccagaccacaggatgccaagaggtgggtgagagccagagcccagcgggaggagcagccccatcacgaaaggccttgaacaccatattaaggaaattggattttatttcatggttgctgtgggctaaattgcgcctccccaaaactcatatgtatggaagccctaatgctatagcacttcagaatggaactgtatttacagataggggccttaaagggctaacccagttaaaatgaggtcatgagggtgggctgtagtctgatctgactgaagtctttttttttttttttttgagatggagtcttgctctgtcgcccaggctggagtgcaacggcatgacctctgctcattgcaacctccgcctcccgggttcaaacaattctccctgcctcagtctcccaagtagctgggattacaggtgcccatcatcatgcccagctaatttttgtattttttaatagagacagggtttcgccatgttggccagactggtcttgaactcctgacctcaagtgatccgcccacctcggcctcccaaagtgctgggattacaggcatgacccaccacgccggccctgactgatgtcttcataggcaaaggaaattaggacacagacacacccagagggaaggtcacataaagtcgcagggagtatacagccacctgcatatcaagaagagaggcctcagaggaaactgacaccttgctcttggactcccagcctccagaattgtgagaaaataaatttctgtcatttgaaccactcaatctttagtactttgttacagcagccctagcaaactcacgcaaaggacaatcaagtgtcctaaggaaaggcagggggcaggggaaggatggttagattcatccttttgaaagattactggctggtgggcagaatggataggagaaggtagagttgggggcaggaagttcaaaagccctttaagtgctagacaatggttgcagctgctatggaggtctgtgcaggctgaatttgcacaactctggggggtgccttctaaatacagacatgcctcagagatgtaatgggtttgttccagaccactgcaataaagcgaagattgcaataaagtgagtcacacaaagtttttggtttcccagtgcatataaaagctatatttacactatattgtagtctattaaatgtgcagtagtgttatgtctaaaaaaacaatgtacataccgggccaggcgcagtggctcacacctgtaatcccaacactttgagaggctaaggcgggtggatcacctgaggtcaggagttcggaccagcctggccaacatggcgaaactccgcctctactaaaaatacaaaaattaactgggtgtggtggtgggtgcctgtaatcccagatactagggaggctgaggccagagaatcgcttgaacctgggaggcggaggttgcagtgagctgagatcacgccactgcactccagcctgggagacacagtgagactctgtctaaatggaaaaaaaaaaatgtacataccttaataaaatatactttgttgccaaaaagtgagaatgattatctgaaccttcagtaagtcataatcattttgctggtggagggtcttgcctcaatgttgatggctgctgactgatcaaggaggtggttgctgaaggttggagtggctgcagcaatttcctaaaataagacaacaaggaagtttgcctcattgattgaatcttcttttcacaaggaatgtctccatcacatgcaataccatgtgatagcatgttacccacagtagaactactttcaaaattgaagtcaattctttcaaaccctgccactgctttatcaactaagttgatgtagtattctaaacattttcttgtcatttcaacaaagtttacagcattttcattaagagtagtgtctatcacaagaaaccattttctttgctcatgtataagaacaactccacatcctttaaagtttgatcatgagattgcggcaatgcagtcacatctgcaggctttacttttaattctagttctcttgtatttaccacatctgcagtgacctcctccactatagtcttgaacccctcaaagttatccaaaagggttggaatcaacttcttccaaactcctgttaatgttgatattttgacctcctcccgtaagtcacaaatgttcttaatggcatctagaatggtgaatactttccagaagcttttcactttactttgcccagatccatcagaggaatcactatccatgacagtgatagtcttacaaaatgtattcttaaataagatttgaaagtcaaaactactccttgatccatggactgcagaatggatgttgagttagcagccatgaaaacaacctttgtctccatcggagctcttgggtgaccaggtgcattggtcactgtcaatgagaagtagtgttttgaaaggaattctttttttctgagcagtaggttccaatggtgggcttgaaatatttagtaaattatgctgcaaacagttgtgctctcatctaggctgttatttcatgtaggaagcacaggcagagtagatttagcataattcttaagggccctaggattttcagaatggtaaatgagcatttgcttcatcttaaagttgccagctacattcgtccctaacaagagaatcagactgttctttgaagctttgaagctagacattgacttctcttctctagctatcaaagtcctagatggaatcttcttccaacagaagcctattttgtccacatgcaaaatctgttatttatttatttatttatttatttatttatttatttattattttttgagatggagtttcactcttgttgcccaggctggagtacaatggagcgatttcagctcaccacaacctccgcctcccgggttcaagcgattctcctgccccagcctcctgagtagctgggattacaggtgcccgccaccacaccagctcattttgtatttttagtagagatggagtttctccattttggtcaggctggtctcaaactcccaacctcaggggatccgcccgcctcagtctcccaaagtgctgggattacaggcatgagccaccactccgggccacaaaatctgttttttaatgcagccaccttaattaatgatctcggctggatcttctggataacttgctgcagcttctacatcagcactgtctgcctgaccttgcacgtttatgttaggaagacagcttccttctttgaacttcatgacctaacctctgctagcttcaaacttttcttttgcctcttcctcacctcttttgagctttcatagagctaaatagagttagggtctttctctggattaagctttggcttaaggggatgttgtgggctggtttgatcttctatctagaccactaaaactttctccatatcagcaataaggctgtttcgctttcttatcattcaagtgttcactggagtagcatttttcatttgcttcaagaacatttaccttgaattgacaagttggctagctgtttggcacaaggagcctaactttcagcctatctcagctttcaacgtgccttcctcactaagcttaatcatttctagtttttgatttaaagtgagagatgtgtgactcttcctttcacttgaacacttacggaacactgtagggttattaattggcctaatttcaatattgttgtgccgcagggaatgggtaggcccaaggagagggaaggagacgggaactgcaagtcagtggaacattcagaacacacacatttatcaattaagtttgccatcttatatggtgtggttcttggcaacccaaaacaattgcactggtaacatcaaagaacactgattggccaggcttggtggctcatgcctgtaatcccagcattttgggaggccgaggtgggtggatcacgaggtcaggagttcgagaccaacctggccaacatggtgaaaccccgtctctactaaaaatacaaaaattagccaggtatggtggcacatgcctgtaatcccagctattcaggaggctgaggcaggagaatctcttgaaccctgtgaggcggaggttgcagtgagccgagatcatgccactgcactccagcctaggcaacagagcaagactccatctcaaagaaaagaaaagaaaattactgatcccagatcatcagaacagatataataatgaaaaagcttgaaatattatgagaattaccaaatgtgatacagagacatgaagggaacacgtgctgttggaaaaataacatcaatgggcttgcccgacacacaggtgccacaaattttgaatttgtaaaaaagcacagtatttgcaaagctcaaaataaaaaaaaaaacccaaagcacaatacaacaaggtatgtctatggatgataatacaaatcatgtgcccacaggtcacacaatacacacgttggcattgcaagcatattcgagataccactaatgacaagcataggtaaaggaattgggaagaaatgcatagattcgagagaaacttagaaaatagactgaattgtgtttgaagattggttggatactactagtaagggagaagaaggagtaaagcatgaagctattttcagtcttgggcaactgggtgggtgggggcactggcccatgaattaagaaaccaagcaggaagatctgtgtcggagaggataattgagtctgttttggatttgagttcgaagaatcaaaaggagctcttcaaattgagattttcaataggaagttgaaaatatgaagattacagacctttacatgcatcatgatttttcatgatttaaatagcctaatattttaaatcatgggggttgataagaactgaaggaatactgtgtaaaataagaaaagaacataaaaaggggtcaggcatggtggctcatgcctgtaatcccagcactttgggaagctgaggcaggcgagtcacctgagatcaggagtttgagaccagcctggccaacgtggtgaaactccatctctactgaaaatgcaaaaattagctgggcatggtggcatgcacctgtaatcctagctactcgggaggctgaggtaggagaattgcttgaacccaggagatggaggttgcagtgaatcaagattgcaccactggattccagcctgggtgacagagcgagactccatctcaaaaaacaaaacaaaacaaaacaaaacaaaacataaaagggaaaaaagatgccctcttggcatccaaactcttaagtcagaggttcattacaggacttagcgggcaaaaataagaaaaacggtgttgcccattttcttcccctcttctacctacctgctggttccaggcacaggtatctcttcatgttcttaaggcttgagagtaccctgaaagcagcagcagtgaatgtgtggggtgatctcattcacccagcaaatatggggtatctacagtgtgtcagatactgtactaagtttctgttgatcaaaaaaaaaaaaatcatacttctctccattctcaaaacaattcagatgcttggggtaatgcatggaccccagaattataattctagtggcattacagggccttcagaattgtaattccagcatcagaatggaagaccaagatcgggtctttgtcagtgtcctggggataatcagaagatctctgcccaacagattcacatgactgtcttgctaaaggaggttaattcattcaaagatgggaagtgggagaatccaagaaagttcacttcctatattccctgatcctacaccttgggaactttttttgcccagcagatatctttgatgttacattttcttgcctctcttagctctgagtgtcaaaaaaatatattttcagttttgaggggactgtttctaacacacttccttcactccttatatagggtatagtgggcaatatccatccatcctttatgagtcaggtcaccttataaatatcaattattaaactgagtaatcacgtagtgatgtctcattgacctgagtgctaaatggctatagattgagatgctcttggtttgtcttttgtctttttcctttctgacacagagcatttttctaagaatcatctctaatatgaaaactagaaaacaaaattggcaagcttgggaggctctggaatatctgcagtgtatgtacaataatagaaaatagactctttgtaagggtctttgcatgaaattttgggcatggctactgaaacacctatgtagatatacaggggtgctttcattcattcatttttgcttcctcctgaatacatagctgaaattgctttaagaatatatatggatttgggaaaagcaaaaaacaaagccactgccccggctcctacattgtcacacctgatcaagggataatagctgaaggttgtgcttcgcaactcagagtcatacggcacctgtcattatctaagctggggttcagatgatgctagttatcacccactctccagatatttgtttttattcattaacatgcctgagtgtttttgtctagttattgagaaagatgggtttagaaattaggcttcgcaacaggacaggctgggacagaagaggccttcagccgaaagcatgatttgtgcatacctaggaagaatccctttgggaccacctgaaagtgaccaactaacaataggaaaggaggttttattctttctggagctcacagtattataatttgggcatagatgtggatgtaacctcattcccagccccaggctggtgaggcctggagatatttgggcaacatgagataagtaaatatatattcaaatccttctgggaacctgggataagatagtcttgcttttttaaaaaaagaatacttgtaacatgaaatagctatttatgttgatatttgacttaagatggcagtttgttcagcttagttactccatcaacagcaaaaaaattcatatgtaggagattataggaaagcaggaagatttactgttttggcaggaaaaaagggaaaacaccagccatgatcaagaagtcaacaatccttaacagagttgtaaaattcagttctggaagcaatggcggaattcataactagttattcaatctatgtccttgtaacgggacggtcacgtcaaaggagaaactggacttggatgggagaaaaggtttgaagtgatttctcacaacgttaagtcaaatttgattccaaagcattccaaggggctatttcaagtccttttattgttttatacttgttcaataccatttcaggccaaatgagaatgcatcaagaaagtctttgtttacagagatgggagagatgcaacaaagtcctatcaagtctgtaaggagaagaaaaatccacaggttggaattctaggaaacaggctctacacagatggatgtgtcacctgcctctgtttacccatcttactttaacacagattagctgcctaaaaaacatccaggtgactctactgggtatagacatcttgtgtgcagttcttacaaatcagttctagggaaaacaaagctgactgtcaaaagcccgttaatagcagacaaattcttctgcaatccttcaagcaatgtttctcaactgtgatgtacatacatatctcctaggaggtattgcaaaaatacagattctgattcagaaggtccggggtggggcctgaaatttcatatttccagatgaaatgctgttggtccaagtcacaccttagcaagttgactgtttctataccatccatagatggagaaaaatctcaatgccctttctcatctagaactgtaggaaaaagctattagctagagaagcaatgattgtccttgtgtagaatatgggtttaattctaggctgcctgcccttgatggatgagccttataggtaatcaccaatttaaaataaagaaagatcagtgtataattttgtagtccctgtcatctgtcacagttataaaatgccatgttgtgaaatgctgaatttactcagaacccccccagttactggcaaagtgtccatgctaagtttctaatttcaaatatgctttgttgaaaagcttagaaattgtatcacttcatggaaaagagagcactgagaaattatatgacttcatggaaaagagagcaagcactgcactgagattcagaagacttgcaatacagtctcagttttgtcattcatttgctgtgtgacattgagtcatgccttctacccttctgaggctcaaatatgaattaaatagcgccaactagatgccttctaggaatgctttcaactctaatgttccacgtgctatataacatatggaaacataatttaagttctcactagcgatcaggaagttgccttgttagtgggatgcggttcatcattagtgttaatatctctggttttatatcagtgagaacaaagaggtgagagtgtaatagttgagagcactggctttgaagtcaggcagagttgggttcaaatcctgctgcctcatgttctaggagtctcatggattacaaaattgacttaatttgtctgaagttcagttaggtcatctgtaaagtccgatctgtgaaatgggtaagaaaataaaccagcctctttggaatattgtaagtagagtggcctaatgttgtggtttgacgggaactgagggttttccctggaaatgggactttcagtgctaaaagcagaacagttcgaggcaaaccgggatggttggccaccctacagtcacaagtgtcacctgagataaacctgtaaagcacatagaaaatattcaatggacactagccatggttgtgaatagcacataaatatagagatatcagggtgaatttttttttttttttgagacagagtttggccctcgttgcccaggctggagtgcaatggcacaatctcagctcactgcaacctccgcctcctgggttcaagtgattctcctgcctcagcctcctgagtagctgggattacaggcatgcaccaccacgcccggctaattttgtatttttagcagagacagggtttctccatgttggtcaggctggtctcgaactcctgacctcaggtgatctgcctacctcggcttcccaaagtgctgggattacaggcgtgagccattcaaccagagcacgacccaactttgcctttttgactctagatttctactttttaaaggttatatggttttctttcttgagaaacagagaggactgtgtaaatgtgacatatcaagccatacaaaatggctgcctttctgcaaaataaaatttgaatcaagggacagaatagcctcttaatgatgagccccctacaagcctggtttggggatgctgatgtggccacaggcagacataggcagcactcagcagctctgatggatgcaacaccagccaggaatgtgagcagctgtcctttctaaccccgatgtcatttgctgaggcaatgccaacttccttctcttccatcaaaacattccagagttcatccttgtcaggccatatacagatatgtctcctacgatttgcataaggccattgtttctggaatttggggattttccagctagaatgtctcacgtatgctattctgcacagacaattgaagagaatgcaggagccaaattcccttgttatggctacttctgccctctaactggttctcctttgggagcttctcttctcttcctttctactctctgcccacctgggctacccactcctctgggctcaaggtccaatcaaccacacacaaagcttcaattctggttgtaaagctgtcagtcacaccagtttctcatattttctgtctttgattactcttagtgttatttcttctctaatttctcctgtggtttattaactgcaatgttgtcaacttcatcccagctttaggtgacctggaaactataacaggacaacaggtgatctgtcctgcttgtccaggacagtccaggattgcacctgttgtcccaggttactaattaatcgaacccccgtttactttcaaaaatgtccacgtttggaagacaaacgatacaatcacactatccagacccaacctctcgagttctactttcatctgttttatattgagcaatgatctcccttataagattttaatttgagtgtaacattttgatatgtttgaacaaaacaaaatgaaaaatcaatcttgccagaaagggcaagacattcataaaaacagccaactgatcaacccgttgttttgccaggcagagcgaaacatttatgaaaacagtcaactggtttgaggagaaaattcaccaaaagcaatatagctagaagtctaacatcttaatgaggaacagtgctcttcgtccagactttatcgctttaggtacaagatgcccaaaacacaagtttgtaccttacgagcaaaattgtgaattgtatatagaaaaaaaaatagaggtgaatcaccaagtaaatgggtcatcaaaatgaatgtcttcaattctaccttaggagaagcttttggagacaagactggcaaataagtgggcagtatatatgaccccatggaaagtcctgggggtttgggatccatcaaaggactggaattaggatactgacttttcttccaatggtgtccctgcggacaaatggcttaatgtctctgaacattattttcatgacttacgctttcataaaaagttcaattaaccattggttttcaaactatgctctgcagagcccaaggatttttagcagaggtgccctgtgcaccctcaggagttatacttttattcgttttatatcaagcaatgatctcccttgtaagatgaaaatttgagcttaacattttgctatgtttgaacgaaagattttgatgcaaaaataaaacgtgagcatttatggtttaggtagcctctgagctccctccaattctggtatatgtgattctaaggccttagaaaatgtcagcagttggagaactatagatagagatgaacaaaagattcctctgctgtctgcaaagccctaaagtaacttgctaataagtgcagaccaagagggccttaggccgtgtgctctgatctattagagaggctgatggagaccagggtgtgtctgaggaaagtgctaatacagacatacagagctgtggctgtgaggtgtcttcgctggaaaagagcattctgggactctgaaaagtgttccccgagatgttctctatcactcacaaagacccggagattctaaactggtccaaaactgattctagatttttggcaaaaggcctggtgtctgaaaataattaccagtatgtccaaaattctttaaaagttctaataataataaagtctggagcattctagcacttgggggagtggggtagcatgtataaagttaaagagataaacactcatctggggtgaaaattaaaattcagaagaattaggtaagataccatcacgagtgcaaaggtagatcaggaaatcatgctcctttcctgtatttcaggtatcaggagagaaaaacagatagtggaaagtgtgtggcagaagcgcttgctttcactggcctggaggaaaagtcaaattttgagtcagaagaaaaagggtagcaacactgagaagtctgtgtcctggctgcttgtgtggtcaggtgtactgctggtaatcaaactatgaacctggggtccatatgtccttctctttataaaagtacgaaataagttagggcttaagattgaactgcaatgaaaattatttttgctttcctttttttatcttaaaaatttttaaagggattttccaagtttatatactgtttatctcatatctggaacacttttaaattttggttagatttggagtaagtttgattatagtcttttctatagtcttttcttgatccttaaagaatgattcatttgattgctgtttcttatttcactgaacttttaatcatgtcacaatactatttttaggagtgtctatggatttctactgcctgagaagataaagccccaagtcttcacattaaagactctcataatctcacattggctttcttttcagtccttatgatccagaaacaccaggttacccattagttgccaagcacattctttaccgtcttcttagtgtccattcatctaccctcccgccaccatatctcctccttcatgaagctttcccagcacaggaaccccaggtggaatgaatcacttctgctcccagaatcctctgctcccagtgatggccattgtggatcctgctgttcctatgtgtataacccccttgctgtgtaggctgtaagaagcatgaggacagggactgtgcctattcttttttataactggcatttaacatagagcctggcatatgacagatgtccaacaaatcattttagaagaaaataattttcttaattaatgaatttttcattgcatctaaaaattagggggctgaatagtcctttaaatggtggatgcttctttggtctgttttaactttataaacttacttaagtggttgtaaaatgaagagtgctgtaaatctgttaagactacatcgtttcagttaaggatgactgattaagcacatgtttttattcctactcctcttccaaatgtccatagaactgctattccccccacacagaaaaactagtgaaaatatctgcattaatgctgcaaaatagggaaaagcattatccacatgaaaacaacttggaggaatttctgctgaatatagtgcagaggcaagaagtcagatgaaacccacccatagttgaagatatgcaaagtagcccccaccggagcagccaatggaaaagcacccctgacgtgagctcttggaaatctccttgaatcaaggccttggtgcgccatctataaacgctgctaaaatgtcgtggatataaatggaaaagttgaggctggttgacaaagttgataaaacctctaaaagatgattcaaatgaacaaaatgtgtcaaaaacaaattatgagataatcagggaaatgtgaacccagactggatatttaatatttcaatgattgttaaatttcctgtggaataatggaacatgagactttggttacactttgtatttatttatttatttattactattttactttaagttctgggatgcatgtacagaacgtgcgggtttgttacacaggtatatgtgtgccatggtagtttgctgcccctattgacctgtcctctaagtttcctcccctcactccccaccctcccaacaggcctggtgtgtgttgttcccctctctgtgtccacgtattctcattgttctactcccacttatgagtgagaacatgtggtgtttagtttcctgttcctgtgttagtttgctgaggatgttggcttccagcttcatccatgtccctgcaaaggacatgatctccttcctttttatggctgtgtagtgttccattgtgttatgtaccacattttctatatccagtctatcattgacgggcatttgggttggtttcatgactttgctattgtgaatagtgctgcaataaacatacgtgtgcatgtgtctttatagtagaataatttatattcttttgggtatatacccagtaatggtattgcagagtcaaatgatatttctggttctagatccttgaggaatcaccatactgtcttccataatggttgaactaaattacattcccaccgacagtgtaaaagcattcctatttctccacagcctcggcagcatttattgtttctcgacgctttaataatcaccattctgactgacatgagatggtatcttattgtggttttgatttgcatttctttaatgatcagtgatgttgagctttttttcatgtgtttgttggctgtgtaaaagtcttcctttgagaagtgtccattcatatcctttgcccactttttgatggggttgtttgtttttttcttgtagatttgtttaagttccttgtagattctggatattagacctttgttagatggatggatttcaaaaattttctcccattctgtaggttgcctgttcgctctgatgatagtttcttttgctgtgcagaaactctttagtttaattagatcccatttatcaattttgacttggcattttcatcatgaagcctttgcccatgactatgtccgcaaggtttgtctaggttttcttctagagtttttatggtttggggttttacatttaagtctttaatccattttgagttaatttttgtataaggtgtaaggaaggggttcacaagcatggtgctgaaaccctgcatagtgttcctaagtacaagaacgctatgtgtgccttacagagaaaatgcatgtgttcagtaagcttcattctggcattacttatagtgctgttggcggtaaattcaatgtcaatgaatcaacaacataaataaagtgtctttaaacagaaacatgcattatacaagtttatgtattaatcagttgacaaaaatgttgtggccagaggctctcaggaacctaatcctgtattttccctaggagcaatgattcagtattcactaattcagtgttcacagtgattttaaaaaacataactaccatgaataacaagaattaactgtaatcacagatgaaatatgtgtctgaaatttgcttcaaagtaatccaggggactggcagtagaaatatacatggaacagactggccatttgtaaattgttgaaggtgtatgatgagtacatgagtgttcattatactgttctctcaacttttgtatatatttgaaatttccaataacaaaagttttaatttttaaaagagagagacagaatggcatagcagaaatacaagtttggatcttcttcaggcattaaaaaatcatttagtgtggtatataaagaaatataattatttagaagtagaatgaattaaatttcatgttaagtataaatgatccagtgccatgtaaagtcagtatatacaaaccccccaaagcaaaagagagtgtatgagtgtgggctctataaattgtaggtaatatagaaacttacatgtcatttttagaaagtgaaaagaaaaagacaagagacatctaaataaaagcctatgttctgccatttaactgtaataaagctcagtttctaactttcaggcttgtctatcccattaataaatctgcttcaggctcctgggacagctctgcctgcctctgctccctcctcactgggagagttcgtaacaggtcaagtccgagggctaatgccccacttcgtcactacctgtttccactgcaatgcctcaacttgctctccagctctctgacacttattcaacagttaagtttgccaaactaaagcctctatgtccttccatccttcctcatctcctaccacagtgttttccaaatccattctgaggggtgctacagctccggagacattccccaggagcacaaaggcagagaagctggagtcccgggtgctactgcagcatagagggctctgcttttatctgttttgtattttgagttttgcaaaagattttgcaagaggaaaaaatgttctgttttttaggaaaaaaaattgaacaagccaaacttctgagacattttttatgatgggagcacatggggctcaatgtgtgtgtgtgtgtgtgtgtgtgtgtgtgtgtgtatcccagctgttcctggtgaatcctggcttacaccaggtgaatgactcagacttactctacatctttcattctgttttcttaacgaagaaaagaaaaaggctcttttgcagcccaaatcgatataggttcctctgaagtgcttagcaatggccagatttgcataaagctgtgtgttgttttgggatcttcagcttgagaaagatttggagaactctgagagattttaaatcatcattatcattttttgagagccttttgtatgctggtcatcacactagttactttgcatttagtattgtatttaaggctctcgataaacttgcaaagtagttggtagcatctgcaggcatcagcactctagcacaggcaagtgacctatacccagatctcattagcataagccacagaagctcacaaaagcaaaatgcaggaaatgacgagtacagcctgtctctggaaggaccggaatccagagctccaatgccagcagaatgccccctgccttctctcctctcagcctttatgtttacttaacatttgtacaactgggaagatggtcactttacatgctttccgtgaaaacagagaccttttttgtttatttgttttattttcctaaggtctttttttttacagcagggttaggataacagaaaaataagtcggcttcacatgcacaacctctcctatcatcagcatttctcaccagagtggtacatttgttgtaattaatgaacctacattgacacatcattatcacacagaatccttagtttacattagggttcactcttggtgttgtatgttttatgtataacgacatggatccatcattaaaatatcatacagaatagtttcactgccctaaaatctctgtgatctgactgttcatcccttcttcaccctaaccccaggaaaccactcatctttttacggttttcatagttttagcttatccagagtgtcttattggaattgtagtgtgaagccttttcagattggcttctttcactttgcaacatgcatttgaggctcttccatggcttttcattgcttgatagctcattcctttttcatgccgaataatattctgttgtctagatgtaccaatgtatttattcatctactgaaggacatcttggttgcttctaagttttggcaattatgtataaagctgctataaacatctgtgtgcagatttttgtgtggacgtaagttttgaagcccaaggagtgaaactgctggattgtatggtgagaccttgcattttcattgcaatatttccagcagctagaacaatgtcttgcacatggaagacactcaaaatatacctgttgaatgaagggatggaatgaaagcgtggttggaattttgcaagttccgtcactctatgctcatagcaaagagactgtggcacatcctgttgtacagtatatcattgtgagcattgagtatatcattgtgagcattgagtatatcattgtgagcactgagtatatcattgtgagcgttgagtatatcattgtgagcgttgagtatatcattgtgagcgttgagtatatcattgtgagcattgagtatatcatagtgagcattgagtatatcactgtgagcgttgagtatatcattgtgaaaattgagtatatcattgtgagcattgagcaaatgcatcactgtaccctagcctgtctccagccagccttcggcatggcctccactagtggattattatatcttacttttacctaagttattccaaataggggtttgttttttttttttttttggcatgatgtgtgtgactctagagataaaacaagatcagaacattgtctttccatgaaacatacgggcaggtatgcatacacagctctctttgactctgggtgaccacagaagccactgtcatttatttaggggcaattcctcttagctacaacccaccaaataatttcgctgtgcttctataattttaatttgaaaaagaagcatcctcccaagagttgagtcctgaagagtgtcaagcactcagcctcagatatcctatacattaaatgaaagatttggaacaatggctcaaggaatcatctggctcattctaaacatcctatcacctgtctctcacccacacctaggcctagctcctattcatatttttttactatttgggaccaaatctagtgtattttcctccccttggagttctgaggaggtgctatgtttcttctgtataaatcacacaaacgcattccaatattagtacttaaaaaatgtaagactctagtaggccttccagagaaacagacaatacagaaataatgcataatatttatattgtataatatagactctattaaaatatataatgttaggtaataaaaaggcaaagtataggacaatgctgtcccatagaagatttcaatttctagcagttacattaaaagtaaaacaaaagcaattaaattaatttaatagtatattttataaaaccaaatatatccaaaatatatttacttcaacatgtaatgaatataaacattaaggagatattttacatttttccctacctaatcttccaaatccttaaaaatctttgaaattcaaatgtatttacacttacagcatttctcagtttggaagctaaatgttccaaggttaaagagaaatgtagttccatcagacaatcgagttgttttaacagagcaatattttacattccttcagttttcaaatttaaattggctacagttaagtacaactaggaactcggttcgtcgcttgcattggtcacatatcacgggctcaatactggacagcaaagtacagtataggaagttatgttgcagggagaggctgtttgagataaagaagtcagggagatcttgtgtgaagatgacactcgagcagagacgtgaatggaatgagagcgggaggctgccaagatgtggggaaagagcattcccggaaaggagaaataaaaagtgcaaaggtcctggaaatgggatcgtaaacatccaaacacacgtataaccttcaaagctgtgaccttgtgggctggggagatggtgtctatctgcttattctaaggatggtacaaaatctttttggtatctgggacacaaagttcctaaaatatgcactacttctcctttatgtcgttcgttggagcaaaacatgagattcctctttgttattaaaaaaataagtaaaaggagcttaaggctctgagtctggacccaggattatccagctgtgtccctccagctctgtgatgtgcaccagtaaagagaaacgacaagaacacaacttctagataatgccaccttgcagaccgatgctacttgctgtcgcctcacccgtgccctggagaagggctcacggtggccatctgcatttagctaatctcagtgttattttctctcggcagttttctggacagctgacaccttcgacagtgatatgagaagtaggctcccaaacagcgctgtccagagtccactcagagaagtcgagcaaatggatgaaagcgtccttatcgtcgctttttcttaggcaagttagacagaggtgtgtacgctgctgaataatctcagtcagggacagaaagtctagaagggccaaatggccaagagctgaaaggtgtctcaagtgggccttcccctccagggagcaggaaggacacggagtataggggagaaggtcaagggacaaatgctcccaactccgtgcatatggaagtccctgccgtacccacactctgacatctgcatacaaaaagcaaatgccaagtgtgtgcacagtatggttgaaataaataagaaagatagaagggtttaaaataaccaaaatagatttggttagagtgattggttgaattttttctactaaattatcttaataatttgcattagttagaagtcataaagaaacaaagtttgggctttttaatttagggttagccctgtttagtctttcagctcctctgatccctacagaatccccagtgggccttgagaaggaagaatccagaggtgttttgctcaggcctgactccaacacgtctcctgaattaaagccccataaagataatattcagccttaaaaaagaaagaaagaaatattgccatttatgacaacatggatggatctgaaggacattaggctgagtgaaataagcaagtcacaaaaagacaaatagcacatgatctcacttctatatggaatctaaaaaagtcaaattcataaaagttagagttgttaccaagagctgggaaggccagagtgggaagctgttggtcgaaggatataaaatttcagttaggaagaataagttcaagagctctattgtacaacacagtgactacagttaataacaatgtatcgtatgcttgaaaatccctgggagaatagactttcagtgttctcaccacaaagaaatagtaggtagctgaggcaatacgtatgttaatgagtttcatttaaccatttcacaatgtatgcagatttcaaaacatcatgtatacaccataattatatgccatttgtatttgtcaattttttttaaagcctgtgaggttgagaatactcctgcttgtttaccaggtagctccacactcaaaaaatatttattgaatgaatggccaacatcgtattgtaagtcacagcccaaactaccagccaggagaacaaatgcatagaagaagaaccgtgcgctgcagggagaagcagagggttttagaaaatgagctcgcaacaaaaattagccaggagtggaggcgggcgcctataatcccagctacttgggaggctgaagcaggagaatcacttgaacccgggaggcggaggttgcagtgagccgagattgtgccactgcactcgaggctgggtgacagagcaacatcctgtctaaaaaaaaaggaaaaggaagggaagggaggggaggggaggggagggggggggaaggggacgggaggaggggggaggggaggggaggggaagggaagggaagggaagggagcccctgaaggcatttctggagtcagctgaggaaggaggttccaggcagctgctttgaagtttatccaatgcctatggatttttaagtccagggacaaaagggactggggacacaataacacctgccctcacaggttcaagatgcttttaactagcatatgtgtttgccctgccattcggaagctaaaacaagacaggcagtggacccagccccatgccctcactgaccatccagcagtaaagatgagcacctggcaccctgcatggggacacgcagctgacagatacagggggagtgccgagccacgcctccttgctgcccttgggagagatctgggagagagaagagaagcaaatgatctctcttgaccctccagtcagatagtatctttccatcctctggcctcccatactaccatctaaagtgtcatcaggtagaaggcagagcagatgtccttggcccttccagaaggaagcattcagctcagtctgacaaagaactcccttgccgtcagtgctacacgcaggatgggctgcttctcaaagccaggtccctgtcccagccttaaggaccatgtctgcaatgtgacagaggaaaaatctccatttggaggaggcttgaacccgatgatctacctttctaataacagggagctggcatctatggccaacaccaactggcctgccccagcaatggacctggatacatcatactccactccaacctctggactcaaaagcctgcgagtcctttgtcccctggctgtggaacagcctataatttatcatgcaaacttaggacactgttttttgggttttttttttttctttaattttttttttgagacagagtcttgctctgtcacccagggtggagctcagtggcgccatctccgctctcactgcaacctctgcttcccaggttcaagtgattttcctgcctcaccgtctggagtagctgggactacaggcgcaccccaccacacttggctaatttttgtatttttagtagagatgaggttttgccatgttggccaggctggtctcgaactcctgacctcaagtgatccgcccaactcagcctcccaaagtgctaggattacaggcatgagccactgcacccggccttaggacactttttcaagtgaaagacgacagtaataataacaatagcagtagcacaacagggcagataaggaggtatagtcaccatgactagagtgcactcttagcaaaaatgcccagacttatggtgggatctataattctaaaccacaacatttattttattcatatttttatttttagagacagggtcttgttctgctgccttggctgtagtgcaatgggacgatcacagctcactgtaaccttgaactctgagctcaaaaaatcctcctgcctggcctcttgagtagctgagactaccggcttcagccaccgtgctggctaatttttggtagagatgggggtctcactatgttgtccaggctagtcttgaactcctggcctcaagcgatcctcccacctcagctttccaaagtgttgagattacaggcacgagccaccgtgcttggcctaaaccacatttattaacatgctaaaaatctgcctggtaccattaaagactgaagcctttcaatgaatatagcaataaatatagcaaggcactatcacataaaaacctgtgggctgggaattctggtggatatggaatacttaatgagggtgggagaattacagagaaatggaagtcctctggtttgaagagcaggagagaagtactgagaaagtgagagtggtaggggacaaatcaaattgtatttcttttttttttatttgaaatggagtttcgctcttgttgcctagtcagtgcaatggcaccatctcagctcactgcaacctccgcttcctgggttcaaacgattctcctgcctcagcctcccgattagctaggactacaggcacgcgccaccacacccagctaattatgtatttttagtagagacggggtttcaccatgttggtcaggccagtcttgaactcccgacctcaggatatctgcccgcctcagcctcccaaagtgctgggattgcaggcgtgagccaccgcgcccggcctcagaattgtatttctgtagatatttttaatcatccttaaaataacactaaggaaaactcaactcttcataaacgtgattgattttggggggcggtttgcgggatgtctggaatagaattgggggagataaagctcctactctactgtcgcctcacggcaccatcaccaagccacacctctgtgctggcactgcctggatttactatgagccacccatgtgactaagcacatttctaaacatctgacgctcagagtcctcagtctgtaaagccaagcacccagaggcctttgccactagctttccgtgtagcttggaccttctgtgacctcactctcctgttgacctacagcaaaatagctgacgtcatgccaagcctcgcagacctaccagagtgattcatttaataatatttgtaatctttgaaagatgaggttgctccataaaagggttagaaaataactgtgacttttgtaatgtgttaacatgcatacctaggagtctctcctgtccaaacaccattataaccgcctgctctcttactttctttcactggcttcttattttttttcccctctggggctcctaaagtcagactcacattggaatggtttgcaaactcccgtctttcctgattgggtccatctgaatggagccgtcaccaatgtcttcacaaatggcatttccattaacatttctatttctgtccattcggggcacctaaagatttcccaccaagatttacatcaactattttaagaacgtgcttttaaaaagccaatgagtttgctaagtttaaatctgactttctcaagggatgcttaaaagaaatatacaaagtttttttaaaagaacctttgtaagttcaaaataacattccaaaaggagtcactaggaaaacattcaagggaagagaaaaaatttttttttgcatttgtggcagacctggctttatcttaatgttctatgtttgtttttcgacgcagaaaagtcaaatagccataagagtcacaaaataattgaaagaaaaatggcttggtgcttctcatgtctagaatatttatagcagagggaggagctaggctgtgtatatccattattcaacaggccaggtaaagacagaagattggccaacggcagctcaaagacagagccctggggattctcttaggtcttatggaagctgcatcagagctattgctaaactatgtcaactgtaactttccattagcctgatgacctgtgatctaccaatgccacaacatgactggaatgctcagacagttaccaaacaggaagataagccatgggtaattatttcaatagaaacttagagttgaagtgattgttcctgtaagagtctattaattagaattagattttgctgctaaactaaaaaactctcctaatagtggcctaatcataaaaagagtccagaggtaggcagcctgtggctggtgtgatgtctggtatggtgacaccaaagagtcatcagggacccaggctctgaactgtatcctctgccaacttgagcatgtggcttccattctccaggttacttcatggtctcaaatagctattctctatcatggctatctatcagaacggcacacttcaagtaggaggaaagagagaaaggagggaaagtgtggtctcctctattttaaagagatttctagaagccccgcacaacacttccattacagctcattggccagagcttggtcacataacaattaccagcccaaaaaagacggggagctgctaatttccacaagtacccatcagtctctttcacaaatagcaactgtgcttactgagtcttttcgtgtctttcagaagcacccgcttgcctaaatccatcacttcatactggaaaagcctttatgaacatttgctcacattaggtgtaaaaaataatccagaagtttaaagagaatgctgttttccatgaactgtaataaatgataagtatttaaaccttaaaatgggttgggtgtggtggctcacgcttgtaatcccagcactttgggaagccaaggcgggtggatcacctgaagtcaggagttcaagaccagcctgacaaatatggtgaaaccccatctctactaaaaatacaaaaattagctgggcatgatggtgggcgcctgtagtcccagctactcaggaggctgagacaggagaattgcttgaacctgggaggcggaggttgcagtgagcagagatcacaccaccttgctccagcctgagcgacagagagagactctgttaaaacaaaaacaaaaacaaaacaaaaaaaccttaaaatggtaggtaagagtatcttcctgtgctttctccagaaataaataagaaaaaaaaaagtccatgttataaatctaataatgatatgttgtcctaaatttacttttgcaggaaaataagaaaaccattagttttccagagaacccacgcttaccctgacatgcttacagcattcatcagcagagatcctaaggtctccataattctatatagaagagttcaaggggtaacagtctggttgggagggcagaagttagggggagttcgaggtagtaaaattcttcttgaagttgcatgtctaaggcaagtatggtacccatgacatgtccaaaatctgttaatttcaagaaatatttcccaaacttagtaatcgcccctcccatgaggaagcagctttgccacaaaaggtagtcttgtgctgccagctttccccgtgatcctatacgataaatgtttacagagaaggtgccactaacagaacggagccgtattcagacaccattctataaaggggctgctttttcctggcagcgtgcaagattcctggcaggttccaagatcttgactgataatgtgaagtgggtcttctggctttaactatttcttttcattttaacacaaaataagggtttctttacaccaaaatatataataatcaaaataaagggcttatttgagaataactgtgtccattatttatacactatgggaggaactatgtgccaggcacaaagctgttaacttaaactatgatctaccacaaactaccaataacacggcactggtgttatctaccacaacggcttcagtgggcaggttgttgattcagttaacgggaaggtgtttccattctggtcttttctgcctcctcctcttaagcctagagccatgcaacctcatgcctacaaacaggtttaggaacctcctgaaatcgtgtgttaagttctgtgtatttgtgtgtttgcattgggagcaggatgctcgtgagattcccagagaggtctgtgattcttaaaattgctgccgtaatattgtatatttcagctaatgcagatctcctaaagagcaaacctgaaggttgcctcttttctccctatctgccaggggacaaggagaggtgtcctgggtagagagaacaccttgtctacctggtaaactcctgcttagacttattatcccagcaccaaatctgtcttttctgtaaagctttctccctacttgtctatgaattctctgaagctcagattgacattccagatacagacgaacgaacagatagagcctctccttttggttgccagttttgcattattcacggatctacttctcttctgaataagattagtcttttccttaatttggggtaaatattaattgcagcgcgtgaagttgtggaatgtttaggcttcaaaacaaacaattctaattcattgaactttgatccatctctttctcttttgtcttgcagattccagtgctgcaactatattcaataaatgggccttgttcaaatcctgagtacaaatactgtcttctctttaacggagctgtttcatgcttctgcctttctgtagaaggaaaacaacgtccattctcaggcttatctgaatctagcaccacttttcacaagttatttttgcttcaagctactttatgtggttctctattaatttcctatctccaccctcaacagtaaggagatactaaaaactgtccatttggttccgcttgtgggattttactgatttttaattttgcaatactgtcttgcatattttaaatctgcgtatctctaagatgactctccagagctgatgaattttctcttccatgctgatgagccagccatgggagagtggaggagtgggggaggaaagagttactgtctcgcgagctgtgagtctgcctgcccacagcggcgttttggatgagactcattatttgtggaaatggtgtgttccacaggcaaaaataactttttaaaaaaagaacatctctgcactctcctgaagtcatctcaaaatgaattcaagatttctcatgaaatggagaaagctttctgatggcctgaatggttccttgtgtacttgaccatgccacgttaaatctaatctaggtaacattagggtccagaaaaagctaatagaggcttaatgatgaggtaatgagcacagaggtcaagggtaggaaacaggttttctatttggagcctcatagccatgggaaaatctcagttgagaaccagaaagaagcagaaaggagcaattgaagtagaagaatatgctccctttcctttacctgattttaaattaaacatgaaggacaccacgttttggataataacttgtgttcacatgaggacctgttaaggaaaaaagagaaaaaaggaaggaaagggagaaggtaaataggggagagaacaggtaaaggaagaattgacaagatgtctgaaaaaaaataaccaggccgggcccagtggctcatgcctgtaatcccaatactttgggaggccgaagtgggtgaatcacctgaggttgggagttcgagaccagcctgaccaacatggagaaaccccatctctactaaaaacacaaaattagccaggcatggtggcgcatgcctgtaatcccagctactcaggaggctgaggcaggagaatcgcttgaacccgggaggcaaaggttgccgtgagccgagatcgcgccattgcactccagcctgggcaccaagagcgaaactccgtcaaaaaacaaacaaacaaacaaaaccccagcactttctctgtgccaggcactgttctaagtgctttacacttattaactcttttacattatgacaattcacaaagcccacattattgccttctctgaagaagtaaagcacagagaggttaagtaacttatccaaggtcaacacaggtggtatgtagaggaactgaaattcagactgaagcagtcaggcttcagagtctgtgtccttaaagacaatgtgatggcagttgtaactgagggactgggatagccaacctctcctgtccacagaaccctgttccaaatcccatttagagtcctcagatccccactgctcaaatcccttctctgtactttctacccgtctgctcctgcctgtacgctcttattaaagtatttctgaatgcctagcttggctggtcacccctcctccaggtataacccctgcctaaatcccctgacctatgagacctcaagtcctgtccctattgggcctgacacccttgatgacacggtctccagtgaaccagccaaagcattgtttttccacagaccatggcacctgcaacagcacctctggcctgtttctcaccaattcatctcatttgcgttccaagctgatggagtcccaggtagaatgcagcaagatgaacatgtctgaaccttaatgtcagcatataggggttcgacagacagctactatgagagaatatgcaaagtcacatgaaattgaggtacttaccagcggatacgtgtggggtggagttggaggctgatgctgaatgaattcagacactccttgtctcatcgctgttgaaaactagaagtcttcactaagccaagaaactccctggggcttaagttctagccttagtagaatgacctttgcagatggaaataacagcacagaactcttgaattgacgcataaatagttccaaccctgaatatcctccttgataaaccacatgatattggaaatttttattttgtaaacaatacactccaagcagatttccctccatagaagttctaatctaatgacaagatttgcccctagttgagagaaggggacagtagggaaagccctggacttgaggttagttgcgttgggaagtgtagtggttacaaggctgtaactcccagagccgaccagcttctgggagtgttgggggcttctggctctcagctgaatcctattcagagatttgctctcagctaatgggaatcacccaagcttacatcttcttcctaggaacacatctatccaataactggttctggggatgggagaaaaaaaaaggcctgatctcatctctttaaggcaggacaactctgaaggattatcccagatccagagttccctgggattcagggccagaactagggtgaggtgagtgaagaacttgactgagatgcgaaatttaagggagaaccaaaaaatctcaataaacaagcaaataaatatttaaatcaatattttaaaaagttaatgcaaaaagtttataatagagtattaaaattttgtgtgtgtgagacagagtcttgctccgttgccaggctggagtgcaatggcatgatctccgctcattgcaacctccgattccctggttcaagcaattctcctgcctcagcctcccaagtagctgggattacaggcaagcaccaccacgcgcagctaatttttgtatttttagtagagacggggttttaccatgttggccaagatggtctcgatctcctgacctcgtgatctgcccaccttggcctcccaaagtgctgggattacaggcgtgagccaccacgcccggcacaaaatattttatagggctgtgggcatagtggctttctcccgcaatcccagcatctttggaggccaaggagagaacatggcttgagaacaggcatttgaaaccagcctgggcaatatagtgagactccattgccacaaataaaaaaaaaatcaaatcaaatcaaaaattggctgggcatggtggtgtgtgcctgtagttccagctactcaggaggccaaagttggagcatggcttgagctcaggagttctaggctgcagtgagctgtgatcgcaccattgcactccagcctgagcaacagagtgagacccttcctctaaaaaattataatcataaatttttttaaaatgtggtaaatgcaaaccctgacaggatggggattagggtggggcaagtgaggtcagccatgtaaatacagggttggattttgccttttatttgaaattttggttctttgttcatcatgatttttttttacattagtttaaacgtttgaatactgcattaaaatatgtatcttgattactgagttttctggcaccctgacattttgccctgaggcgagtgcctaataggtcttactctgcttgaatctgctgagacctcgatcggaaacacgtcacagtttaacttctcctcatgctctatcctgctttcctcactcctttgtaggaattatttccaagccattccctggaaagcctcctgcccccaaacccaacattggcagagtcacttttctaggggcccccaccgaagacagggagattacttggtagttttgaaagtttatgttttagacaaagctacatttgaagctcagccccctgacctaccagaagtgggacaaggcatgcagtttctgaatctcaattttcctctattatcaaacgagaaaagcaattcctccctctcatttaatcctggagtgctaagaggagtaaatgagctatcccaggcaaagaactccatttagtggtttgtagcaaataacaggtgttcaggaaatgttattatcccttcgtgtgtttcagctttgcctttcctggagcccttaaacaggctgaagtgaaaagcaccatgacctgtcactacaagacgagaagcctcaggagaaggaaggagatcccttttcattggttttgccgagtttcccgagctccatcctcctacagttaaatcaacactctttatccttagactgctgataatctcaccaaccgcttcctggtaagatctgtaatgcgtgaggtcttccttcttagttgtttgcaaacatcagtgattagggacaattagggactggtgtgcctgtcattcttctcctttcagctgaggaggaaatcctcatgcaccgttatcgggagtgagacttcatctgtcagctgcagtctcaggaatccacgggttcattcagtcgcaactctaatctcactaactttatctgtgttcctcaaatgccttagactatttgcttcccactgatagggaaacctgacatctcattttctcagtgtccagacaaagattcgtacatagcaagaaactaagataggtgttacagaacatggagggaaccaggaaaaccaaatagaggacccccttcatggggcttccaacacgacaataggcaaaagagaagaaacatacatgtaagagacaagcaaaacccagaaccatcacttatgaaggatgtcctcatcaccctcttttgctgcctgtcaaaaccggtgagggctcatatgacaccttaattatgaattaatcttcgttcctcctacaccagcacttcccctcaccccagtcgaagccatctctttatatttccatagcttaaaatgctatttttggttctagatgctttgcctctagatttggatactgcatccatattgttgtatattttttcctttctatcttttccacaatgttttttttttttaacttttaagtttaggggtccaagtgcaggtttgttacataggtaaacttgtgtcatgggggcttgttgtacagattatttcatcaccaagatattaagcctagtacccattagttacgtctttcttctcccaccctccaccttccaaaaggccccagtatgtgttgtacctctctatgtgtccatgtgttctcatcatttagctcccacttataagtgagaacgtgcggtatctggctttctgtccctacgttagtttgctaaggatgatgggctccagcttcatccatgtccctgcaaaggacatggtcttgtccttttttatggctgcatagtattccatggtgtatatgtaccaattttgctttattcagtctaccatcgatgggcatttaggttgattcaatgtctttgctattgtgaatagtgctgcaatgaacatacacgtgcaggtgtctttatcatagaattatttatattcctttgggtatatatccagtaatgggattgctgggttgaatggtagttctgtctgtaggtatttgaaggatcaccacactgtcttccgcagtggctgaactaatttacactcccaccggcagggtcaaagcatttctttttctccacaacctcgccagtgcctgttgttttttgactttttaataatagccattctgactggcgttagatggtatcttgtggttttgatttgcatttctctaatgaccagtgatgttgagctttttctcatgtgattttcagccacatacatgtcttcctttgaaaagtgttcatgtcctttgcccacttctttatgtggttgtttgtttttttcttgtaaatttatttaagttcattatagatgctggatgttagacctttgtcagatgcatagtttgcaaaaattttctcccattctgtaggttgtctgtttactctgttgatagtttcttttgctattccacaatgttttgtgcaagataagtgcttagcaaatgcttgtaaaggaatgcctgcaccaggaaagtccaatagctatgaataaagaaagaaaggacaagttccaggggaggtgatttttttttcattttcatttttttagacagcttttaaaggaatggagtagcatgttcttctggagcaggagttacaaattggacctctaagggccacattcagcctatccacatggttgcagcactgacagagtgttttgaaattttaaactctgaatacttgtagataacatatgcatgccacaataaactgcatttccatc

SEQ ID NO: 1226 - DNA, 87220 bp, Homo sapiens; identical to SEQ ID NO: 1225

SEQ ID NO: 1227 - DNA, 448039 bp, Homo sapiens
gggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttggggtgagtggctcgctcggcttgctccttccccggcgctcgttcggcccggctggctgcctggggggggggcagggagaggtgacccgtgcgggtacagggcagagagggacccggcccttaggcggatggcccgcttgttgcttggccaggtgggggcccacacctgccggggggctccgcagacggacctggggactccaggagcgcctgagtccccatcctcgagtgcaccgggctgtcttcgaccgtgcggggaagtcagtagacgaaaggggttgtcagttccaacgaggaacgtgccttggaggaggtttctttgcggtgctatccacgatggtctgttctcaaaagtgtgcgcctttcgggtggaactgctgtgtgtggcgacgctcgcgtgtgtttagaatcaccattttctggtctccgcttcccaagctcaattcgaaattcccgtctgatgccctcccagcgccgcgcgtccctgccggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaagggttcaaaactattctagtgaccagacgaggcggtaggagggactcacgggaggcagcgggacaggaggggctgtcacctgggcgggagcagcctagacttgggacgcgagagagaggatggagggatgggcaggaggtccctggggagcgcgcgatgtagggtggcctgggaggctgaccccggctggctggtccagaaaagcgaggggaaactcgtctgggaaagaaagggcccctgttccagactctggttgtgtctacctcactgttctccaacttccagttctaccaagctcctgcctcccggggcaaagggtccttgagctagaacctttcctgtgttccctgatgactggatgaatcctccaacttggagaaggggaaaaagaggggaggactttgctaatttttgtgtaaaaaagaaagcaaaagaagggtagtgttagagagtggaagaaagataaggtagaatccccgaaagagggcagatcaccaagcaccaggagtcgctttgtcgggagttggcggcgccaggtgttggggacaggaggacgggaaaggcagacttgactcttggtgctgcctctgctgggtttcgcattaaaggtgcagactgtaccccaaggacaacaggggcccattctggaacttcagcagctctgtagtaggctgggaggctgcaagagcgagtgcggagctgggtgacagcaacgccccccttcctccagcctggagccaacgtgcgctgccgtgagccccaccaaggcgagagagagcaggcgccagagtcagatcctcggccaggtttcaagggcttttcttgggtagaagaaagcgcctcattcttttccaggcatataaggacgaacccacgggaaaagctgcggttctccaggagtctggttgttcctcgcagccgggacggaatgctcaagtctgtcaccacacagctgtcagccaagggaggtgcagagctggaggtggaagggagtcgtcttcttagcttgacctttgaagccctttgctttacgactggatgcttgatcatttttctcggcctttgatcttcttgaaatcgcaattgtatctgatgcctcagactatataaactaatggatgagttaagtcccagacaagatgtatgtctgcgttcacagagtcacctgcatatgaaaatgagactgaagaatgtagcctgagcatccccttcctgcgcacttggccctggagtctataggattcccctccaccccatccaagccctccaggatttcacacaacaaaaactgagtatgtaacccaattataacatagggcccaaggaaagtgcattgattgcttcttgggtaactatggcattcacagcgtttgaaatgtcatcttgaacgccatttctgcctaacgatgtgtgcaaatgtatatttacacttacaaagcctcttttgctgtgttcactgtttagagctttgcctttgtaaagtgcagccttcatagaaaacaataaaagtgtgttcatataaaagttaattgcttttgtcctccatttctacctgagaaatgtaaacttcaaagttagatattgaaacagttttgttttaaattaaatcaaaatattaaattcaccttgactattttgggaactttttttttaagtcagatacttttctattcagaatattctaatatgcagaagagtgaatttaaatggcaaaacttcacatagctggttctgtgaagcttactaagttaagtgagtcccataagatagtaaaactaagcaaatattgtgtgccttaaagagtcataccccaaatcataaaaattgaagttatccaaacattaatatttgctttgcatagttaataatacatattcctaattttatggactcaaaactatgaacttttccaaataacatattttttaactccaaggacacgatgagtttttgtgatttatgtccaaaactaaatttcaaaatataaataattataattgaacatgcatagatatttgatttattatggacagtactcatgctttcaaaaatcaaagtctgtgatattctaatggagaaaaaaaggcctggatatgaggccgattgcatcagagataattattgacatgaaacataatttatgatgaaatgttctaatgtgccctttgctcttcacagataagtgcaattttgaatgagggcagtaaggcatttcttgtcctctaggtagcaagtcagccctttcagaggggcttccaggtttaagaggtcaaaaaggcccttgccctgtgtctcactggggaagctagcaacctgttgagtacagtcccttacccactgcttgggaaagaagtaaaatttagtaagcaaggcatatatagcaaaatatccagtcagtttttggtttgcagccaaactaagaactcaatcactgaaagcattaataatctaacactttgtgtattgaccctaaatttatcagaaatagatgcagctttgtggagtgatcatcatcatcatcaccatcatcacagtcattgtcatcaatatcactgtacaaattttagactgctataccttgacttattctagacacagacctcacatcattttttttcaaggaattcattcaaatacatcaacatgactattcacagacacattgtatgcagacaaaatagtgtcttctacagacattttacatttcttactcaaactcaggtgagagattggtgttgatatgtgtgggttctgaaggagtgtctcaggatagggtggtgtgtgtgtgtgtgtgtgtgtgtgtgtattcaggtacacactcaagtaatcaaattatcttggagtgcccacagtttaagaggcagtgtacactggtgtttgtgtgtgtattacagagtcatattgtgttaagcctgaattagttataataaagaacccctgcatcattgctactgagagtacatcgggccagtcattgtcactttgcaccaacttcgctgtaggggaagcagggaaatgtggagggacagattgcgagttttgaagagcactaactttatgagctgagcacctattgagaattttgctttttcatatttttgttttaacatcttattgtggattcacctacctcttgccctttctcccttcttgattaaaaccttaagacacctccattcctggcttaaggataattgatctcctttctgtaaacactgtgagttttcctttcctctctcaacagctttcctcggagtatttgttcatgagagatatttatgaaaattcacccttttatagaagctcaatgattaaaataaatagaaatagctggacacggtggctcacgcctgtaatcctagcattttgggaggctgaggcaacatggtgaaaccccatctctactaaaaattacagaaagtcagcggggtctggtgatgtgtgcctatagtcccagctactcaggaggctgaggtgcgagaattgcttgaactcggaaggtggaagttgctgtgagctgagatcatgcctctgcactctagcctgggtgacaaagcgaaactctgtctcaaaataactaactaaataaaataaaataaaataaaataaaataaaataaatagaaatgtgcatatgtgcatttgtatattttgtcctttagaccattttacaatttctttcatctccaagtctgtaaaaactagtttgtaaagagagattatatcttgcatggcatgcattaccaatttcccaagaattagatgcaataaatatatttaagataaaacatataaataacttagtcattctgactatttaaaaattctaaaggaatttcaggatcattactttgtatatgaatttccaatatatggatttatggtgcagaagttataatgagtgtgtttcagtctttacttgtctagaatattgtgaatcctggacattgttttctgaaatggatctgtggtatctatgtttatttatcatttgtatatttatcatttctcattaaatactaatttagcagatgacaatttcaattatttgaactctatttgattctagatttttattcatggtgacaattatgcatattccttacgctgtgtgtagatttgccacttacttctgtatctatacatattcctgcaaataatgctagttcttagaattttccagtaagcaaagatcttatatatcttctacccaatccctatattttgcattatcttcaactgcatgttcgtgtgtatgacatctgatgtatgcttagaaactctatctctattggcaatttttttccttttaaaaacatccctctgtctgcatatgaacatgtccaaagttctttgaatttcaaaaattaagccaaagacaatgaaaattaaggtaatttttacagtaaaaaccaaatacagacattgtggctggattttgctattaaattattatgcctatgtaagacctgggagaggtgggtaaatcagagagagttatcaagattcacatctcagtttttatcttgatagatttacagatgactgctggcaaggtgaactttaaaaatggcattccttttcttagaaaacaaagataatactcagtacttaaagagatctttcaaatgactgaaattaatagatagtgagcagggaagtgctacagtggtcaaatatctttctacgatctacattcccagtttccttaaatgtctttcaaacacgcacagtaatggtgaatattttggatcagtataaaatagaatacggaataaaaaattagtttaggctgggtgcggtggctcacacctgtaatctcaacattttgggaggccgaggctggcggatcacctgaggtcaggagtttgagagcagcctggccaacattgtgaaacctcgtctctactaaaaatacaaaaattagcggggtgcagaggccagcgcctgtaattccagctactcaggaggctgaggcaggagaatcgcttgaactcgagaggtggaggttgcagtgcactgagatcgtgccactgcactccagtctgggcaacaagagcgaaactccatctaaaaaaaaatagtttactatgaagcatatatatttgacataaatgtcatcttttcaaagtatttttattagttagcattgccctctttggatcataaaccatgtagaaactgttgagtaggacaattaagtatttgtatctttggactgtttctatttacatcaattttagaaactgtagaagataaaaggtatgcaatacaaacaaaattgaaattatctgtagtcccaccatttaaagataatctctagattcacatattttgaaatgcagtgctggttttgaggaagacataatttctattaaataagataaaataattaaaagggagcatactatgatttctttagcctcggttttattacttgtgcctcactttagtcacagtattttctgtttttcttcaaggtcttgtaactttgtccacagagtccacaaattctagatagggaacattttcattaactttctgcataaatcctctttagatttattttaagatacagagcagtattatcctctaagtaattcatttttatattgttacactattactcaatgagaatattgcacctgtcagtcaaagtggatagaataagtaatgatattttgctataagcaagagcagaaattaataaagaaaactattgtttacatggtacttgcaatgattagtgatggttgtaacctttcaacatgtgcaaaatattttgtctgccattttcctgaattatttgcaataattcttggttaatttttatttttggcttaacagtaaaattactgggaacaaagacatattaatgcttagtttgagacttcataatggtaacataatctcactacattttgtacatattgtgcatctcacaacttgtaaagacttatcacacatattatataagtcttatggtaggatttcaaacatatattcaatttttaacccccattctgtacataaactagaatccaaaagaagtaaggcaaatcagctggagttattgagacacagcttgggtttgtgtgtttgtgtctacaaacctaggtttataacttcaagttcagtgtaatagctgttatagaacagccaccactttggagtatatatagacaagttcaacacagtcatgtgtacccttcaaagtcaagatgctttctttggtatcttggtttaaagctgatacaatcattcactgtactcaatgctaagttatttagattgcagacaaaaatgctacttagtgaaataatttatgtcacaataaggaagtactatgcagatacttgtccaggccacactgaattgacacaatttcattttcattgatgccaaacacaaattcactaacctctcctttcaaaaaaaaaaaaaaatagagcacctttcaaaatttacatgacagtgtctgggtagaattttacaagttatttaaatagttaaatatctttagtttagcattacctttatttatggaagatgatattttatttaacctggctttataaaagattatgtttaaatcaacttagtgaaaggtgagttcatttaaagaaaacctaaatacaaaaactgtacagattaatggggatctgacaaatcaaaaggcagtatgtgttgacatagtcatgcctcacatagtatgacagtgttagctaaatgcccaggcattgacagtactcaaccacagcacgatcttaactcaagagactggattattttgtttgtttcttatttttgttgcttgctgctttaaagggggcttaaatcaaaatagatgtatttaaattatgttcctttattaaaaaactattaattttttaagttgcctatatgccactctcttattcaaatgtgtacatttatacataaaatgtattacacgttgatgtggtttggctgtgtccccaccgaaatctcatttgaattgtagctcccataatccccacgtgtcatgggagggacccggtgggaggtaactgaatcatgggagtggtttctcccatgctgttctcgagatagtgagttctcacaaaatctgatgattttataaggggcttcccccttcactgggtactcattctgtctcctgccgccctgtgaagaggtgccttccaccatgattgtaagttccctgaggcctccctagccatgcagaactgtgagtcaattaaacctctttcctttataaattacccagtctctggtatgttcttacagcagcgtgagaatggactaatacacatgtagaaacgtgtgtagtaattttttcctaacgatttttccattgtaaatatggaattgcttttttctgattactcactaccctttggcatgtttatgtgtgtatgtatatgtgtgtacacacatatatacatatataatgtgctatatattgaatatgtatgtatttccaaatggcacattactacccatacacatggaattgctatctttgctgagtggatagcagaatgcactccccacctctgcaccagaagaagatgttcataaaatgcttttgtagaatacaaggaaagtttttaattctataaaccattttatgtctacattggtctttacttggaaaaatagatgcaatatttgtctaaaattggaaagttagtattttttccccaaaactataaaaactataactttaacaccatggcaaccagtaaattttatatttatttttgtttacataattctagtaaattttctcacatgctatgcaaaaataagagtaaaattatacttttcacatatgtctccttgctttgaaaaatattcctttttgtttaaacttactagcaaataggaatacattttccagagtgttttaaagaccgtagggtagttctgtagaaagcatccatgtcattttactcttgctttcatagacttcaccacatatttggaatccttaagttttagctatataagtctcctaaaccaaagtacacctagtaccaagtcatgatactgaatttacctagaagctaccaattttatgtataagtatgaaatatactattctagacatttaaaactggacaattatttagcactgtgaagtccactcaacacattccgttgttttctgatattttgaataattatctatattacctatccctttattaaaaaacaatcactgtcaaccacgactgcatataggagtgacctgcagaacttgatccttccgcctgggcgttcctcactgaattggcctgcctggagttgagtgtaggtttgctttagagttccctcaagtgcttttaatgtgacaccagagttgataattgttgccatcaaatgatacttttttaggaaacagagaaaatatgtaacatgctagactcctctaaactgcgaattacactgttgttagtgcgaagacctctgaaatataaagttaattatccattaaatcctttatgtaacactaatttcctgacagtccataatgctttataatgtgaacacagaaggaatacaacaaaaaatttcttcgatgtacagaaattgacttcataaacaatgtaacgaacgtgagtaaatcctttctgaggactttccaggctctcttgatacatgactgatgcttctaccagcaatgtggatgctcttgaaagatttcaattgtctaatttgtgtattctcatctaagtaattaagataccacggctatttaaattgtacttaatttaagactcactgagttctgaacaatgcaatcatgattttcccaatgggagattcagtgcatgaggctatatttttaaaaaaccagtagctcagagtcagttttgtattcttcataaacctgggctcatggctgtgaaagacagttgctaccctgcaacaccttgctcctgatatctatgaggtttatgttttatgttcttttctttgttctttgtttcctacttaaagagatagggcatagatggatagatggggggagagaaaatcgaagcaatatatagcacatacctctcgagttcatgcagatagtaggtacccttgtggtttttagagaaagtgaccatcaagctgacaagtcgtgaattaagaagtgtttgttaaaaagttctatgcataagacacaacatatccaggtaacaatatgtgtctagatgagatgagtgtggagtaatgagaaaagatccagaataagggtgcttgtagtgttctaagaagctgggaagttactgatgtgttttacaagaggggttaaatgttcattgtcaaattaacaaaattcctgagcctggggtgtagaatagattgtagtgaaataggactgttggcaaggagccaataagaagtgagtttcagtatctaggaaaggtactgtatgcttccacaggctagccaggatggagaaccattgccacagaagtattttgtttttctagctcttgggaaaaatgagtctttcacctactattgtttgcattgagaatccatctggcagtcttatttttgccatttgaaaatgattagtctcttttcttctgtctgcttttaacatgttctttatctttggttttcaggagttttgttatgacatgtagaaatatagttttcattccattcatctttcttgatgtttatagggcttcttgattctatggcttgatatcactcatcagttttgaaacattctccaccactacctcctcaagtatcagttctgtccattctttctctttgtccttactcgtatgtaaggaagcagatatttggcaagtaattactaccttatctcaaagtgtctttacgcttttactctttcatctctttgcctctcagatcttcaagataaatatttttcttgcatttctttcagtttgctaattttctattcaactgcaaataacctactgttaaaactattcattgctatcaatttcgatgattttattttcatgtctagaattatcatttggttcatttaaaaattatacaaataaagtatcagttttatctttggtagttttcgatgccttcgaatatatatactttttgtatgtgtgcagcatttgtgatcatgagcatgtgggctttcttgaattacttagtacaccattaacagaaatggaactttctcactggttaatggctttttgtggaggtagaggtcatgtgatcctccagaactccgctgagagacaggagagttggctatggcttttccttcattgtgggaccctctacctgtgataattttgacttggaatattctcaaaacaagttatctacctccatggtagcactatggcttgtgacaatgacagtgaagaaaaataattattttacttttgagggttattttttctcttttgttttggtaacagcagtggcaagaccgactcccagagattctaccttaattgatttctgggcaagagaattatttgtttcaggcttggtttttatctcaagtgattctagaataaatgaagtacatttcaccgaataatttttaatgcaagttgtttttcaccatatatttccactgagccctagagagctaggataaataggctaaagtatgcctccataagtaaaaaaataaaataaaataaatgtctatatcggctacttgtcatttctttatttcagccaaaatttgagtctctttcccatatttggaaagtactcccacattatgaatggtgaaggtagcaaataaggtcttgcattataaaagatgaaatgcccaaaatgcttatctcccttgcagctagagcacaagaacatgagctggcttttacaaattccaggaacctaggaccgactttgagttagtgacaaaagaggcaattcagtggaggaatcttcacaggggaggagagactagtcatttctactggatcaatgtaatgacacagaagtagaaacaatgcaaattgctgcatctattgtctcaagtgaatacacacattaagccactttaataactttagagaatatttatggttgcttagtcttgaacctggttctccagtcctctattcctattttgaaataataaaaactttaataaattcctttctgtctaaatcagcaagtgtcagcttctgttgcttgcaactaatacatataattgataaaacagcattattggaagtgactcaattaagttttaaaatatcttaaaatcatcaatgttttagagtagtgaatattaaatagttgtcttcagcaacaagtagatagaattaatttctcttttgtttactcctagcttggacattagagcatcattagtgatttactctgttcaaacatggggatttgtaggagctttgatataaggatacatccagatcatacaattaagaaaaaagtttgatttaaatagggacccacacaaatacacataacatattttaggcaaaggtggaaaactaatttgataaagaggaatgccttttcagcaaatgttactggagtaattgaacatccacgagcaaactaagtgaaacttcacataaacttcacgccttgtaactcaaaacaggtcacagacttaaatataaaacataaagctataaaaaatttttggaaaaacattagaagaaaatctaggactaggcagaattcttagacttgacaacaaaatcatgatccataaaaggaaatattgacaatttcatcttattgaaattaaaaacttttgctctgtgaaagaccctattaagaggatgaaaagacaagctatttactggcagaaaatacttaaggactatacatctctgacaaaaaactagtataagacactctaaaaactgtacagtaaatttttaaaaaaccataattcaaccagaagacaggcaaaggacatgaacatacatttcaccaaagttgacatatatacaaataaccacataaacaggtgtctgacatcattaaccattaggaagatgcaaattaaaactaccaagagatatcattacacacctattggaaaggctaggaaaaagtgacaacactaaatgctgacacgaatccagagaagctggatagctgggtcactcattactggcgggaatataaaatggttcagacactctggaaaacaatttgtcaatttcttgacaacctacatatgcaaaaatgagacctggcaattgcactcctggacattcatgtcagaggaatgaaacttctcacatacaaacctattcatgaatgttcatggctgcttcatttgaaatagtaataaattgaagataaaccagatgtccatcattaggtgaatgattaaacaagctgtagttcaccaaattacgcaatactacacagcagtaacaaaggaccaaactaataataaatctcagaaaattatggtgggtgtctataaaaacaccaatcatcaaatgttacatactgtgcaatttcattctattaacattcttaaaataataaattataaaaatgaagaacaggttggtagtatccagaggttatggacaggaaagagggtatggggtttgtgtgtgaggtagaagtggttataaaagcaaagaatggggaatccttttgatggttgaaatgttctgtatcttgactgtagtaatgtcagtattttggttatgaaatgagatggtaattttacaagaagttactatggggaaaattggataaagagcatgcagggttgttctgtactgtttctcacaactgcatgtgtaacaacagttatcttaaaattaaaagctaattagaaaatgtaagaaggagcatcaaaacctagcctcattttacaaacacgataagccatccagtggggcacaattatagtggaagtagcgtagaaaaatggaaagagtacactcttttagaatcaactgagggatttaattaataacttgtcaattatgaattttgtaacctatagtaagtttcaaatatctttaactctcacttttcttaattatgaattgggtagaagaacaccaacctcattgttgagtaaaataatactttacaagatcaaaagagtgcttagtctatgatgcttcaaccattgaatggtagaattgattgacagataccaaaagcctcctgggacagacctttgaaaaggaacctatttcttggcagctcttctgaactggggttccataggagaagaaactcttaattccttgagtcttccaatgtatgtaatgagttaacttccttcctgtatggaaaatggtagcaactgttcaatacttgtgaattgaggaaaataatgactcaaatcatttttttgtaagtcttaattctctcatgaaactcaggttgagaaaggccaaatgttgattgatgggctgtcaatttctgcgtatcatcaagaaaacagataaaggggaaaggtgtcattctgtgatggtttgaatcatgagaccacccccaaccttccaatatgaattttaaatgatcattactatcttaaagataggcaccagatatttattttaccacagttttaccccagtagctaaactcaaagtctgatacagtgagtgcatgcagatagccgtattgatatattatgtaacattttggcttactttttgcaaacatctgtccaaggatgcattatgtcattttcagcacctaaaggtcaatgcattcatgagataaattctgattttggaagaaaaatcttaaaaaagaaagccatattttgagggtcacaaaagagaggtcaaaaatatttacctcaaccttacgattcatatattaaatcccaaggttactaaacatgtaaaagattaatttatggcttacagaattttaagggattttaggttggctgtatattcatataaacatttccagtgaatacactcatcatttacaaacccatcatgtagttagcttatttaactcataattatgggcatatttaacaatactgtcttctgtagctactccattttcttctgctttccagatctctagaaaaattttttggaaggaaggaaggaaaggagggaggaagggagagagggagggagagagggatggagggagggacggaggaagggagggagggacggagggagggagggaaggaaggaaggaaggaaggaacgaaggaaggaacgaaggaaggaaggaaggaacgaaggaaggaaggaaggaaacaaagggtgggagcaaggaacaaacatgtccttaaaatgaatgaatgtgtttttgctgaacagtcttaataggacaacagttattctgaaactcaagccaccatggcatagaaaagctaaatttgtgtttttgcatacaatttaaccgactgtataaatatatgaatacacaagtatgatttaatggaataactctccacattgtcacctgtgaaaacataaaaatgtcttttcttttggagacagtgagaattgttcccttcaaagtgaggactttacatcctctcccactgttcttcctagaaatgcagcagaaagtgggagaaacatctgccttctgttcttaataatttatagaccccagtatggcccatttagaaatttcacctatttaacaatatgctcaaatcctacttcctccagattgtatgacctatcatcctcatcctggaagttttctactgtctctgagctgatggagttattatttgtaacctaggcccacctcatagggctgtgagggctgtgctcagcacaaatccaagggactgcatttatatagactatgttgtgatcactttggagttgtgtatataatcctggcactgtttcaatgtactgttttccttcttgcatgtttgtctttggtctcctaaaccattttaggttatggcaattatgctatttttaatttttaaatttttttatgtttatggatacataatagttgtccatatttatggaatacatgtaatattttgatacaataatgcaatgtataatgatcaaatcttggttattgggatattcatcacctcaaacagttttcatttatttgtgttgagaacattcaactctactcttctagttcttttgaaatatacaataaattattaactttactatagtcaccctattgaactatcaaacactagatcttatccttctatctaactgtatttttgtgcccattaaccaacctcccctccctactacttttcctagcctctggtacccaccattctatccactatgtccatgagatcaatatttttagctcccacatattgtgagacacgtaacgtttgtcttcctgagcctggcttatttcatttaacataatgacctccattttcacctatgttgctgcaaatgacaggagttcattctttttatggaggaagaacattgcgttgtgtatatataccacattttctttttcattcatccattgatgaatacttaggttgataccatatcttggttattgtgaatactgctgcaataaatatggcagtcatgtatctttttgatatactgatttcctttcttttgtatatatacccagagatgggattgctggatcatatggcaattctatgttcaaattttgaagaacctccatactgtattttagatggaaataatttttatttccatcaacagtgtgcaaacattctctttcctttgcatcctcgccagcatttattattttctgtcttcttaatagtagccattctaattggggtgagataatatctcattgtggtttctatttgcatttcccaaatgattagtgatgttgaacatttttttcatatacctttgactatttggcttcttttaagaaatgtctatgtagaacttttgcccatttttaatcagattgtttgtttatattgctattgagttgtttgggttatttatgtatcccgtttattaaccccttgtcagttgaacagcttcacatataatttttcctatcgtgtaggttttctcttcacttggctgattgtttcctttgctctgcagaagcttttaaacttgatgtgatcccatttgcccatttttgctttggttgtctgcttttgaggccttactcaagaaatctttgctcaaaccagtgtcctggagcatttccctaatgttttcttcagtagtttcacaatcttaggtcttatttaagttattaatctattttgatttgatttatgtatatattgaaagacaggggtccagtttcattcttctgtctatggtctagatagtttttggtgtttgtttttgacttttgggattatttcacttcattttatgtcaaattcaaatggatgatcttttattataatatctgataaattttatattttcatctaagcctgatgaataacagcttttctcagtgaattctgagaaatatgtaaagtagaatttatatttaaatattaaacagctttcctttttagagatagggccttgctctgtcatccaggctggagtgcagtgagtgggatcatggtttactgtaaccttgaattcctggactcaggtgatcctcctgactcagcctccccagtatctgggactacaggcacgtgccactttgcccagctaatttcttttcttttctttttttttggtggggatggggtcttgctgtgttgccaatgttggtcttgaactcctagccttaagcaatcctcctgcctcagcctcccaaagtgctgggattacaagtataagccattatgcctagcctgagagcttcaaaataaacataaagggaatatttatttaatgccagtcaagaaatggctgcttctaaatttcatatgagagtaatagttaactaagaaatagtagtggggaaaaaactttttttgcctaagtacatgtatttcaattattagctgggactttttcattttatggttctctcttttgaattggggaaaatataaatgttaatcattttgcagttgcagtttagtgttctctgtgaaatgaggtttgtataagctacatttgcccatagaataccttaattactaggacccaagtggtttgaacactccattgactttaaaaacaaacagcagtgcaaaacttctgtgtctttgatgttgagctctagagccatcttgactaaattttagaagacttcattacttagaagataaagttcaatgccttttcaatgaaattctattttgtaactgcagtaaaagagagatcactgagctgcattcccatccaaaacgcgcacatagctatcttgatactcatggttttaactagtcacaactcccttttaaatgacaataaaagtgtgcagaatacaaaataaataaagtcccaaataaagcatccaaaaagtttaagtcattatgctttctgctgacagcttaatgtcagtatctgactagaatgtaaaggggaaacagtaaaattacttttcaaaagaaaagtaatagcacctaaagaaatagcacctaatgcatttggatattcatgatttacccaggattcggaattaaaggtgaagtaaataattgttttgctctgcagttagaatctgtaatgtatctggtaggtttttcttcaattacaaatattaaggatgtgttagtatatgtttaatatgtgttaattaaggatatatgctaataagaaataaccaaggatgaagaagtaaaaagatggcattaataccaaccccagcatttactatacacaggaggatacaatgatatgtgagaccctttctggcacaaaagagggcagtcaataaacatttgttaaattgttaaataagtttacattcagaactgcaccattatggttttgattgatatgtacaagaatattggcaccaccttcatagaggcactttgtaatatccacctttgtaattagcttcagcaatatcaattgattgcaatgtaaagcctgtaattggaaatatgccagcaataatatattttatatcttacctaagaagtgttattcgatgtttaatttttacaaactacattttataacttcaactaaatttattttttgacaatttttttgtgaacatactaaaatttagctttttaaccaataaaacatacaaaaaaacacagcaaagtacattgctgttttggagggaagagagtttgttttaaaggctatctaaattaaaaaaaaattagtcctgcattgtctttagatgtatttgttatattgtgatttttttcagttactattttgactattctttatgtatatatttgtctttaaaatttaatgcaaaatttcaaatagtatatacaataaaattgtgcagcaacttttacagcaagtgaaatgttctattaggaatcatcccaacaatatgaattcttactgttttttacacacagtacacctttaacacagctatactgttctgtgggcaggtcagatatcattttctctttatttatttatttatttttatttttttaattatactttaagttctagggtacatgtgcacaacgtgcaggtttgttacatatgtatacatgtgccatgttggtgtgctgcacccattaactcgtcatttacattaggtatatctcctaatgctatccctcattttatacaggaagcccatgaagttaaggaagctaagataacacaagcaggctcagatctgttacactgatttctagcgccttctcagaacacctgtttcaaccactgcacacaatttcatgacagtgtattccacccttaccccagaggaggttggcgtatctctgaggatgccgattggtgtgccatcctagactaggacatgataccctttttctatataatctacagtaattctaaggctcctattttatatagtttttccccaatttaattggaaccattggctgtatctatttcaattcacagtccctgatgagtgcctcaaccaatctcaaaggtaatgtcactaacgattcctcagatctcttgatcactttccctgttatgtgtgcagtctaccatctttgaaaccctaagatgcatgcatcactttaaatgtactcaaagattaagacaggttctcaattgtacttattttaaaacctgaaaaacctttacaaaaacattctatatgcagcagtatgattctgaaatgtcttttcttccatctcattgatgttggttttgataatgtgattttatgacttagctggagcttatcaaagactacattgtttttgtctctgaaagaactctccacagacttctgcttcaggaaaatccagtacttcagaatattaacattatttaagccccagctcaagagtaccaagttctgaatatcaccagagtgtaatgcagacaaagaactttggaaatagagacatttggttgaggctgtggactttccttcttcatacctcatctgtaaaatgggcatgaagtatcaaatggccaactcccatagggttattgcaagacgtaaataagataaaatttgcaaaatgccaggtgcatggtaagccctataccattttacctattgatattggtatttctaaacaagaaatacagatttgatttgccacaatgaaggagtatctttacatttaatttcacctctttggggacgacttctttttttgccacagggaaaacagttttatatctgatacagtcaaagtggaaagctatgatgttttaatccagagaaattacttgattacatgtggttttaaacgtattcattggacaaaattgtgtgcatggattgatgcatgggaaagacacagaaactggtgtggggttaccaggctgatgatgtcttgaccacactctgcgttgaggcatcccagcttcctcacctggagaactgggcttcctcaccttcacctgactagctcttccctgccattaaaacaaagcaaagcaaaacaaaacaaaaacaacttccagtttcccttaagtttttatcatccaccagaagtccagctagaatcacttagaaagccctcaatttctgaaccttccatcatgtgtaccctaacggtttccagcccttcctctgcttctaatacttgactgtcccatctgtctggaaggccagggatccacacatgtgtgtctcctgctgcctggcccactggaccgccttccctgtcttctcctcctcctcatgccctctctccacccaccactacaagagttctgcttttaaaaaaatcttatcctctttcccaaagaattcctcaagtcctgagccctacaattttattagtgcttctcaaaagacttctctgaaatataattttatactttaatctcactttcagtgtccagattggcatactcaaatttttataaaatattttctgcttcctactcatattttactccaggccaatgagtctaaatagaatatattctgttccctcctgaaccagctactctatcatgtagaaacatatattaagtagatatttctgttaacactgccactgttttcgaagttattcaatattagacctcaaaggtaaaactgtcttgtctttatctcaatgagaacatccaactgagtgctgtatcttattggtgctgcctcagaatgtctctaccttctgtggtctctttccagttgatatactctgtttgtgtaacttaaggcacaagtgttggtgtgactttctaatggttctttttactgctcgctcaattatccttgtacttcctgctagattaatttttcaaaattttggtttgaaacataattattcctcttaaaatttcccatgctttttcattacctagactaataatttaaacttaaacttgcaattcagaactatttgcaacatctaccattgttacatttagattttttaaatataatatttcaagcatgatggaaattgcagagagtcacattacaaacctccaagcgcacactactatattttagaaagttcttcttttcctttaaattttttaacatagaaaaatgtggccaggcgcagtggctcacagatgtaatcccgggactttgggagactgaagtgggaagatcgcttgaggccaggagtttgagaccagcttgggtacatggggaaaccccatctctacgaagaatacaaaaattagccagtcatggtggtgaacacctgtagcccagccacgcgggaggctggggtgccaggatcacttgagtctgggagatctaagctgtagtgagctgcgatcatgccactgtactccagcatggacaacagagtgagatcctgtctcaacaaacaaacaaacaaaaacaacaaaaaatgttgggaattgaagacccatttgaaccttttgctatcttgccattttcacactgaagagttgcctttggtatttatctgtgttactacctaagactagtctgtacacttcaaccgttgtattgtcctctactacataagttaatcacttttcctctattaatagacagtatcaggtattgctgattttgctattacaaaccatgcttcaacaaacatataattatccttgattgcatgtatacatgtttctccagggtatgtggatagaagtagaaatactggtttttaaaatgtgtgtatgttcactttactagatgttttcagattgctcatgattgttttaatttataagcctagaaccaatgaaatgaaaacttcttttgtcctcagcaaaaactactattgccagatttttccagttatgaaatattccaaacatacaaagaacataaacttttcttaaaacataatttgctgtgtttcagattttaaaaaagaaataaaatgaatataattgaggcctggtgtatatcccaatatagttatttcagaagaaaactcatgtttataattctatgtacagtttttctacatttattagatttttgtatttctttaaataatatttgctattgaattacgtagcttcaactttatataatcagaattgtacagaatgtgatttcctgtttttgctcaagattatgtttttgaaatgtaatagttttgatatatagagttgtggttcattcatttttacttctatatactatcgctttgtataaatacctacaatttgtattttaatgcaaatgtgcaagagtttggttaggttatatgcttagaggtggatttgctgggcataggttggccacatacttaccatctactgcaagtttgccagatggtgtatccaaatgcagccaagtaaattccagaaccttttgctctaccttctcagcaacccatgacagtgtgagactttttccccttggataaatgagtgggtaaaagttgcatttctctgcactttgaacatgttttcatatgtttattgaccaatagattttcttagttttgaattatttcttcacggctattgattagttttctatgtgacatcttttcttaatggtgtacaagaatgccatctatattttaaatattagttatttacagttatacacaatacagttgtcttatgttatagcttgcctttaaacttgcttatagtcttctatgtcttactaacattttacattttaataaaatcaaatttattctctttgtgacttataattttttgtcttactcaagaaggctctctttacaacaacataaagctactatcttctagtctaatgacacaatattctgttctaattaagccacatgtagatctttaatcaatgtctaattaatccttatttcagggtttgagtttgggatttatttgttcccatataggtagtctgtttttcttctccatttattaaaattcttgtgcatgagcttgttaaacatgcacaacttttcatgttttcatacatgtatcttcaatattgtgctggatttactcaggcaaatagagcaacatgggcaggacaaaggcgtaggggtctcagaatacttgccatcatgcttcagtgccacttgtgtgtaaagtgtgccagattaggtcaaattagttaggtcagagtaacacagtaatattttacatgtgcagtctagattattgtgagcaggactggaagcaggagtactatatagatgccaggcaaaaagtgcaaggaagggtcggcgtgagcagcaaaaatagagaagaattttgctgttgtagtcagagtagagccttatgtgcattgtatcattatgtaaatatggatcgataatttgcccacttccagtttttttattatatatatttatgtttatataataattttttcttttcccactatcacagcttgtcacagtgctacctgctacttaggaccatttaaaaagccaccttgtttaaaagctttttctagatgtcctaaacactatgtggtttctgctcctccccctttcaattatttatggcgctctgcttgtgcccttaatataccctttttccctgtttttcattatatttacatgttcatgaaattaatttgttctcaattatcccacaatgatatatgtcctttttaagatctcactaaaatgtattaactggaaatttgaatgtattataaaatattttattcattgcatcatgattaaagcaatcattttttaatttttagaaaataatttaaaataaaaatacaagtttaaaataacctttaatcagatatttgcaattttaaatcagagtattctgatttaaagtgttaaaaaaaatgttgcattaaaatttaaaaaatcatataaactggtaaacatatgcttaatctcctgattgcttatattccttgactttatttcactatctgtatattgagttgaaatatttctttaaatattaaggagtgggcaaaactgtcctaaagattattttaacactagcataatagagctagatatacgtattcatattatttttatttctggagaaatttttcactgccctaaaatcgcaaagatattctcttacattttattctaattgttttacttttaatttttacatgtaagggatccattcacctggattgttattggttgatgagagattatgatcaggttaattttttcgtatgtgtagctagttttctcatcacaatttgttaaataatctgtccttttccattcatgttcaatgctacttcttcatataccacatttctgcatatgtgtaggtaatatatgggcttccttattctgcccaacttgttcatttatgtataatgaacactgctattcctccccatatccaaacacattttccttcctctccaaagctgtccaggatcttcctaatcctttactttgtcatttgcattttaggatttgtttattaacttgcatcaaatactttgctaagatttgaataaaaaattcattgacttttaaaattagaaacgtaattatatacgcatttcaggcattacatggttcaacttaatttacaaatgttgaaatgggatctcaaaagggtaaactcagatcacctatgaaagtcgttttatttctaattttctaggggaagatataaacgactaaactttgggccatattactaaacattgtagatcatgagtatgccattaaaacataataaattgagaaacacaagaaaatctacaaagttagatattcaatcaatacagtgaagtgattttaaaagtgtcagaaatgattgtgttaacaaacattcatacccattttttcactttgtagaatatgatatgtgtcacattttgactattttctccacctagtcattcttcatctctactagtctgatgttaccctaccttttattcagttatttgacttttttgtactctcctttatttctttttttaacttctattttaagttcaggagtacaagtgcaggtttgtaacataggtgaacttgtgtaatgggggcttgttttacagctgatttcctcacccaagtattaagcctagtgcccatcagttatttttcctgatcctctctccccttccatcctctaccctccaaaaggtgctagtgtgtgttgtttccctctatgtgtccatgtgttctcattatttacctccaatttataagcaagaacatatggtatttggttatatgttcctgtgttagtttgctaaggatcatggcctccagctccatccacgtcgctgcaaaagacatgtgctgtctctctctccctctccctctctctctctctttatggctgcatagcactccaacaaaggtctaatatccagcacctataaggaacttaaacaaaattacaaggaaaaaacaaactaccacataaaaacgtgggcaaaggacaggaacagatacttctcaaaagaagacatacatgtgccaacaatcatatgaaaaaaagcataacatcactgatcattagagatcattgtgcaaatcaaaaccacaatgaaatgccatctgacaccagtcaaactggctacagatgatggcaaggtggtggagaaaaaggaacgcttatacactgttagtgggagtgtaaattactccagccatgtggaatacagtgtggtgattcctcaaagacctaaagacagaaatactattcggcccagcaatcccattactgggtatatgcccgaaggaatacaactcattctatcttaaagacacatgcacacatatgttcattgcagcactattcacaacagcaaaaacatggaatcagcctaaatgcccatcaatgatagactgattaaagaaaataaagaaaatgtggtacatatacaccatggaataccctaccttttttttttttttgagatggaatttcactcttctcacccaggccggagtacaatggcgtgatctcggctcactgcaacctcagcctcctgggttcaagcaattctcctacctcagcctcctgagtagctcgaattataagtgcccaccaccacacccagctaatttttgtatttttagtaaagatggggttttaatatgttggccaggctggtctcgaactcctgtccccaggtgatccgccggcctcagcctcccaaagtgttgggattacaggcgtgagccatccggcctggcctggagtaccctacttttaaagtgatttactttctttatagttcctcatgatctttactttgtcttcattgtactgtactaataattaaattataaaatatagagaatatggtttttatatatagagaaaatagattataaaatatagagcatatagattatttctatagtaatctgcacttctttgttttgtgcccacacaatgtgggctctgtatacaaatttgataaattaaaggaagtgtatttaaaatcctatcgtttatgtcttcattcattcattccatgatacagatttagcatttacttggtgccagatatgattctaaccattctcagatatttaaattcttactacaattgccctttcaagaaagatttcttctttattatctgaaatttgagtttcaaacagaaattaaataattaatataaaaatataaatgttgggccccaataaggattaattcttaatccttaagaggataactctagagcttcctcatgaaaaattactaagttatgtaggtcaaagagaaagtgatttagaatataaacctctgatagctcacttgctggataaaataccaaaaataataaaatccaaatagcttgcctaggattgtctaacatgttcaaaaacaaatcagctttttccaacaacctctctattctccttttataaactctaataaatttttaaaaagtaaaaataaaaggacttgctcaaacaaactcctagagtgtcagtgtggtactatattttacatcaatgatgaataatcatcagaatcattgtctttaattgtggaatcatcattcatgtttattagtgtttccttataggcacctacgtgatacgtggaaaagaaatctgcaaaatcaaagggtagctttagtgtctgttgcttttcacaaatgaatgtactcatgatgaaaggcctaacattgcttggactacttcgatctggaataagaagaaatattgcctgttcagaacagccacaggagaagtaattaattgagggctttggaatcagtgttttataggaaatgatttaattagttgttctatccattggcttcaaaaattttgttgtaatatatgcttcagtttacccctgtgactctgatgatttccttatgcatataaggaaattataagagaattttagtagcatggacatattcctgtgaattgaagatgtgatgaaaacttctaatttaagaatctttattctttggagaacatgtggttctgccctgtttaactgcacactaaaatgatttaatttactaaatgttaagatgatctaaaattccagaatttaaaaatgattggcttttccttatttactacacatggatattttatatttctatcaaaaatatattggaaatagtttcttagattcctgtttgtacttgagattttatgcttaaatatatgttgaaaaccacaatgtattcaatcaaagttacatttaatacaaacaacatctatatctatgttgatttttctataaggaaaatattgagggatacatatatatatatatatatatatatatatatatatatatatatatcttattaatacaactcaaggtcttccttttcttccgtaccacctctaatgcagtgtctgtaatttgtgatgatttttgcattctcacagttgtaatttctaagcctagtataacaagttaaacctgttaaaaagagagaaactattgttttcatttagatgcacagtataagattcattgctcttatctctggaatttttccaaagataaattggttaaactattcattatcattatgaaacattattattgattatgaaatgctgataaattagccgtttttatctaatgaaatttcctttttatgaaagtgaaccataaaaacaatctcagtgcataaagggttatgcagctgcttctgaaataaatttctaagtgggcattttacatcattgatcttcaaaactcttaattatcaaaaagcttttaatctgtagagggacaattataactattagatctacctgtgttggaaggtctaggatttgactgattacgaaggagaagaaaaagccatcatttccaaaaagtcttaggttgtctacatcaaaactgtcatctttttaacatccaattttagaatatttattatgcctgtatcttcagtctaagcattcagaaagggactgtagttaatgacaaggaaagtaggtcatttttggcttattcagatttaaggtacaggttatttctttttactttcgcttttttattattttttgagagcaagggactattctcttcaaaatataaaaaagtctttcatcataaaaatgagttgctctttattaaaatagcaatcacaaaacgtagaaaacgataaagaagttagttggacttacccaaaatctcccccgcttcctcattaggattagtatcattattcattctttgaatgaatctacctagatgtttttctttccctaattggaatacatacataattttattttgcaaaaatagcagagagtatatgcaatgctttataggaatttttttcccgcttgaaaatagattactggccgggcacggtggctcatgcctataatcccagcactttggaaggccgaggctggtggatcacctgagttcaagagtttgagaccggcctgattaacatggtgaaaccccatctctactaaaaatacaaaattagccaggcgtggtggcgggtgcctgtggtcccagctactagggaggctgaggcaggaggatcacttgaacccgggagacggaggttgcagtgagctgagattgcgccactgcactctagcctggcgacagagcgagtctccgtctcaaaataaaagaagattactaatgttttcccatgtcaattttcctagctcagtcaacataagaccaccattgacagcctccactgtgacaaaatcaggtttattacctcagtttaatgaaggacactgcacagcagagaaaatttaggagttctcaccaaactaaggaaaagagatagttattgcagcgtctagggagtgatggagcttaggggaaatgtaaataaaacagtattttcagcaggcacaaagcaggactatttaaagggattaacatcagttctgaactgcagtgtaaactgagagtcctttttccttggaaactacagagttgagataattacagagagctgtgtccagttaccccttatctgaatctctgcacctgagttgtcagttgctgtagcttctctgagtcaaagtaacttagcaactctaggcaagagtgggaggtttcattcttatttacataatttcaaacatcaaagtttctgacagcaaacaagatttctcagtgagtagaaaaacagtattcattcataaaagatgatccttatgctgcccttggttttataatagcttatctttgggagaaagggtgactcctgttaactttgcatcgggcgctacctgtctcattccagcccaagaatggcagggctgatttttacagtcccaattaatttttaatttctcaccataaatacaagtgtacacaattttcaatgtgtatgatttacagataatgcataatttgtttaattactgcctactgttgaaatctccccaccccatggataaagtcttataagtagaattgttgggtcaaagttatatattttgtaactttttaatttgagatagtttaaggcttacataaaagttacaaagatagtacagagaattctacatacccttcatctggcattcccttatgttaatatcttacataagcacagaataattatctatcttaattttttgttttgcaggtattaaaaatagcatcctacatttaaacatcatactttaaaaaactgcagcttaaccataggaactgatgttaagtcttaataaccaaaaataaaaagaaaatttgaaaagaaattacaattaaacatcgatatttcacaatatagtatacaattagtgagttttttcccctaaagattattaaactaaagaagtttatcattttgtctgggcatggtggcccatgcctgtattcccagcactttaaaagaccaatgcatgaggattacttgagcccatgagtttgagaccagcctgggcaacatggcaagaacctgtctctacaaaaaattaaaaaccttagccagaagtgctggtatacatctgtagtcccagctacttgggatgctgaggtgggaggattgcttgtacccaggaggtcaaggctgcagtgagccgagatcatgccgttgcattctagcctgggaaacagagagagaccctgtctcaaaaaaagagaaaaaagtttgccattctaattattttgaaatgtgtaaaaaatgtgaaagccacccataaactgagtgaagagtgaacctttaatctgattgctaacaacataatgctattttgagagaagagagggaatgaatatgcatatttctgtatttcaacaaggtttcaatatgtaagattaatctttttcacagtttgagtaattatataatgactactggcaacagtgatacatttggtggtgttactgcataggaacttgtttccagagtttccaagtttaaattctccccttcaaaaaaaagaaaaagtgattaatgaaagaaaatacaattttatttaaaatataaattcatacaattttaaaaagatttcattaggaaacatttatttgtgttgtgcttgatataaaattaatgaattaagctaaggagttgccccctaggatttcattattaaagtgtgtgtgcattatattttctggcacattccatgttaataaatcaaggctttgaggttatggacatgtctgcttgacctcaaagcacagtgatttatttgttttgatggttttgattactgcaaagtcatagaagtggaggtttgtgaaaactgtggtatagctagaaacagaagctctcttctaccttatttagtcttatttaaaaagcttgattgtgtgttctaatgcatttgaatctagtttaagtctatatattaataaagttataattagaacacatccacaatttttaggagatctgttagcattttatttattagtgctaattgaaccattgatagtaaaacactcttagaaagcaagtttcaattttcttcctgaattttttttctgagaaccaatgtaatatgttaaaatatctcattgttaagttgaaagacaaaagcataatagttttgactacatattgcaatagaaatagcaggaaaattaaggatgtcttttaagtgagctacatttttaaaaattgtatcaaattttgtaagtaaactataatgtaataaaaatgcatttaaccaaaatagcagccaaaaattattccagatagagataaagctcatatacatctaagtctcatgctctacttgaaaatgtaatacattgagccacattgcagggaagaattcaggacagtgagactcagtgtgcacacaattttagaagctttgcactgtctgtgtcatctgtatatattgaaaaaaaaacaaaaacaaaaaacaaaacagttattcttcccttctaaaaacctggatataagtagtttggaaagaaatgtagactgtttcctctgagaaactagttaaatatatagtcacttttatgacatgaagttcaatagagagcacaaatatagaaagaacaatgtgcatttcagattttgaattttgtcacatacattcctatgtactttttcactacagattttctatatactatataaagttttcccaacgcatggctaatgtaaaaagaaaactacatgtactaactttatagcctcaactacagcaaaatttcctgatcacacatgattttttccactaggaataatcagttccatctgttatcatacattttaactatttcttactaatttttaacttctcttccaagcataattatgtgaggtcaggttcagttttggtgtgaaagcaatgaaagtgtctgggaatcctggtggagccagtagaagcaaggctgacagtcagagtgatgtttgagatgtggttttcaatttctctaccattccacaaatacctattgatttctggttctgctggaatttttcttgattaacgtttctgccacatgttctccatgtgatcttggacaagttaattaaacactttgcactttaaacttctcattgaacaaaatggggaaaataattcttccccttcagactgtgatgagtctcaaaaaataaatgaaagaagtaacaagtgccctacatgtaggatgcacatggagatttgcatgtggcatgtgtactggattgttcctgggagatacatacataagaaaatggaaaaggtggccaggcacggtggctcacgcctgtaatcccagcactttgaaaggcagaggcgggcggatcacgaggttagagcatcgagaccattctggccgacatggtgaaaccctgtttctacaaaaaatacaaaaattggccaggcacggtggctcacgcctgtaatcccagcactttgaaaggcagaggcgggcggatcacgaggttagagcatcgagaccattctggccgacatggtgaaaccctgtttctacaaaaaatacaaaaattagctaggcactgtggcacccgcctgtaatcccagctacttgggaggctgaggcaggagaatcgcttgaaccagggaggcggaggttgcaatgagccgtgatcacgccactgcactccagtctggcgacagagcgaggctctgtcaaaagaaaaaagggagggagggagggagggagggagggaaggaaggaaggaaggaaggaaggaaagaaggaaggaaggaaggaagaaagattagtgtagggagggagggaaggaaggaaggaaggaaggaaggaaggaaggaaggaaggaaggaaggaaggaaggaaggaaggaaagaaggaagaaagaaagattagtgtaggggatcctgatccacaatgaggttgcagctgcggtcttagcctgctccacagttgagctctggaactgggatgggccttcagagttgtcacaaattgaggccaatgaaatagtatttgcacttgcacattggccagtcactaggctcaggttttctccttctcccctcaatatcctgacttttaagtttattaatcatctatttatcaaatatttatttaagctgtgcgctctactggaaatgtaaatacagataaaatatgggtctttctattaagaatgcattgaactggtgggttgatttagtaaacaggcaaatgtttggaatcttgtagagtcataataaaaatagagatgaatgctgtgcttctgaggggagacagaaagcggccttttcattcgattgtcgacacaaagtgggaaaggattccttaaacctttcttaattatgtggatcttgaagtagatctttggaacaataaagtcaggatggatactgaagtggtaagaagttcaagttgtagaatagcattaaatatcatttttcaccttaatggaatgtatttttaaaaatctttttattggcttacttttttggcctaaagtatttccaacttattattgtttttattttcaaataatccatattatgtgctacaaggaaaatacataaatatatatttcagttatatttccccctccctctttcgtttttatccctttaaaatgtatccagtgtttctcttggctcatatgtgcttttctttagatgtataaagatactatttaatataatttaagataatatccctttattccctgctatgaaaactgataaagttaatatacttttaatccttcttttctttctaatttttgtgtactattttaactgaaggtttttaatatttatgtcctgtcttataattacagttcttacaccttagttctctatttaaaaccttagttctatattaaaatctatgtgataaatcaccgcagcctctctattcttgagttctttgtcttgatacatatacgaattatctggatttttttttttttttactttaaattctgggatacatgtgcagaacgtgcaggtttgttacataggtatacgcgtgccatggtggtttgctgcacccatcaacccatcatctacattaggtatttctcctaatgctgtctctccccttgccccctacccgctgacaggccccagtgtattatgttcccctccctgtgtccatgtgttcattgttcaactcccatttatgagtgagaacatgcggtgtttggttttctgttcctgttgctgagaatgatggtttccagcttcatccatgtccctgcaaaggacatgaactcatccatttttatggctgcagagtattccatggtgcatatgtgccacattttctttctccagtctatcattgatggacatttgggttggttccaagtctttgctattgtgaacagtgctgcaataaacatatgtatgcatgtgtctttatagtagaatgatttataatccctcgggtatatacccagtaatggaactgctgtgtcaaatggtatttctggttctagatccttgagcaattgccacactgtcttccacaatggttgaactaatttacactcccaccaacagtgtgaaagcgttcatatttctccacatcctctccagcatctgttgtttcctgactttttaattatcaccattgtaactattgtgaaatggtatctcattgtggttttgctttgcatttctctaatgaccagtgatgatgagctttttttctatgtttgttgcctgcataaacgtcttttgagaagtgtctgttcatatccttcacccactttttgatggggttgtatgtttttttcttgtaaatttgttcaagttctttgtagattctggatattagtcctttgtcagatggacagattgcaataattttctcccattctgtaggttgcctgttcactctgatgatagtttcatttgctgtgcagaagctctttagtttaattagatcccatttgtcaattttggtttttgttgtcattgcttttggtgttatagtcatgaagtctttgcccatgcctatgtcctgaatggtattgcctaggttttcttctaggatatttatggttttaggtcttacagttaagtttttaatccattttgagttaatttttgtataagatgtaagaaaggggtccagtttcagtcttttgcatatggctagccagttttcccaagaccatttattaaatagggaatcctttccccattgctggttttttgtcaggttttccaaaaatcagatggttgtaaatgtgtagcattatttgtgagtcctctgttctgttcagttggtctctatatctgttttggtaccagtaccagtaccagtaccaggctgttttggttactgtagccttgtagtatagtttgaagtcaggtagtgtgatgcctccagctttgttctttttgcttaggattgttttggctatatgggctctttttatgttccatatgaaagttaaagtagttttttctaattctgtgaagaaactcaatggtagcttgatggggataatccaaaggaattatctggattttatcatatcttggaaatattgttcattcaggcatatcttaaaaatgttattggttcagttctagaccaccacagtaaagcaaatatcaaaaagagtcaaacaaatttggaggttttctggtgcatataaaagtcatgttcacactctgctgtagtctattaagtgtcaatatcattgtgtctgaaaaacaatgtaattccttcattaaaaagtaattttttgctaaaaatgccaatgatcatctgagacttcagtgtgtagtaatattttgctggtgaagggtcttgcctcaatgttgatggctgctgacagatcaaggtggtggttgctgaaagttggggtgggtgtggcaacttttaaaaacaacacaacagtgagtttgccacatatattaagccttcctttcatgaaagatttctctgtagcaagtgatgctatttgatagcattttatccatagtagaacttcgctcacaattggaataaacaaagtttacgtaatattataaatcctttgttgtcatgccaaccatgttcacagcatcttcatcatgagtagattccatgttaagaaaccactttatttgcttatgcataaaaagaaacttcttatttgttatttgttaaagttttatcttgagatttcagcaattcagtcacatctttaggttccacttctaattttagttatcttgctatttctactgtgtctgtagttccttcctctgctgaagtcttgaactcctcaaagtcatccataagagttgaaatcagcttctttcaaactccctgttaatgtggatattttgacctcctccaatgaatcagaaatgttcttcatctaaaatgctgaatcctttccagaaggttttcaacttactttacccaattccatcagaggaatcaccatttgtggcagctacaaacttatgaaatgtatttcttaaataataagatttgaaagtctaaatgactccttgactcatgggtggcagaatggatgttgtgttagcaggcataaaaatgacaattatcaccaggtataatggtcacgcctataatgctagcactttgagaggccaaagtgggtggattgcatgaacccaggtattcaagacgagcctgggcaacatggtgaaaccttgtttctacaaaaactacaaaaaaatagctgggtgttgtagcacacgcctgtagttccagctactcgggaggctgaggtgggagaatttctggagcctgggagatggaggctgcattgagctatgatcataccactgcactccagcaaagagtgagacctggtctcaaaaaacaaacaaaaacaacaatcacctccttgcacatttccatcagagctcttgggtaaccaggtatattgtcaatgatctgtaatatttcaaaaggaatctctttttctaagcagtaggtctcaacattaggcttaaaatattcagtaaaccatgctgtaaacagatatgctgtcatccaggctttgttgtcctgtttatagagtactggcagagtagatttagcataatctttaagggccctatgaattttggaatggtaaatgagcattggctgcaacttaaagtcaccagttgcattaacctctaacaggagagccagccaatcctttgaagctttgaagccaggcattgacttctcctttctagatatgaaagtcctgaatggcatcttcttccagcagaaggctgttttatctaaatttaaaatatgtttttagaacagccaccttcatcaatgatcttagctagatcttccggataacttgctgcagctcctacatcagcacttgctgcttcacctttcacttttgtgttatagagatggcttctttcctcaaacctcatgaaccaacctatgctagtttcaaacttctcttctgtagcttcctcacctctctcagccttcatggaattagagtgagggccttgttctggattcggctttggcttaagggaatgttgtggctggttcgatcttttatccagaccactcaaactttctccatatcagcaacccaggctatttcactttcttatgattcatgtgttcactgtagtagcacttttcatttccttcaaaaaattttccttttgcattctcaatttggataactgtttggcacaagagctcttgcttttgggctatctctgctttcagcatgccttcttcactgagtttatttttagcttaatgatttattaatcatttgtagcttttgattttgaagcaagagatgtgccactctttgtttcacttgaacacttagaggccattgtagggttattcatttgcctaatttcaacattgttgtctcagggaatctggaaggtctgagaagagggagagaagtgggaaatggctggtcagtgacatcagaacacacacaacatatttgtcaattaagtttagcatcttatatgggcatggtttatggtgccaaaaacaattataatagtgatatcaaagatcattgatcacagatcaccatggcagatataataataatgaaatggtttaaaatattctgagaattaccaaaatgtgacaaagagacaggaagtgagcacatgctgttggaaaaatggaggtgatagacttgcttaacacagggttgtcacagaatttcaatctgtaaaaaatgcaatatctgcaaaacacaataaatttaagtacaatgaaacaagttatgtctgtagttgttttcaagaaggcattcggagtagccatgagtctgttctctgttttaccgtatatttgggaatgtcggccttcttacttgcaggataacttgagcccaagtatatttcttgggttatagtctttttcactgagacccttgtagacttttttccactgtcctctagcatttattgtgtctgtgaagaatttcagtctctccaatatctcacttttctacacaaattgctttttcttctgtgatttttgttcttttatacacacacaaacacacacacacacacacacacacatttctttgactatgagatacgttgaacatgaaacaaaaaaataatggtcgatttatgtagaactgtgatcctgggagagaaaaacaacttgacattgtctgattgaaggtttaatacaagtactgagtgagtaggtagtgaatttcatcagcttcttgaagtatttcaaatcctactatttgattttcaataggctaacttaaaaaattagttgactattttaagcgtttgaaattacaaaggcagaaagatattaaaattaaacttttcaaattaattctctattccctataccacttaatttccagtaaattgtgtgtgtgtgtatggttttgtattcagattaaatctgtccttatagccaacaaccaccataaaaatactccttacatgaataccagatgaagttaaagtaacattttattacagtttttatcattatactgttactgtaacgtcaaaaatagtataaaagtatgataaatattatgagtacttaatttttgaaattcaatagttgtttgtttcttttctgtccatctttctcacaaaggttgtgtatatttttagctaggcattttcctttgaggatctcaattattttatactttctgaaacatttttgcaatttaaaacattaggagactagagaagataaatttaatacaataaactttgtacataacatctgttgttactcaacttaatatgaattacttattttgaagtatattttttgtaaagaagaaccttcaagtctatactggacctacctccaatgattcattcaaacatgagtagcataaataacttacatttacaaggtatttccaaattagataattatgttctttgagcccaccagaacatgcactggataatatagcaataaacgtagctgaaaatgtattcttcttttttataatataaatatcaatagccaggggatgcacagaataactgttgattcaacagctgttgcattgtgaaaagcacaataggtgttttatgatataaagagatggcccagtggtacaggtagaacaccggtgtgcataatgttacacagaatgtgatgaatgccttaaggaggagacaataaggcattttggatattgagagaaaagaaaaaaatgttcaggctggaaggaaggcagagttcagaaaaatactttaagaaaggagatgacatttaaggtggggattaaaatatggttaccccggaacatgcagagatagaggtaagagaacaaggtagtcagaggatttggataattccaaattgtgtaccaatcctgcataattaatcagtctgtcttttaccttgtgtttttttaaattcaccattaatgttgttttttacttgcttaattctctcttctaaaaataggatcaatttgttcattttatgaatattaacagtatttgaaagcatattttatgttctttttatttttaaagatcttcaaagactcttaatatgctttgtgtattagtccatctcacgctgctataaggacatacccaagactgagtaatttataaagcaaagaggtttaattgtctcacaattcagcatggctgcagaggcctaaggtaacttacaatcatggtggaaggggaagcaaacacatccttcttcacatggcagcaggaaagagaaatgcagagcaaaggggaaaaagccccttataaaaccatcagacgttgtgagaactcactcactatcagagaacagcatgggggaactgcccccatgatctaatcacctcccacgaggcccctcccgcaacatgtggggattacaatttggattacaattcaagatgagatttgggtggggatacagagacaaaccatattattttgcaaattgtttttcaacaatagacgtggaatttctgtttgctactttacacatgttgcttattgtctttacacatgttgcttattgtcttatactatacttatatatgttgcttattgtcttatactatacttatatatgttgcttattgtcttgaggacacttcattgcacatctttcattgtatatctgtgtgaatattttattagtgtttctctaccttactgggaggtgcataagattagggatcatttatttctcactgcatactaatagcacaaagcagacccttagcagatgctcaataaatgcttgtttaatttatttacaaataatggagggaaacgaatgttgcttcacactcattttatctaaaataatgaagatcactcattttttttcatttggtataccaaagatacgaatacgcctgtttaccttacaacaaatgcgtcagtagactcagagcttgaattaatttctttcagagtaaaaagttacatttacataggatctatagatttctgagcatgacgttccaggttgttaatttgaaaatagctctgtatgactagaaagattttagtgtttgaatatgacatttgactacctgatgaaggcatagctcctctcagcaaaaaactagaggcagattcaagagatcttgtgagaacaccagagcacagtggtcacgtgtgtggagcaagaccatctcaggttgaaacccagctccagcacttccggcaatgtgacctcagcaaatttatcttctctttgttctgcagttttctgttctgcaaagtgctactaggtgatgattcaatgagttaaatcatgtaaataacttacatgggaaaacctgaacccatatctttttcttgtagcctataagagagtagcaaactgtcatctttgttctgtttgtttccaaattctgttttctgatatgattgtgcttgagacagtctaaactccttagtgtgacttcaaaaccattcaggagccgtctcttacttgtatctccggcattttcttgtgttactttctatcccttgtactaaatgctctatccacaaggaattacatgcccttgactctgtcttgtttgaaggagttgctgatagtggtatttagacatagacccatagtattcttgctcctgcgttttgctaggatagatcctcagataccacctcctgtagtcatcatagtcctcacgttcagagtggaggtcaagtctgtgtgctcccttaacctgctgtgtacactctatgcttgtacttaccacattccataaacatatgtacacacacataatcatatatatatatacacacacaatacacatatacatacattaatacatatacagatatatgcatgtgtgtatatatatgtatacgcatgtacattatatataatttgtctctacttgtaaagcaatcagggaaggttataagacaggatattaaaatatgtaagttttaagatggctttaaatgacttcgaggaaatggctgagctcatggaggatcaagtacagtaggcagtttaggatttttaaagccctttgatgttttggagagcacggcactcatcattgcagcctaggctggttcacttgcaatgtagctaaagaaactattgtagcattatctcatgatggctgaatatttgaagagaactaaagaaacgttgtggatgtataactccaggaactcattgccttagtgactgcacaaaaagggcaccatatggacttgattcaatttgtggttgttctccaagaatgcatttcccaaccaccgaatcccacacatgagctatgcctgttttgtaaatgttcctctgaggtttacttggatgaaaacttcagtgggaagaatttgccatctttattgctgtctccttagtgccgaataccatattgatttttatttttatttttaatttatataagttattattgaggcaaagttaacataatataaaatcaacctttttttttttttttttgagacagaatctcactctgtcccccaggctggagtgcaatggcacgatctcagctcactgcaacctccgcctcctggattcaagaaattctcctgcctcagctcccaagtagctcttgaaattgagaaatatgagtcctccaagtttgctttaatttattttttactattatggctacttacaattccatatgaattttggatcaggttttctctttttttaatggaaattacattgattctgtagatcacttgtggcagtggggtattgtcatctaaacactatgaagtctttaagtcgatgaacatataatgcctttctatttatttctgcctgctttaatttattttggcaatgttttttactttcagtatacaagtcttgcatattcttggttaaatgtattgctaagtattatattctttttgatccattattttcttatttcattttcatattattaattgctacggcatggaaatgcaactgattttttgtgtgttgatcttgtattctgccactttgataaatttgctttttagtttaatagatttgtgtgtgggttttcaaagattacctatgtatattattaggtttacctatagatataaccagtttgagtaccattgatttatttttcttaaccagtactactagtacaacattgaatagtcctggctaaagtgttcatccttttcttgttcctagtcttagagggaaggttttcagtctttcactgttttgtataatgctagttatgaacttttcataaacgccttttatcaggttgaggaaattcccttctcttcccagattattaagtgttcttatcatgaaacagtttgtttgggattttgtcagatgctttttttggggggggatttaatcgaggtcatcatatagatttttttccttcagtctattgtggcatattactttaattgactttcatatgttgaaccactctttcatttctaaaataaatctcacttggttattgtgtatatattcttttaaatatgttgctagattcagcttagtagtattttttggagaatatcaaaaatctattttcttggccaggcatagtggctcatgtctataatcccagtgctttgagaggctgacacgggaggatcacttgagcccagtagtccaaggtcacagtgagctatgactgcatcattgcaatctagccttggtgacacagcgaggttatgtcttttacaaaatgtttttggtaatatcttctatattccttatttatataagatctgtagtaatgcctctactttcattcctgattttagtaatttgagtcctctctttttttcgtggtcagtctatcagaaagtttgttgatagtatttatatttctttttttatttcctaattaattaattaattaattatactttaagttctagggtacatgtgcacaacgtgcacgtttgttacatatgtatacttgtgccatgttggtgtgctgcactcattaacttgtcatttacattaggtatatctcctaatgctatccctcccccctccccccaccccacgacaggccccagtgtgtgatgttccccttcctgtgtccaagtgttctcattgttcaattcccacctatgagtgagaacacgcggtgtttggttttttgtccttgcgatagtttgctgagaatgatggtttccagcttcatccatgtccctacaaaggacatgaactcatcgttttttatggctgcatagtattccatggtgtatatgtgccacattttcttaatccagtctatcatttttggacatttgggttggttccaagtctttgctattgtgagtagtgccacaataaacatacatgtacatgtgtctttatagcagcatgatttataatcctttgggtatatacccagaaatgggatggctgggtcaaatggtatttctagttctagatccttgaggaattgccacactgtcttccacaatggttgaactagtttacagtcccaccaacagtgtcaaagtgttcctgtttctccacatcttctccagcacctgttgtttcctgactttttagtgatcaccattctaactggtttgagatggtatctcattgtggttttgatttgcatttctctgatggccagtgatgatgagcattttttcatgtgtctgttggctgcataaacgtcttcttttgaaaaatgtctgttcatatcctttgcctactttttgatggggttgtttgattttttcttgtaaatttgtttgagttctttgtagattctggatattagccctttgtcagacgggtagattgcaaaaattttctattctgtaggttgcctgttcactctgatggtagtttcttttgctgtgcagaagcttgttaatttaattagatcgcatttgtcaattttggcttttgttgccattgcttttggtgttttagacatgaagtccttgcccatgcctatgtcctgaatggtattgcctaggttttattctagggtttttatggttttaggtctaacatttaagtctttaatccatcttgaattaatttttgtatatggtgtaaggaagggatccaatttcagctttctacatatggctagccagttttcctagcaccatttattaaatagggaatcctttccccatttcttttttttgtcaggtttgtcaaagattagatggttgtagatgtgtggagttatttctgagggctctgttctgttccattggtctatatctctgttttggtaccagtaccatgctgttttggttactgtagccttgtagtgtagtttgaagtcaggtaacgtgatgcctccagctttgttcttttggcttaggattgtcttggcagtgtggcttcaaagagccaacattaggttttgttgattctctctattctttatttcattcatctccactataatcttcataagtttctttcttctatattccttcagtgcttagccaggccattaacagccctgccttagctttcacctcctattttcatggagtcagaaggtgagcccgtgatgaaagctgaggttattttctgcttttaacagagtatgtgtatagccctgggcatgtaattagtcttcttgatattctggtataaacagatattttaaaagtaaacatatctcttttcctaacctcttcttccctggagtttggttatattgcctgttatattccttatctcaggtttccagtgacctttaaagacttttggcaaatgttatcccagccctgagaatgtattggttcagacaaattaactgtagccctcaagctagtcattcagggagctttgaaagacaggtcaaaacacagccacagttctttgataatagcaattgcattgctcattttggcactagcagcctgaagaaggagtgtggtctgctgctgtctttatcgccatcactcatctggaaagtgggagatggtaggcagacaacttaaaatgccacagtgatttcttacactgatgcagcaaattcttacttcattaaactttcaccagattgttttaagtgtttaactagattttagaattctgaaaaagttgactctgagactttttgctggcattgtagttgcatttgtgcaaggagggttgggctggcatttcttactctgccatttgggtgatgccatcccaaattgattctttttttatttttatttttacttttatttttgagacagagtttcactcttgttgcccaggctggagtccaatggcgcgttctcagctcactgcaacctctgcctctcgggttcaagtgattctcctgcctcatccttctaagtagctgagattacaggcatgcaccaccatgcccagctaatgtttttgtatttttagtagagacagggtttcaccatgttggtcaggctggtctcaaactcctagcctcaggtgatccacccacctcagcctcccaaactgctgggattacaggtgtgagccaccgtgcccagcccaaattgattcttaatagttgattataccatccttggtccttaatgagagattattaatttttggaacattgaataatcagaagtattgttatatttgtaaataaatgttagttgcaataaaagtgacatatttactatttattctaccaatactgagtgccatgtatatatttgaaaaatatggcaattttctatttcagatgtggcaatatatttcaattgccacatttttcaaaagtagaatatatcaaaatgcatgttatatagagagtcgccaaataatttgtcacccaaatctggatactttgaaagtacaaagaagagctgacaagacaggaaactagggttaaggtataaccaggactgtattagactaatttgtacatatgttcatcctagagatctttcgctctctttagtaattgataatcctgacttctagtctagttagttgtggtctttaattactagtttttgttattcttgtatatttatgcaaagagtttattgctaaaaagttgggtgcaagataagtctacttttggtataatactatatgaacagtagtttccattatcacttaagaataatcaagtttatggcagatacaatgtgagaaacctttgcttcagcattgtagaaatgtgatctaatatgcagaattgaggaattaagagcttttctcttagttgtaaactttgacataaatctgtaaataagaccaaagaaagaaaatagctagataataagttcatatcttaatagcatatgttatcgaaataccttagcatttgaaataaggaatttttcattaactactaatttaatagcaaaactttattgggtcttaaataatatataaccatgtatgaaaatagctgtggaagctcaaggaggcctgcctgcctctgtaggctccacctctgggggcagggcacagacaaacaaaaagacagcaggaacctctgcagacctaaatgtccctgtctgacagctttgaagagagcagtggttctcccagcacgcagatggagatctgagaacgggcagactgcctcctcaagtgggtccctgacccctgacccccgagcagcctaactgggaggcaccccccagcaggggcacactgacacctcacacggcagggtattccaacagacctgcagctgagggtgctgtctgttagaaggaaaactaacaaacagaaaggacatccacaccgaaaacccatctgtacatcaccatcatcaaagaccaaaagtaggtaaaaccacaaagatggggaaaaaacagaacagaaaaactggaaactctaaaacacagagcgcctctcctcctccaaaggaacgcagttcctcaccagcaacggaacaaagctggatggagaatgactttgacgagctgagagaagaaggcttcggacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgtcacaaagatactcctcgagaagagcaactccaagacacataattgtcagattcaccaaagttgaaatgaaggaaaacatgttaagggcagccagagagaaaggttgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaagaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacacagactggcaagtcggataaagagtcaagacccatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaacagactttaaaccaacaaagatgaaaagagacaaagaaggccattacataatggtaaagggatcaattcaacaagaggagctaactatcctaaatatacatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagagtctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaataaataactaaaatcagagcagaactgaaggaaatagagacacaaaaaacccttcaaaaaatcaatgaatccaggagctggtttttggaaaggatcaacaaaattgatagatcgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcaacacatacattctcccaagactaaaccaggaagaagttgaatctctgaatagaccaataacaggagctgaaattgtggcaataatcaatagtttaccaaccaaagagtccaggaccagatgaattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggaaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccttgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagagttggaaaaaactactttaaagttcatatggaaccaaaaaagagcccgcatcgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttagtaaatggtgctgggaaaactggctagccatgtgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccactatgagatatcatctcataccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaattatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccgcatattctcactcataggtgggaattgaacaatgagatcacatggacacatgaaggggaatatcaccctctagggactgtggtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaagaaaagaaaagaaaagaaaatagctgtggaacattttcaactttgtttagaattcgcctttaggtacttttgctgaatagctatagcaaaaaaaaaaaaaaaaaagaaaagaaaaagaaaaaaggaaaaaaaaaagaaaaaccaagctgaaattcattaatgtgtaaaagcacagaacatcatgaaagaaagaatagtaactagtaggtatgcttctagcagtaattgcagtgacacacaggattgcaaaataacactgaaaggcattcttgcaaggtcaaaagccacttgacctactttattttttaagtctgaagaaagcttttcatacacggagagtctgtaagtttattttgcatgtgtgtgtttgtttttaacacataaagtgaacattgactcaactatttttaacagaaatatatgtgaataattcattctataaaatacctcattttttgtttctctgtctttcactctgtctctgatattacatgtggcatatgcattgaaattgtgtggagtcacaattgtatattgggagatattttatcaatgtatcagtttgtttttacatagggatgggaagtaagatacatagaggcttaggattttaactgatggcagatgagaagaatgtaacattttaggggtaaatgccacagcataaaatgtaaaatattggcagtccttctccttcagtaaaattacctacagctgtattggcaaataacttgtcatttatattcaaaaagctaaatgatgggcaatttggactcatttacctttttaaaatccatacaaataatgacaacattaatcttatttcccccaaaaaagtataaactagtttgaaatgccaattctctaaagagacctacactgactatagtgtatccaaattaaaaatcataatttaaaagagggattaaagacttcaaatttgtttgaaatatacatgatacaagattacaaatctgtttctgccatatagaaataaacatttagcattcacccattgtagtcaagaaccgtatctactacctcaaaacacccctcttttttcatgatatcaaaacattgtttttattccaggaattatgtcaaaaattaagcctttttttcctaaatttcaacttttattttctatacaaggggtacttgggcaggtttgttacatgagtatattgcatcctggtagtgagcatagtacccaataggtaatttttcaacccatgcatcactccctttcccctctagtgtctgttgtttccatatttatgttcatatgtggtcaatgtttagctcctacttataagtgagaacatatggtatttggcttcctgtgcctccattaattctcttaggataatggcctccagttgcatccatgttgctgcaaaggacatgatttcattcttttttatggctatgcagtattccatggtgtatatgtatcatattttctttatccaccttactgctgatggatacctaaattgagtccatgtctttgctatcatgattagtgctgctgagaatatatgaatacatgtatctttatggtagaatgatttatattcttttgggtctatacccatgaatgggattgctgggtcaaatggtagctccattttaagttctttgagaaatctccaaactgctttccacagtggctgaactaattttctttcctacgaaaagtgtataagtgttcccttttcttcgaagtcttgccagtatccattgttttttgacttcttaataatagccattttgactggtgtgaaatggtatctcactgtggttttgatttgcatttctctgatgattaatgatgatgagcatttttcatgtttgttggccacttgtatgttttcttttgagaagtgtctgttcatgtcctttgcccatttttaatggggttatttgatttttgcttgttgatttgtttaagttccttacagattctggatattagacctttgttggatgcatagtgtgtgaataattttctcccattctgtagattatctatttactatgttgatagtttctttcactgtgtgaatgttctttattttaattaggtcctacttgtcaatttttggttttcttgcaattgcttttggggacttagccaaaaattctttgccaagaccaacattaagaaggctatttgctaggttttcttctaggatttttagacattcagatgttatatttaaatctctaacttatcttgagttaatttttgtatattgtgaaagataaggttctagtttcattcttctgcatatggctagccagttatcccagcacaattaattgaatagagagtcctttctctgttgcttgtttttgttggctgtgctataggtgtgcatttttatttctgagttttctattatgttccactggtctatgtgtctgtttttgtaccagtagtatgctgttttggttactctagtcctatagtatagtctgaagtcaggtgatgtgatgcctcaagtctggttcttttttgcttaggattgctttgcctatttgggctctcttttcattcattatgcattttagaatagtttatttctaattctgtgaggaatgtcattggtagtttgataggaatagcattgaatctgtaaatttatttggatagtatggccattttaatgatattgattctttcagtccatgagcatggaatgtttttcaatttgtttgtgtcatctcagatttatttgagcagcatttggtagttctccagcagcacatcaaaaagttaattcacatgccaggcgtggtggctcacgcctgtaatctcagcactttgggaggccagggtgggtagatcacctgaggtcaggagtttgagaccagcctggccaacatggtgaaagctgtctctactaaaaatacaagaatttgctgggcgtggtggcgcatgcctgtaatcccagctacttgggaggctgaggcagaagaatcacttgaacccgtgaggcagaacttacagcaagccaagttacagcaagccaaggtcatgccattgcactccagcctgggcaacaagagcaaacctccgtgttacaaaaacaaaaacaaaacgaaacaaaaaactttttcaccacaatcaagtaggctttattcctgggatgcaaggctggttcaacatatgcaaatcaacaaatgtgattcaccacataaaaagaattaaaagcaaaaacatatatcatctcaacagacacagaaaaagcttttgataaaatccagcatcctttcatgataatagtcctcaaaagactaggcatcaaatgaatatacctcaaaataataacagccttgtatgacaaacccaaggccaatatcatactgactgggtaaaagctagaagcattcccttcgaggatacaaagtaaggatgcccactctcaccactcctactcaacatagtactggaagtcctagtcagagaagtcaggcaagggaaaggaataaaaggaatccaaatatgaaatgaagtcaaactatttctcttcactatcaatatctacacttagaaaaccctaaagattatgtcaaaatgctactagatctgataaacaattttagcaaggtttcaggatacaaaatcagtgtacaaaaatcagtagcatttctatacaccaataatgcccagactgagaatcaaatcaagaacacaatcccacttacggtagccaaaaagaaagtgaaataccggctgggagctatggctcatgcctgtaatcccagcattttgggcagccagggcgggtggatcacctgaggtcaggagttcaagaccagcttgtccaacatggtgaaacccagtctttactaaaaatacaaaaaaaaatgagctgagtgtggtggcaggtgcctgtaatcccagccacctgggaggctgaggcaggagaattgcttgaacctggcagatggaggttgcagtgagctgacatcacgccactgcactcctgcctgggtgacagagcgagactccccccaacaaccccccccccaaaaaaaaggaaggaaggaagcagaaatacttagaaatacctaaccaaggaggtgagaaatctcaaaaaaaaatattttgtgtgtgtgtgtgtgtgtgtgtgtgtgtgtgtgtgtgtgtgtgtgaaggtgccacgtaatgtattgcattccaaactcaataaattaaattttagtaacccctaaaattagccttttatactttctagggctcatacatttctgttaatattatgtgcttgtttcttatttaaaatctattctccaagtttttctggccctatttgttggtcctcatgttatggagttgataacatcaataataattattgaccaatctttatcaagtatttaaaatgtgtcaatgttcttggcatttcaattttaaaataattcattgttcacctgctattacagttgaggaatatcacattttaaaacaagagcaaatcccaatcagcattgtttccaggacttgtgctcagaacgatgaaactcactgtcatggtcattgttatagaaagtactgccttctgtttctgtatttatattcaccatcactaagctttcatcactgtactcagaactttactatttttagcacagtaaataatatttcataattctcatttagggaaaaactcaaaagaaatgcgaaagcaatatattggttacttttggtgcttggcttgaatatgcagagtttaaaaaaaatacatttcagatgatatttgctaaataacccaacccaattttggtgttatatgtgtgggtaaaagttgttggagaaactaccttcttattgtgttatttgtgtttaaatattacttttcctatttctttaatagcatttaggaactcttttataaaatttaatttataaccaatttatctcattagtcgttttaatacttaaattgttccaaatgtagccagtgagagcttatttaagctgacttctgggcccttttgccatttcattgttagtttttaagcacttctgtactttctggcacaatatataagggatataagggagaggagaaaattcctcattactaaggaatgacaagtgaaaatgcaaaatgattgatgtaaatagaaagacatatttttcacaattactaaagcagtcactgaaccactcaaacatcatcaatcgttgggtgaaaaacagaaaacaggatattcacaacttaagtaataaaacttatcaccaatgataggtcaggtgtaattattgtacattgacatgatgcaataacaaggagatatatatgttaatacatcaatcatatatcaataaaatatacatatattgaggtatattaatatcaatgttttatgcaggtgtagctaaataatatcagtcagtttatgctttatgtaaaactgttagatgaactcaatcaatgtatttgtacatgaatatattaatgtttccgtatctatataacatcccaaaatagtaattaaatattaagtcatgcatacccttcatgaacactgaagaaattgtaacaaattgttgatatctggcaaactcattggtatggtaaatttatataatcagttatgtgtttttattattttgcaactaaaccactgaatatactacttttctactcataaagacgtgttaaaatagtggcttcttgccttataattgtattgccctctttcattcttcataagcatcatttaaaagcctacctctgcctttcctgcagtctcatcttgacttcgatcatgcccactttttaactgtcagagcagcaacactttctgcttcatacttggtcttttgaacctgtcttgtttctgtgtgtgtgtgcacgtgcaaaataatatggtactatgtttgaggaaagcacagaaaagccttaaactgagttacatttcccgaagtgcctttcccatagccttgctcttaggaagttctgaatatttgtggaatggcactgacatctttgtcattattattaattatttttaatagtagtagtggtattgtaaagcaagcacattcttttttggttctgatgaacacatatacttcagaaacacacacacacattgtctctctctcagaaacacactcacaaacttataaatgtattttattagaagcacttgcaatcttatctggaactcagaaatgcttcccagaattacttttatgttttatgagtttatttttgcttattttcaagcctcttctatttcctttagtttctgacctgccatattcctcatcactcaaagcaaatcacctcacctcccactccaccatgggaacagctggcaggggctcctcagttcctgataaacgcctggcagtcttactggcctctattaaataaattccctttattcatctcatctgcttacggtggagcacatatccctatttggtctaaattcctcccagcttttctctgaatcatatcacctcttggaggccctatttaatctattaatgttatgctttcctccaatctttatattatttatctcaccccacttttattccagctgttataaacatcttttcaaaaccctctttaaacctaatattaaaagcatttttgatctcatatcctcctctagtcatagtcctattgttgtttgctaagcaaatttttgaagtgacttcatatgtctttgtgtatgtgtacatgtgtcttaagaatttgaaatagaaatggcagtgcagttcatcatcttctttgatcctctcttaccatcttgtggattaagtcatcttgtaaaactccagtttgtcttgtctcttaaaacttcccacgcagctcaaaagccttaatccttgttgtcgcctataggatctttctaggtgcttatgcctgttcttccttttgtccagactactttcccttgcattttcaaaaggaagacaaattcccttgaaatttctcatcctcttgtctggttagttgctaataatttttcaagtagataggatatctctttttggatatcttccttgaaattccaaagtgtgttacatttcccctatgtgctttcatgccattgattagatcatataataattgtctatttatttgtctgtatttccctctatcataaggtttatgaaaccaagcgccctgtgtatttttttaaccatgtgctttcaaaatcttgtaggaggcctgtcagatggaagctattcactaaccactgattaaatgaaatcttagctattggccttcttgcataggctattaagtgtagtatatttctgtgtgtatgtgtgtgtctgtgtgtatgtgtgtgtcctcaaactattccttgtgctatgaaggttaagaatatttacaaaagtatcctcagacatcagcttttcatgaatattttgattacattattgcttctttcaattttggtattaaaaattctaaatgtcatgggtatttaaaggtatatttattcagcacattgttgtaaatgatagaaagcccctttcctgtttgtgctagattttggtctttatttttattaaaagcttcagtgaattgctttggctttaaaaaatgtttttatacagcattcatgtacggtattaactgattaatccttctgccagaagattatgaaactctcaaatctgaacagaattcaacaaatccagattaatagcatttaagcattggaaaggtggtttctcttgggagcttgggcaattattttaaactctgtaccgaagtaactcaagccattaagaaatgtcctgccttttaaattctttgagcccaaagagatgactgacaactctgcctgcttttcattacccttcatcagatcagcctgtattaacagactaaaaggaaattggaatttagtctatggctaagcattttgaaatatatttagtgactgtcttagtccatttggatggctgtaacaaaataacatcaattgggttgcttatgtacaacagaaatgtgtttctcatggtgctggaggctgggatgtccaagactggtgtctagtgagggcctgcttcccggttcatagatggcaccttagctgtgtcctcgccatggtggaagggatgaggggtctctctcaggcctctcctataagggcaccaggcctaatcatgaaggttctgccctctgtacctaataacctccccagggcctctcctctccccagcatcaccgtggcgattaggatttccacacatcaatcttgggagaacaccaaaattctaccatagcagtttctccctctcccttcagaaggagcccttgggagtgctcttcagcagcccttggcatttggagatgaacagcaacatctgttatattgctgtttactgttggcttctcctgctccctcttccatatcatctccccttaggaatgttttcttttatgcaaaacactagttttgccattaagctaactgaaacactaagctaactcatttctgagtaagatacttgagagagaactccacagagcacttccagttctattggctacaagactgtttcattgacctttgttgtgtgtgtatgtgtatctgcgtgtaaatatgtgtgcatgtgtgggtgtctatgtgtgtgtgtctatgtgtgtatgtgtatgtatatgcatatgtatgtaaatgcatgtttgtgtgtgtctgtgtgcatgtgtgtgtgtgtctgtgcaaatgtgtgtgtgcatgtgtgtccgtgtgtgtgtgttaatcttaattgcgtcctcttatttagattttatggcactatgtctgtcaggctaatgcttagcgttccattgaaaccaaataaagttaaactgtaatcactgtaattactgctacttttatttgaaaatgatatttactattgacttttgtcaatattttgttacttaaattgctccctcctgtgtttccagcattctgaactctacacctgacagcataaagatctggaccgtctaaagatttggcaatttttaaagtgcacagtttatcctgggctttaaacataattgtagcacacttaatgagtataataacctaacagcatgagtgttgttttcataaacatgtctgcataatgatagactcacttctaagaagaaatcatctaatcaatgtgaattccagttatttgtcccatatcctgatgtgggattgacatcctgatgtgagattttctaaaaacctttcttggcaaaagcttgtctggggagattgtaaacagtggagtgggtatgtttgtttttctgtttaaatttcagttattagggtccactttcctcttctctaggcagtggcctattccgaatgttctttgtatcttcagcttcagatatactgaaaatctggtgacagcagtttgatatttatttaattggactttatattagattatgagaagaggaagctaatacacaatggtatttttatttcaccatcttcagtctaggacagagatgttcagtgaagacttttgccctgcaaaattaatgagggaaaataatctataaaatattgtgttgacatcatctataaagttctgtagctaaaacactgcggatatttcttatttttcaataaaatgtctgcaatttgcgctaattgtgaagaaagtcagtcttcactatgaacaatgtaaactacagaatgtatttaaagatctagaacattattacataaaattaatcaggacacttcaaattagtctaggaaagtattggcagttgaaatgcttggaggatctgtttccaagaacaacaataaagacaaaacctctattttaaaatttcagatcacacttttcaaagtaaatcctctttaaatgtaatccagattaacttttatttaaaattatttatctctccttgtagcatctttacatattgtaattggttatttaatactaataaacgaaagaagttagacctttgttcattcaatttagttccatgttcttcacacctaaagtttgtttaacccaataatgggggaaaatattgtacatacatacacaactggaagtcagttcactaattttcttgtatggcatgtttgatttctatccataattgaaggagctttagttttcttagaatataaaataatggaaatcagatatggataaatttgtattttcatttacataagaagatattgaattctttttgtatttatgtgatagaactatataaaataaaatttattttattttattattatactttaagttttagggtacatgtgcacaatgtgcaggttagttacatatgtatacatatgccatgctggtgtgctgcacccattaactcgtcatttagcattaggtatatctcctaaagctatccctccccgctccccccaccccacaacagtccccagagtgtgatgttccccttcctgtgtccatgtgttctcattgttcaattcccacctatgagtgagaatatgcagtgtttgtttttttgttcttgtgatagttcactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatatccagtaatgggatggctgggtcaaatggtattttctaataaagttattctattgtcttacatttttaaaggtatagttgataccttaaacatttatagttgataaataaaaattatatatggtgtatgacatgatgctttatacattgtgaaatagttaaattaagcttactaaactttcacctgacatactttttttgttgtgagaacatctaagatccacagttttagcatttggtaagtatacattattattaactgtagttaccatgctgtacagtagattttgtgaacttattcatcctgtctagctgaaattttgaaccctttgacaaacattattctattcctccgcccctccctccagcccttggcaaccaccatcctacgctgagcatttatgagtttgatttttgtacattccacatatgagtgagatcatgcagcatttgtccttctgtgcctgccttatttcacttaacatgttttccagattcattcatgatgtcacaaatgtcaggatttccttcttttttgaaggctcaataatattccactgtacatctatactgcattttcattatccgttctttcatcaatgaacacaaagatggattttatatcttggctattgtcaataatgctgcagtgcatatgagagtgcagagttatccccgagatagtgtttttatttcctctgaacatatatctagacttgggattgctggatcttaaggtaattctagtcttaattttttgaggaacattcaaactgttaaatttaaacttactataaaattttacatatttttgtctttgaaaaatttttcaaaaacaaaaaaaaagctgtatgagatcataagggagaatctctaacttattcattgatcagttaacaatgtgtgtgatatagtctgaaaaatcccaaagactcaagggaaaaaaaagtaggaaaagtaagagggagggaaagagggagggagggaggaaagaaggaaggaagaaagaaaggaaagaaggagagaaggccccctcttctgtgtccgtaatgaaatattcttttctgttgaataatccaagttacttttatattgatactgggagaaatagtaactttctttcattttttgttttcacttttctttttttcttaaataggaaggaggaaagaccatgaagggattcagcacctaggaagtaataaataagtagcaacgtcaaagagatcagaatgacgcattttaaccttagtaaaatttttgtaaggatcaattctgtctgcataatatgatacaggcaaactattagccactgccttatttaataatgttgtaaaccaaagaggaggataagattaagaaatgactgaataagttatgaaaacacgccatattctattatagctgcctaaagagaagaggtcatttggcaaatacagtacttcctggagttatcaacaattcatatataagatcatagaccatttttaaatgataaagatgaatggaataaaaaacaagtgcttcctgtaacacaaataaaaaattcaacagtgaactaaataataacttattttgaatcaggaacatgaggtgattcattttgaattttgaatcaggaatatagtcctatactataggaagtataatatatgaaaatatgagtggctttaggtttatgtgaaacatagtttatgtggttcatttcatagttatccaaggaaatacaacttgctttcctcatctatatttgactaatttatatttggctcataatgttgcaaaaaataataatttagcacgttttctataaaatcatctagatattatccaatcacgatttcttatctcttatgtaatgaaaaaatcggtgctttttaggaaacctatccttttgtgtgccaccagatagttacttactgttaacataattacctgaggagtttgtgtaaatacgcagtttcctgtatcatttattactatgaagtatgcattagctgttagtcttgctatttacaattattattattgttgtgatatctgtattagaagtgacagacaacacagtttccaaagggacttgaaggggttatgatagcccctgaattgtattgtaaataatagcatggagagacagcttgcagttttgaaaagcactatgccatgcaataggcaatgatttaattttgaagttattatattttcaaatgaaatgcaaattcccctgtttcttactgtgtttctcattattaattcgtcatttatcctccttaggtgattatcatggttcatgtatcattctttggcttatataatatacctagctgacattatatatggtgacaatttgatatttctcattataatggaattattttctttgtatactgtaaaggaggttcctgtatttcaggaaacaaataatgaatacttatttaacaaatagaaacatgtcactgagcagattttgccattaaattctgccacacttagcaacacttggaagtagcccagttaccttaatttgatcattacatgttatatgcttgtatcaaaatgtcatatgtgccccataaatatgtgtaactattatgtacccctataaattaaaaataaaattcagttaagctcaatgcaataacacacactataaattcaactgcctactatacaccaggtcctctgtgaggtaattggcagtgtctgtacccttgagaagtgtatggcttggtatatagatttcctacatagtctgtcagtttatctgtgctctattttctgagatctgagaagcacggatgtggctgcatagagaaatagaagttgaaagatcttaaaaatatttcatgtctcatatgatacacaatgtcatatgatatacaatctcataagatatatacaatgtagggcaattttagatttcaaacttagattaggtgtggtaatagtcatagatttgaaaaatttattgcggctgcatgcaagatggactagagcagaaagaatttagaatataaagacacgaacttgaatactactagagagataaagctctggataaaaatggagatttttaaaaataaaagcaaaggaggaaactgtgacacacttcagagtaagccgcacccggattttctgactacttggatatttgggacaaaggaggtgtgcgaggaattacttttgaaaatgatatcctctctatctgataggtcaggggagaggatgaagatggtgccactgaaggaactgcgggtttgcttagaaagtgaatgactttgatattgctgatagtgacttcaaagtaacataaagaggaagagtgacacggaatggcaaccagcaattgtggggcaagggcccaaggagtcagaactagaaatacagatttttaaatatttagtgtgtgctgagtactgataatttcataaaataaggagattttaccttttttatttattactagtaattattagatttatacaagtttaaataagaatgctttttattctcacccttcacttaaataataaactatatcaaatgcaagacattttaactttgtgtgtttgcttcgcaggatagggaaaggtaatttaaaaattcatatagatgataattacggcttttttttttttgtggtttttatttgaaaactcgtatgatctataaccttcgccgggagtgatctgccgccactagggcgcagcagatagctcaggggagactgacgtcatctacttactcatcatctgccggaaatcacaaacatcatggttccctgcgtgctcatctcaggcttggtgctgctagcctacttcctgccggctgcctcaccagagcctgggcactgccgccccggagatacgctgctgtggggatgccgtgaacttcgtggccaagaacatgagagggcaggacacgagaggccaggacgccatcggcgaggttggacaggagccagaggcggatggagcgcggcagaggcgcccccactgtctcccgtgccactggctcctgcagctgcccctttaaggactgtttgtgccgacccttccccaggaagtgacggcatctgcttctgggtcgctcgggtgctcttcagcctgggctccaaccttatctcatcgtggcctacttgaaccgagtgtccgatctcccctacccgctgggtatccagccttagcgcgcaccgactacaacttcaactttccacccatctccaggggaaattgattttgaaaaagcaggctgctgccaccacagcattatgatcctttccggctgctgaccaatctgtattttgtgaacttcacaagaggaatggtgtgtgcccattccttggcgtgtgtaggtctggccccaagtccaggggtcagcaggagggaaaacggttcaagcaggctctgaggtgctagtcttccagaaagcaaggactgcccttcattcacccttgctgacctcccagcttttctcaggcccagcctcacgtgactctggaagctgggagcttctgagctatctttgttcatctcatagccaaacaggagacccctttgcaggacttgcacatagggaggctggagccaggaaactgtctccttttctggcctggccctgctggagtgggtgggaaccaaacaccttcagtgccggtggcccccaggcgcacctgtttagagctgaggatgccctggccctccctcagtcatttattctaggtcttgttggtccagcactgcccatcccaccccaggagactcactcattgcggatcccaccccaccctgcccctttcttccccaccctgaagactctctgcttagtatccaggactgtgagagaaagcaataacatagggcctgaatggtggggcgggagggaatacatatatatgtatataacacatatatggccttctccagaaagttgtgtggaaaagatgctggtaaacgagcagaaaacaaagcgtaagaaattttcattcgctcaacatgtggttgttgactttgacttaggtgctggggataaagcagtcaggtcctgttaaagttttcattttagaggagggggctcagagtaaatacttaacagtaaacaaaaaatagatgaagataaatgctgtagaaggattttttaaagtgtgatgtagccgggcacggtggcttgtgcctgtaatcccagcactttgggagtccgaggcaggcggatcacctgaggtcgggagtttgagaccagcctgaccaatatagagaaaccctgactctactaaaaatacaaaattagccgggcgtggtggcatatgcctgtaatcccagctactcgggaagctggaggcaggagaatcgcttgaacctgggaggcagaggttgcggtgagctgagatcgcgccattgcactctagcctgggcaacaaaagcaaaactccatctcaaaaaaaaaaaaaaaaaaaaaaaaaaaaaggggtgatttcagagatgaagggcagcgaggaggctgcctgctggctccaggcgagaagccaccggtggatcaggaaagtgctttcggaggttagggaaacacttggtgcacttgaggaacaaaaatgaggtgaatatggtgggtagaattgaacagtatgtttggaaaggtcagtgggagacttaactgactagggctttgtaagccgtggcacggtgcttggattttacctgcagttctctgagaagacactggacagttttaagcagggatttgtccttctctgatttatgagggtttttttgtttttttttttttgtagagaacactggctgctgtgttacaactgggtggggggttgcacggagaagagagaaaaggatcagggagaccatttaagatgctctggtgatattacagctgaaagagacgtctaatcaataaatatcgaatgagcgagtgagtgaattgccatttgcttcaggaaaactgtcacttgctctattcaaatagagaattgttcttggttgagcctgaaatatagagaaactttcaaatcacctgatacaatttgcctctactctcaatgatgaattctgttttgccctattttttatttcaagtttcaagcaatctggtttcttatcccctagcacagttacttgctttacagtgttggttatggaataattataagtagtagcattactgttctagtttacatttatttcctcagcagggactgtggtcagggctttacatgcattatctcttatgattttcccaaacaactctttagttaggtaacataaatattcccattttacttatgagaaaactgagacataaccttacctaggaaatagttcctccgattcttatttacgaaaagccagaaaactacttaaaatacctgtttcacttgaagttaaagagatataataaaaacaggtgggcctactaacgtattcaggccagattctgagtgtgagcgcccgggcaaggtaaggtgactgcgcacacaatgaggttccctttttccttgcactgtaccactctcccgagtgtctttataatgagaatacccccagggacctgcagaccttagaagaaaaggtggcacatcatattcttgccttagggtctcagatttctgtgctaaatccactacctgggctctgctagattgcatgtgccttggaattgttgtctgttcattgttgcaatagacaaaaggtggcttcctcctcctgccaggtctctgggccccactcctccctagtgctcactgacgcccacaggagaggaagttctccaactatttctagaatctttttatttgccttttttcccaatccctcatcaggagaattgaaaacacactcacatacacacaagcacgcacacacatgcatacatacgtatacacataaacatacacacatacacgcacagatagacacacacacacacacgggatctcattatttctttaaagaaacatttattttttcttttcatttgacctcagtcacaaactctggtctagaggcagacaagttatcaattcaaaaactttataagaaacaaagaatttcaaacataggtcattcatatcatgttgttgtatgtttcgttcttatccatgttgaaaaatctcatactatttgaaacctcttcaaagacagttgctggcattagcttcccttgtttcatagcagtgctaatatgtaagttagagagaaaaacatattttatgtttagctcatatgatgaaatacaaatgttacaagtatcaacttggttgggaaaaaaattaatatttttttattttgcataactgatataaccctgctttccaaagatgagagagaagttcatacttgctgtttcattataaataggcttgccaagtaaaatataggaatactgttaaatttgaatgtcaggtaaacaatgagtaatttttgaaaatatgtccaatgaataatttttgaaaatattgaaaaatacaaataaaagttgtttgcgtttttatttgttaaatatggcaaccctaatttttaaacaattttaagtgaaaacttaaatatcaaaaagatgttaaaaggtcccatcagtttatatgatcacaatggtgatatcatgttccctcatattcccccagtagctagagtggttcctgtcgtggttgaggcttagtggtccctgttaactcagactcacctgatttctttcagccattgaagatccctacatatcagctgtattttctgtctggagtctgtcttgcacccagcactgtcagtctatgctctggggacaactagaccctcaccatagtggctcgctggcagaccaatcccatgtccttgctaggtcatatgcagggatttttgaatcccttcagtgttacaatgttgctgagggaaagagactctaaaccactatttcatgttctttctcaaccaaataatctatgtaatgattttaaatggctttgaccacatgtcttgctatggaatccactggagggaaactgtctcctacgattacaaatagaagcaggatatgttccttctgtgctgtccctcttgcttttagcttcctatccaccctatctgggtttttctatcacagccctattggaagtgcacacctttcccccatgcacccaagcttttaggactctgaaaattcaagaaggtcagccttcagactcaatgacacattggtttccttctgttgaagccaaaaatcatggaaagaggcttcattaaagtagaatttttaggaaatgaaaatacattgcaaaatatttttaaatccctcatatgttaatatagattttattatatgtgtccttggtgagggggggccttctttccttctttcctccctctcctgttctctcacacactctctctctggtttttgctctgtcttctttcctctcctttcttctcccttcttctccatcccccttccattcttcctttctctctttcattttccttttttactttctttcttgaaatcgtatgtgaacaattataaaagcaacatggccccctaagtattggagaagcagaaaagctttgaaagattgaatgactctgatgctgaatttttcagttatgaggcaaactcttgcctgatttattctaatatcaataagaattgttcattttagactcatcagaaaatatgtgcttcgatctttaaaataaaaattttacctataagcaatttgcatttgacttttgatatggtttgtacatggtttaatgtattccaaaggcccattcattgaaaaatgtgttgaaacttcttataatgccatttttcgattttgaaccaacttatatagcactccttggggaactgccagtgccttctttggcaagaaaatctttggctataggataactaaaatagttcaaaaggtttcccagtgcaaaatttaacaatcagtgtattcagagctagaataattcttgtcaaaacaaaaatgaattcagttgtgtaattcttgttagcaaatggatataacccctttagaaatcctgcagcctgtgattttaattatctatagcaaaaacttgcactaaatttaacaatgcaacagaatgtaatgttttaaaaacaatgtatccattctagatacttaaaaatgattcatatttaaaatttatgttcttatatcacaaaaatatagaacttgaaccaaataattatttcacttccaagttccagaagggtacattttgcattgactttaacatatcaagaaaaaaactcactaaatcactcctgaagggatgatgtagctaataaataccagttatatattttaggaatttaatcaactgtagcacaacagaataagcatttgtataacatattccaccatattggaaaaaagaaaatgtggttaggtagaggagagtattggaatcttactttcacagagtaaagttggaaaaacaaaagtattgatcttatcaggaataagtagtttccaagggcatgcagtaacactgagtattaggattggacccagtggaaatgcactaatattaattacaaattcccacttagaatttagaaatgttcccctaatgagactgaaaaaatcaagaaatttgacattagaagtatgaaacaaagaaaaaataggaaaacattatcacagaattggcaaatagtttaacttttgcagagagaaattcagcattttctgtgctgccaaacattgctgaacatactttcctatgtgaatcctcatttagatggccccgcctctaccttgaattgtgttcctggaaacaagaaagctctatttttactgccatcatcccaagctatgtatcttgaaaattcattgttcactttatatcttgttcatagatatcttgaaaagtcatcgttcactttagatactatcagctcttctagtaaacatgcaacaactattcctacttgctttcactagaaaaaaaaatttcattctattagacacaagttaactttccagttttactaaacacatattaaacaatatgagccacttatcatagctattgaatgtttattttttattattttattgttttaacttttattttagatttaaggggtacatgtgtaagtttgttacgtgggtatactgtgtgatgctgaagtttggagtatgactggtcccatcacccagtaagcatagtacccaaccatttttcagtccttgccactctccttcccacccctctcacctccaatagtccccagcgtctgctgttgccgtctttatatccatgaggcctgggggtggtggaggttccacttccttacaagtgagaacatggggtatttggttttctgtttctgcgttaattcacttgctgcccaacattttaaatgcacgtcttcacaggcagtttttttgtgagtttatcatatattatttttccctaggatataagaataggttttgttttctgggtatacagatatatgtgaattttttctacatgaagaatatacataagagtaaaacattttctaggtattcctacgctctttgtctaatattgaatgtaagtacctgaaaactcaggaattttgtttttgttttctcaagagcggaagagaaatcagagggattcttggaaggcacgggtaatcgtcacttgatcagtcagagttcccggaggaaatcgatggcattctcagaaggagggattagagaagccttactctggacaaggcagttaatagacaggttagggaaaccaaaaagaagagaaagcaggaggtggcctctgccacccccaggtccacaggaggagggaagggattggtgaccctcattggagttgaccttgagaaaggggccacccatcaggaactgggcttgaggagaagaggtagcaggaagcaggtagcagggccgactgcggcctgcagagagggcgtgagagaataagcagcactcctccttgcttcctcccatctcttgctggaactttcctttctcagaacccaattggaagcatggaacatactcatgcaatccatgaagaccagcctccaggacagcaggacagagaacaatgagactgaaggaatctaaaggggccagtggaatttatagatcccacggttatgtacacagtaaaaggttgcttggattagtcaggtgatatatgatttgcctgaagtcttaattctgtgagtgctgtgcacaaccccatcactgaatttatttataaaatatgctacttgtagcataaaaatagtatcatttttaaagatagatttggtatatggatgactgcgtattgttgtgtgctttatatgacaatcccatggtgacaatgctgtttgaaatatgtatttgacgtttgaaataaactttagagcaacatttatcttttgggggatcctatcagcccacaagtgtggaagcaggtttcgagatccgttctaagcccaaagcatcagttccacagatgctgagacaagtttgtcccattggaggctacagtggtagtagggtgtacctgggagcaagtagtccttaactttcatcaagatcaaaaagtgtatgttttaaatttttgatcaaataaagctatgtctctaattgtatttctttgtttgccatagcaatggaaaacttaaagcaagagggagtctagctgtaccattcatttttttcaacagctatgacttgagcttctataccccccaaaaatatgaagtcctgaagatgcaaacaaacagtatttattcctccatttctttatatttgaatagaagctaatgtatatttagtacaggctattctatgcatgttttaaaattcaaagatgacccaattcttgtttttggttaggtatactgtgactgtatagaaatgtcaaagaaaaatttttgaacattgataacttttaaagtgatttcctgcatgatcaatattcatttatcagtttaacagccaagaagataaccttacatattagcatgaatttgaccttaaaatcaggttttcgtatccgttatcttcctcctacatttggtttattgaaacctaactgtgaaaagaacactactgtagtatttgagcctttagctttgatctcatttaggccgaatctgtcacaaaatttttcagtggtgaatgaaatttaaaaaagtattatcgttaacaaatggtaaggaaaacttatattgtctttcttttaagatacagaaaattacactaatattaccttaaattgagtgttcaagtattaatgttcattgcattgataaactaatctgtacttcacaaaatacttaaatacgtgtgtgtttattctatactcccattagctcagtgtggtggaagagagaagaggctttccgaatcacgctattttgggcactagacttaatatttcatgcatagtttaaaaatcagattagcagtcttattttagcatagggcatttgcctgttaaattatatcagccatcatttattctaaggaattttcttgtacgttgaacataaatccatgttttggggcttgaatttctaatctgacacctatctaatttggttcttcctcccctccccttccttctcctcctttttctcctttgttttatttaaatcattattagaaagtagtcactttaaacttactgttttatttcctaatctaaaacaaatgggaaaaaatagttaatgttctagtttcctaactacaacctcctcagtcaatttgatcattttctttgagaaacaaattcaatatatgccattgtaagattagtgttgttttctgattctgatagtacacatttatttcatgattttttattggaataagttttaatttacagaaaattcaccaagattatacagagagtttactatttatccaatatcctctaaagttaacatcttccattaccatgatacatttattaaaactcagaaaccaatattggtacattactgttaactaaaccccacactttatttggatatcatgggctttgccactgatgtttttttctctgtaccaggatccaatttatgatacaaaaatgcactgaatagttcttaaatttagtacaggttttcagttatagaaaaagaccaccagattgtagtatagatttcaattaacataaattaagacacaaattaagacattttcagtatacatccaatttagatattttgtccgtttcatttttgctaaactgtttcttgagtgctcagcacactgaaggatgcttgcattgggaggtaaggaagcatgtaactaagagataaatgcatgttgcctgttctcgggaactagtggttattataaactaaaatagaacaaaccaggaaatagggtatttgccagagggaggagaggaatggagatattaagtttgtagtaaacaagtttagtcctgaaggattccagtgaaaagttgaaaatatgagaataaaaatcaaggaagggttcttaggtgactcagagaggatacagtaacatgagttggtatacaagctagcaacatgtgatacatttcatggtatgggctagagtaagggaagaatgtgattcccatacctagccctcaatataaaagggatgtcgagccagttaatacatgagatgaaatgtagaagcatgttttgcagggttctgggattacaggaatacaacgttttcctcagcttttactttgctgcagatgtgctttcggtaatatggtcatcataatacacttttataggattaattctgagctctttgaaaggaaccaattcattaatacaagttaatattatgtaacttaaaatattcttctccaagtaatcattaactttggcaaattttcacacacaaaaagaaatactccttatcacctgtggtatcagttggaatggaattataatttcttaccatgagcagaaaaaaggtatttaacactcttaagttgagatataaaaataattgagcaaattgcttagaattttataaagggctttgaatgaaggatgccactaatatgattaaacatttcttttgcatctgtttagtctcttgtgagtgtgtggtagggacctgattttaacttaattatcagaagcattaatagatttagacacaaatcaagagggaaaaagtcaatttcaaaacttattagtaaattggcacactcaaaactcatttatttctccagcttctaaactaatgaggtgttacagtctatttgttggcatattaataaaactgaatgcctttttattaatcaaatatgcactacttgaaatggtaaaataaatacaagttagtagtagtgataattcaaaataagtttaactttaagatgaatgataaattttagtttttaaaaaatattttatggactctatcattttaaatatccttattggtatataatttaaaagattaaagctaataaatgatacatgtgggaaacttcctttttatttcccaaatgtcatctaacttttgagatgaaaagtttaccactcattttgatatgataaaatgagtgtcaaagatatgaatcttgactataatattgacaagaaccaaacagatttttatttgctagttacatatctgtgactaaattaatctatagaaatgaggtgtctaatgtgtctaaaatatttctaaaatatacctaaaatattttaagatcttctgaaatatttctgtagtctcttctgtaattaatattctctgaatttacataaaactacctacccctagtgacacatctaatctctttgaattaagatctatttgtcagttgaacacaaggatattgtgtaatccctctgcgttctgctttttgaaggcgtcttggtgtagtgagaaatgtcttacacgtgtggggaaggagatatggagatatgactttgatgtgactgaggtcacaatacagtgtgacgattttaaaataggcacagaattataggctgagggacaataatccatgtatgtgatattggttaggacaggttttacttttcgggcaatggagatgggtggatgtcccaagtcagagaactgtacatgagaaaggctctggaggaccctgtgaagaactcacatacggtcctgagatgactggatggccagagaagcccaatatatctacctccaaagtgagagtgaaggaaagagatatttgcccttctcccacattctatttaaattcagtgccagaggagtaaagctttggtagaggattgggagacccagccaaaaccagcacacaccttctgccgtcaggcacttggaagagaaggacagaaatggccaagccttttctcgttcacatcccttgaggttcatatctgagagtggagaggagctgagataccaagtcacatgtgtgatggggattttttttatattttttattattatactttaagttctagggtacctgtgcatgatgtgcaggtttgttacatatatatacatgtgccatgttggtgtgctgtactcattaactcatcatttacattacatatatctcctaatgctatccctaccccctacccccaccccacaacaggccccagtgtgtgatgttccccttcctgtgtccaagtgttctcattgttcaattcccacctatgagtgagaacatgcggtgtttggttttttgtccttgcgatagtttctgtgaatgatggtttccagcttcatccgtgtccctacaaaggacatgaactcatccttttttatggctgcatagtataccatggtgtatgtgtgccacattttcttaatccagtctatcattgttggacatttgggttggttccaagtctttgctattgtgaatagtgccgcaataaacatacgtgtgcatgtgtctttatagcagcgtgatttataatcctttgggtatatacccagtaatgggatggctgggtcaaatggcatttctagctctagatccttgaggaatcgccacactgtcttccacaatggttgaactagtttacactcccaccaacagagtaaaagtgttcctatttctccacatcctctccagcacctgttgtttcctgactttttaatgatcaccattctaactggtgtgagatggtatctcattgtggttttgatttgcatttctctgatggccagtgatgatgagcatcttttcatgtgtcttttggctgcataaatgtcttcttttgagaagtgtctgttcatatcctttgcccaatttttgatggggttgtttgtttttttcttgtaaatttgtttgagttcattttagattctgggtattagccctttgtcagatgagtagattgcaaaaattttctcccattctgtaggttgcctgttcactctgatggtagtttcttttcctgtgcagaagctctttagtttaattagatcccatttgtcaattttggcttttgttgccattgcttttggtgttttagacatgaagtccttgcccatgcctatgtcctgaatggtattgcacgtgcactgatggggattttaaactgggcttggcacgagtcttccaaatggaaaattatcagaaaactagagaggggttcatccaagtgttataaatagaacgggactgacaattttcttacagcatattttggggaaagaattgaagaaaaattaacttcatgtatgtttgtatcccatggaatttagaacattaagtgtcctcatgacattatatgctggaaaaacaattctgttctaggctgaagctgcccattaccaaagtgagattatatagtaaaattggaaatgacaaaacaaattaatatttcatgcagcataaatatgatccattttagaggttttagtttgtgtatcttatgtatatctctgctatgcatccttatgtatatctctgctagctaggagcttctgttataaaaattattctataaaataagaaactatatgaaaaaggatgaaataaaaaaagtgatataagaaatatgagttctgtaatttaaaagaacctctgcagtaatttactaaatgctgttcttttaaaaattatttattattctttttatttttttaacttttaagttcaagggtacaaatgcaggtttgctacacaggtaaacttgtgtcatgggggtttgcggtacacagattatttcataacccaggtattaagcctagtagccattaggtatattttctgatactctccctcctcctgccctccaccctccgacaggccccagtgtgtattgtactctatgtgttcatgttttctcatcatttagctcccacttataagtgagaaaatttactgttttgtttcctgttcctgtgttagtttgccaagggtaatggcctccagatccacccatatccctgcatgaacctatatctagaaaacccccatagtctcagcccaaaagcttcttaagctaataaacttcagcaaagtctcaggatacaaaaaatcaatgtgcacaaattactagtattcctatacaccaacaacagtcaagctgagagccaaatcaggaatgaactctcattcacaattgccataaaaggagtaattgctgttctttaatgatacagtgatgttattagatgaaagagttttgaggccccatctatcttagaagactcattctcttgactctcttgaaagctgtttcagcctctttggaaggaatgagcatctatctttccatagcattgggacagactacgaagtactcagttgtctgctgatttcctctctagtctttgcttttcttggctgctgctttcttctgatcccttgtaacactagagtccttgtaactccattctgctcagtgaactgcaggtgccattcaaaactcaagaaagtgttccctccagattgtgatagtaagtttgcaggatagacttgcttaattacaacagtgccttagcaggcatgcaggctttcctcatgcttgcctaaacgaaatttagaaacggaaagggttagagatgcattagtctttgcggttttctcatactggttgtggcatctccgctgttaattgctttcctttagtgattaatataatttttccatccattaatctatatgccaaactgggtttgttcgtttgaataacttaaatatctacatatttttattttttaaattagcaaagatgtttaacagtttaacaatgaatcctaatgttttatttatctgttgtgtcagaaagcaagaagttgagggatcctgctcttagtggatatcattgtgaccctaatatatattgaattattgttcacttaatttataaatcctaagtcctgagcctttccataaaaaaaataattaaatgttcaataggtctctaaaatccgagactggctgaaatgttattcttataaagcattttgattaactggtttctatgtaatacgtatatgtctttaaaagactcaatgctttctttgctttaagtaactaagatacttattttatagaaggaatccaaataaatgtttcagcttcgtatgcctgcatagagatactcagttgatttatttttgctgatgggaacaaagcctaaatttagaagctatctttcttttatatcactgtcctaaaatactttcagacgttttcgagttttgtattttgtatttgttcaatgaatcaaataactaatatggcaaaatctagaagggttttaagctttgtcatcaagtaatactgaaccattgctcctagaggaaatacagggttgggttctcagagcctcaggtcacaacatttttacccatggatcaatacagaaacttgttttgagtgtgtttctattgaaaaacatcttatgtaatacatattcttgattcattaacattgaactcacggccagcagcactgtaactcatgcctgagctaagcttatctcatcatattttctccttaaggtgcaccacagccttctcctgcttaggagtcctggacagcacttcagcactgtgcttagaagttatttaaatggtgacatcgccaacaaaaagtgcaaaaatgtggaaatcatgactaataaatagaactctggaaaagacacttgtttatagttaagagagctggaacaggaaggaagagcgtcacctgctgggcttcagctgggaaacttgtgtgttgggtgactcagatttctccctttctctttctgagaaagtgcagtgaatattgattggggggttacaaatgcattgtaacgagtaggagaatttgcaaatacagagtccactaatagtgagggtcacttgtctcttcacagtagatcgtttgcacatccctttgggatttggtttgggatttgtggaatcaactgttcaacagatgatgcaacagcaatgctcctggattcccagtggttccatggtgagcaagggcagcaagtgagagggcatgctgaaagccttgctagaaatttgtcgtgattttagatgtgttggatctattagtgctttctatatcatatatatgtatttttcttagaaatatattttaatgtgctttatgaagtctcttaacagataggagattaaaaaagaagaaaaggtcctttaccccagaccatcaaaggcattgcctcattcagttggccatttcactctgtcccgtggatgcagaataaaggcaagagggcataggatatcctgcagttgaatcccctaattgttcactgatcccaagtctgtgcttgagaagtgaaggcttaatccttttttgtgccattttgttctaagatccttcagaggagtgaagggtaaacattcaaacattcaactcggtttgagaagagatgatgtgtttatgtctaagggattctagaatgcaatacaaattggtaggaaattttgagagaatgttttctaggaagaattttaacacagacatatcctgtccattctagtaagaagaaaatttagtcaaatcattctgaatagaattttctgtctcattgcagacttcagacatttaaggctcatatatgtatgtgtgtatatatccatatatatagtatacgtatatatgtgtgtgtgtgtgtgtgtgtgtgtatatgtatatctcccagtatcccctaaaactaagcttttttattaatatatgtttcatttattgaaatatacctgatcttcctataagtattatttactcattctcttttggtctataaatgccacttcttggatgaataacacatatgaagcagggaaaataggatatttcataggtaaaaaggtttcagttccttttttaatatataatgtaacattattatactcattattattataagtaataatgtctacattcttcttttgcagagtatagacatttcttgttcctttattgatatctttaaacattagctttactaagaacatatttataattaagagtaaattaacacatataaactgatcaagctgttgaaaaaattatacatgtttagtttttgtttaatctgaaggtactttagaaaacgttaggagaaacagttttaaaattcatgaaaagtcttagtaagaatgataatgggacaattaagacagtagtgtgggtttttgttttctattttttagtttttcctatttctcctgtgtgaggtgatgttcacagaagttcactatttcaacctagacaataaatctgccatccagaatggagatctaaaatgtattctggaaacttacattgtgtactttctcaaacttgaaatttagtgcttttgatcaaattgtaatgccagtggctgaacccacattttgttgaaggttttattttattcaaatctatcaagtgaaactttacacagagaagtctggaaatactaatttttcactcaacaaatgtggtggttatgtctctctgggctagttttttattcaatgaaggaatttttattggtaaatcttaaacctaccacagcatacttttctttttaactaacaatgttaaggaaatttactttaaaaatagcattggtttcattttaaagtttacatttctatgagtgtttgctatggaaataccatctgcggtttatatacacctattttcctgtttgacattttatatttttcttcatccttatttttcaccccctttctttcttctttctgttgtatgttaatgatgatctactttctgctccactttagggttgtaagtttcccaaccctgcctttcctgtcagggcctgttgggatagaaagaggggaaaggaggagagtgaatggaagatgcacctgtacggtgtcagttgctgtctttatctctgattcaataatttctgtctacaattagccttggcactgataggatatgtgtgtgtgtgtgtgtgtgtgtgtgtgtgtgtgtgtgtgtgtgtctgtctgtgtgtgtgtgtgtgttggggggtatcagccctcacttttcaatgtcctgttacagtctttcaaattacctatttttcacctttttctattttataaatccagtggtcataaattagggatcaaagactgaaaaggggcatttctagatttgaggaggtcactaagatcacaggcttcattgaggacaactggggcaaaatctgcccccagtgtgtgaggagctggaaggaatctgatctctggtttactttttccaggtttatactttgatgtgagtggattatccttttattattttcattaatatgagataaccaaaagttccttttttaaacttttagtgctgactttagatgtttacccctttgctgaggaatgttccatcgatgtttatagaagttatgcaaggcaatttctggagagagtcaggaaagaggccctgagaagcaggtaacaggttatttcatcagctggaaagctttggactctggatctccaattctagagcgggagatcttagcccctccacattttgaagatctctgccctgcctgacatctttcagagtttcagggagcatcttgctttcgcttttgacctctgcttcccactcatctgggttactccccaaatgctttcacaaaaactctttctggtgtaggcacagtctaggttctctgagggtcccaaacagccttgatgttccactcacatcgagcccacatgtcttagtcttctcagaaccatggtaaaatgccatggactgggcagcttaaacaacagaaatttctttctcacagtaatgggaggtagactgtccaagatcaaggtgctggccaggtaggtttccttctctagccttgtcccttggcttgtacatgaccacaatctcatagtgtgtttctatgacctcttcttgtgctcaaggggagagaaagggggtgggctgtcttgtgtctcttcttagaagggcactaatcccataatgaaggccccaacctcatgacctcatctaaccctaattgcttcttaaagacccagtctccagataccattacattgggaactgaggtttcaacatatgaaactggtcgagtgggacacaaacgttcagtcttaacactgggtctccctccctctgtttgggctgctacccaccatcaatgcttcctgctccccactggtgccaccagctcattaggccatagtgctgctgcctcaacgttcttgtcatgtgttttagtccgttttagtactgctatgaagaaatacccaagactgggtaatttataaagaaaaagagggccaatggactcacagttccacatggctgaggaggcctcacaatcatggggggaggtgaaggaggagcaaagtcctgtcttacatggcagcaggcaatagagcagtgcaggggaactgccctttataaaaccatcagatcctgtacgacttattcactatcagaagaacagcaagggaaaaacctgcctccatgattcaattacctcctaccgggtccctcccacaacatgtggggattgtggaaactacaattcaagatgagatctgggtggggacacagccataccatatcatcatgattcacttatgttattctctttgtgtcacttccttttatgtgaatgtcactgctacctgtactactacagccagaactcctgtttattgatctgtgaccatattaacagagaaataggctcaggtttctgattggctcagctcttattgatggagtccatagggttcacagagctgtagcttaagttttatacacatagaacttttctactaaatggaagataggtgggtgcattgagagagtttccataaagaaccacggctgaactcagaaacacaagttcactagttagattgtttctaaaaggatcacagcatatttggtgatttggccataggttgatgccccacccaccttgtccagcttaaatacttgcatagttctgaatcccaacttttcaaaatctcttccagaaaacttttcagactctgaagaaattgtcagtacaaatactaaaggttcatcagctctttttgtacttgctcacatagggataaacagtccacttccaagtactgaaggtccatcatcttcctaccagtgatggaccatgggccagggcagggagggtaagcccgtttccatagtgctgtgtacttgcagtgatttcaaattaatagcttgaaatcagccatagtggggaagtgtgtacaccatggaaattgacggtactacaaatctaagcttttttgaggggaaggggtccaaaataccagtattgtcaccatgatcgattataggttacctcagaaatttgcctggcttccccattcacattggcattactattttacttcatttagagtcctgtttcttttgttaattacagaataaaatttacatttgtaggtttttccttatccttctctttctaatgcatatcgaaagccctgttcagattttcatgaattttgtaattttggccatacacgatttggtatgtcttaggttgatattttattagctgacacaagttaatatttctttagaaggtgatggaagaaaacagcagtattttttccaatatatttcctctaaaatacattaggaagaacagttttgaagtggtgaatagtttttggagacaaaaattctaaaaaaaaaaaaaaaccctatctttacataaatacagttttagacaaattctgccgtattcactgcaacattgtaggctgccatgtcatagttttacatattcagaagacatgccaattgttcataagctgagattgcttgagaatcagattttgcaaaagaattgtcctgatatattttctattttaagagtttaagaatgtctgaagaaaacaaaaaaaaagcaaaacaaacttcttgctgtaatgggtgaatgctctgtttgcattgattctgacttcttctcagtggtgaaacgccagacctcacaaggatatcattagacagcagtcacagctcatgccaccatcaggaggaactctagtccacattgttttaactggcaaactcaattcctcacaaaggccagaagcagtttggctaaatttgaattgttatataaatatatgttggataggatactcaaaatttagaaagaaaaaactttaacactggactgtggaaagctgaagataataattatgaaaaaatgtttcaagttaagaaggggttttaataaatttgtaaaatggcatgccttttagggaaatttgattcattaatatatgcctgttagcatatacttaagctagaaaatacttttttattacgtaatacaaactattcacttaaaaaaatcttaagatcaaagacaaaagttatgaccatctacatactaatataataatttcccaagtatttgaattacctccattatgtgcaactaaaacaagcaaaaaatataaatataaatataactgattctatttagttttgtttcttttaattgaataaaaacattttgagatcaatgtaataaaattgtgaagtgtttttatttaaagccttgtattgggttttatatccaactttagcaaatttgacctgctaatttccaagtgggttgaattttgcgtatgggtgatatgtgtgtgcttatttctgtcatgaattttacaagaatgactcatgtctcattgtgaatgccctcagaaggccgcagtccctgagcatttgctgccggcagcggaggagcagatggagttaattaacattaaccaatggcatggtatatatactaaacattcagtaagtgttatctacattatctgcaatggcatggtatatactaaacattcagtaagtgttatctacattatctacaatggcatggtttatactaaacattcagtaagtgttatctattaatagtaataataaacacaatgaaaggaaaatagtttaaattaaccaaccaatgttatcagtgcagaacatctatggagtttgcttagatgattaataaatactttcactgtcttatctagaggaaatgtgtaatttttgcacttttccatctcgattggctaaagtgcccttcacagcagaaagctaactattgaagaatgatattgcctgtcattttctgatataataaatacatgtttgtgtatataataaaatagtttcttttatgcatcattgtattccttctagcgaacatagttctaggcattgaaataatgttttctaaaaaatcagtagaagtacttatggctaaatttgagattctgaaatgttgtctcgtcacatttgtattatatgtcctatgtatgatatgagtctcatcataaatttgcaaaatgtttaggttgttagcagtgcgtttcctaaggaagaaacaagaatctgtgctgaatattaattccaggcatgactgagggttttccaaattgcagtagtcatttagcaggctgttatttgacacaagactatggccttggagattgtttattgtatctgctgatttggaatttgtttagaataggttgcccaggaatgtttctgaacatgctgtctataaatatataaatcatcttttttcttaactatgctatctaaatatataaatcaacttttttgccaactggctagacattaccgctgagtaaatggcaatcaatgtgcagagaaccaaaagaatattaaatatgagtatttccaatagagaactcagatagttttattatggctatatctgttacaaagtgttcattcccaaatctgtctctttgcaaagctaattgtatgccagcagcagatagaaaactgaagaaatgagtagtgtgaatcgacaattctaattgttatcttatttgcagataaacaacgcatgtaaaaagactaatgtactgtattgacttattgaaaatatacgataggaaccataaaaatcacaatactatttatatgaaaacaaagtgtcacacaattaattttaaatttatggatatcatacacaatgtaaaataatgtgagatgtcaccttcttagacagcaaagaacaatattgcttctgcagagactgtacaatctgtatctgcaagctccaattctaataaaccccttatttcttttaaaaatttattttattttatcttattttattttattttattatttttctaactttcactttaggttcagggcatagatgtgcaggtttgttatatgagtaaattgcctgtcacgggagtttgatgtacagattactttgtcattcagataataagcatagtacccgataggtagtttttcaatcctcaccctccatcctcaacataggccctgatgtccattgttccctgttttgtgtccatgtgtaatcgatctttagctccaactgagaacatgcagaattttgttttctgttcatgaattaattcacttagactaatgacctccaactgcattcatgttgctgcaaaggacatggtttcattctttttctatggctgcataatattccatggtgtatatgtaccaaattttctttacccagtccaccattggtgggcttttttatagctttggatttttaaggatggtgtaagaaatactcaaaaggaacgttttcttttcttgagtatttagcttcaaacccagctctgtcatttactacctgtgctttttccttttcaaatgagaatagtaatactacctgccttatatttaagaatcttaaatgaaaatataaacttattgtcacagcaaatgccctcaaaatattagctatcacatctatataaacatcatgatgatgtcattgtatgacagtcaccaacaatattaagatctttccagaacctcccaggtgaagtttataatctctctatatcaacatagaagcacaatattcatattcatctttgagtagcactttaaaagattataaaatattttaaaagacattaccttatttaatcccttttgtaaacttacacgtttggcatggctaattgtatatttttttctaagaagtaagggaggttcaaacaggcagtaaacacagcctgtccaacaatgcaccatgtttagtggccaagacatggacatccatgcattacaacagtcattctcatagtgtggtccccagaaaaagagcactagcattgcctgaaaacttgttagaaattcagatattcagcctcaaccagatctgctaaatcacaaactctgggagtggaacaccataatctgattttttagccactctaggggatattaatacatgctaaaatttgagaatcattgcactagacaaggcaactaaggataatatctgaaatatgagcaacactcaataattatcatttttttcaaaatcatagagatacatatatgaaattagtatgcccatcttttagaaatcagctatatataagaattttgatatctcctaaattggtgaatatatttacaaataatagaaaattacaagcaacaaataggaaataaatttttgtggcttttttcatgccacacccacaatggttttattttattttattccagctttatggagcaatcattgacaaacaacactgtatatatttaagatgtacaatgtgatgatataatatgcatatacattgtgaaatgattaccataatcaagcaaattaacacataatcatgcattcagatagcaattttattcacacaggccactttacttcaaaggagagtaacctggggtctgtttcaggaatgttaaagttctacatacaatgactgaagcctaaaatctaaatgagatattttgtcttctaatatcaacaaatttggcaaatataaaagtattttttgtcttgcacaattttcagattagtgcttctttcttaactgcaagttaaacccacttaagatttttaaagaagatttggtaggccaggcttggtggctcatgcctgtaatcctagaactttgggaggccaaggtgagcagatcatctgaggtcaggagtttgagaccagtctggccaacatggtgaaactccatctctactaaaaatacaaaaattagccaggtgtgatagcacacacctgtaatcccagctatttggcaggctgaggcacaagaattgcttgaacccaggagacagaggttgcagtgagccaaaatcaagccactacactccagcctgggtgatagagtgagattctgtctcaaaaaacaaacaaacaaaaaaaaagttttactacataatagcttatgtttttgaacaattactgtctatagttaggcacaagggagaatagggcattttattttctggaattactgacaaattatttcttcaaattcttcccttctatgatttcttcttgatcgtgttgtcttatcttcctgtactcattaattaaatgacttggttaaatatattggtatggggcaatgtataatcacagtcttattaccttctcatttttctcaaaaacttaaatgatataattacccttatcttcttacatagctattgatgcatttattttttaatcatactgttgcaggatccttggggtgacgcatttctggacagaaacctctgtggccagtggcacctttgtgtgagttttgcttgggcccaatgggctcattgcacccacttagcttggcaggctctactcggctcacactactggcctggatcccacacctgccaagtgcgagccaggtgtggagcagcaaggggtgtgtgagggagcaagcattgggtccagcaactgcacagtcacgcatgctggctgacacagcaggatgggcacctccaggtgctggaacaggtgcctgctctctgcaaggctgtggctggaccaggttcaccacaggcagcttcaacagctgcccccagggaacgcagtggaagcctggggactccaggaaatgcaaagccccaaagagggagtcacagtcttggcttggggagctcccaggtctggagagggccacagctctcctctccccttcaccttcaatgtggcgagcaaggggcatgtttcagccctgtatgtgttacagctctttcagccctgccgttccacatttctcgagttcttttcctgcatccaggaagaatgaggtatgcagataagtggagggtgagcaaggtgaagaggagctttactgagtgacagaatacctcagaggaggccctggagtgggtagctcctctctgcagctggttgtcccagtggctgctcagctctggctgagcctggggcttctataggcattcaaaggggaggaagtgcacactgattggtccatgggcagctataggcgggcccagaaaaggcaccacaagttcccactcctgtcagcgggactggtagccctgcctgcagccttcaggcccttcccagcctgaaagtaggcttggacatcccgttctgcccaggtacctgtctgcctctgctgccattcatggcatccaggctgttcacgccaagaggagcctgcaggccagcactgaactacctgcaacaccccctcaacttccctcctatgctcatcagcacccaaagtccagagggggctgtgtgggcaggggctggtgtgtcagcactgccccaagtgtgcgcacacccagccagactgggacagcacctgggctcagccccaacttttctgagatttgagcgggtgccgggaatggagagagggaaggcagcgaaagcagacacttctgaaacttgcggggggagatgcctgactctgcagggcattgtggcttgtatggctgtagctgcacccaggaatgtgggtctcctgcctgctctgtgggctaggaggcccagatctaccgccgtgacttgggcatctgcagctgccccaggagggcaggtttcctgcctgctcccaggccccccactttgagatgtcaccgtcaacgagggaggcctgggttcacaggcacaacctgagtgtctgtagctgtgaccaggaggacagggatcctgcctgctttgtggagtgggatgcccgggtccacagccatgacgtgggcagctgcagctgcataccgggagttcccaccccaccaactcggaaggggcggggctcccacttgtcccggctaccaccaggtctatggagggtgcagccccagcggggcttcccggctgcagctgatgtgatggcagccgtggctccagacagccgctgctgccatcagtgctatctcgttcagctattttcagtggacctatatacacttaaatttcacacagttccccaaatggacaatgctttctaacacccatgtttttggacacaatgttttttctgtcttttttcttgactaatctccattcattcctctaaacccatttcatatgacattattaccagaaaattcttcataatcctctccataatgggtagggtgatttttttcatattttctcatggtattctctgaatccatccatcatagcacatatcatatcacattgtagttactttaaatctctgcttcctcacagaatgtgagaatcttaaaacatgaattatattagtaattttcaggcttccagaactcattctgtggcacagaacatttattgaaaatttgttggatgcaatatacaggttgtaaataatatggagtcaggaatgatatgtttagtagcaagtacttatacaggcaaaaacatgagttaacactgttgcattagaatgtactaggcattgttctaagcatattactaataaaatattaattattaaaacggccttatgaggttggtattgctgtcagtctcattttatattaaacaggtttgagttagtattgaccatccatgccacaaagacagtaagtacaaaaaaatgcagattagggtaaatatgtaatccttctaaaatattgcctggaaagctacgcataagattattatcaaaccttctaaacagcatttgtctgaaatatacatttcttaaacttgagcaaagtcattcgaacagcagttttaagtagtccctattactctaatagagaagctaaagggtcagactagagaaagaaccaaatgtcgtctgatgacacacatgctgtgtccagccccaatctctggaaacacccccctctcacaccaccccaatgccacgtttcacaagcaggatccttgaaaagggagaatcgttcatgtggctggaaatggagtgttactgggtataggggctgacttggtctgtggaacggtgatgtctcaagcactggttattctcctgctcacaggttgtcctctgaaaggacggttactaatttatgaactccaagttgatagtcatcatgtccatcttattcccctgcatgggcctaacacctattggaaatagaagatactaaatacgtatttgttgaattgcaaaatcaatgaatggatattcactttacttgcttgatctgcagattctagggaaatttaggtcgcacatcaactttattttaaaagctttttaaaatataaaacagtgttaaaattaaaacttgagatgtgttacttcattctatgccttaaaaaaagaatattggacaggtatagttgttcatgcttgtaatctcactacgttgggaaggtgacgttggaggatcacttgaagctaggaatttgaggctgcagtgagctatgattgcaccactgtactccagcatgggcaacagagctagaccttgtctccaaaaaaagaaaaaaaaagtgaagacaaataatattaagcttatctctctctctccacgcacacacaaatacacacacacacagacacacaaaaaatgaatacttgtgtgactcttaaagaaagaatgttaatcttactatgtgcataggagatcagaatacttagaaaattcactttgggaaaattagatatagtaaaatgaacttaattatttgatttcattccaattaatgaaataaaataaaattttaatttttattaatgaaaataaagtataataacaagtttgtaaatttttaacttactttgtagtattgaaacaaaatagaacaattcttctttgaaaccacaaaggtttattttaataatgcctaaagacaaatcattataaacccagaagattttctttgaagaacagagttgggatgagtcccagacagggccattcttattttttatgcaaataatttgatatgataaggaataccaaatgatattttaaagactataattctttattttggaaaattcaattatatatgctcacatataattagatatgatgacagtggcttattgaaaatatgagtgttctcagtgagttttaattgataacttagtgtataagttaccccacaattaaaaggtcacagttagcctatattggggggtaaattataattttggggtgaattggtttaaggtgatttttataactattttcagagtcaaagcattttgtacttcatggttaattcttccaggcatggaacagggcaagggcactctcttgtacaaagatgcaactccagtgggaaacatagtgcctggcacatagtagctgttgaataaacgtgtgttgcctgcctgaaaacaaattttcccgtgtatcagggtgagttgttacattgattttacaaataaaagagaaaatatttaaattattaggcaagaatgcctaagtagctgtttgaaaaatcttcccttgttttaaaggctctgtaactatagagattctcaactgcgtcactttgagataatagattgatgtgtttattattttgtaataattttgaatattacatttcgcaatggtatatgctgtgtgtaaatgccattatgctgaacacaattttcagagacagaaatgtaataaaaataggataaacaatgaaataaatttctctccataatttatgcttaagggtatatatatacatatatatgtgtgtatgtatatatatatatgagataatgaatattggaccaaaagatgcgatgggctaagaagattacttgtttagtttttaaaataattttttatcctgaaaaatagaaaactgtttttaactcttgagtcaatcaatcaatagatgtggactgaaaacaatattccttactgtggaaaataggctagaattagtgtgatagaattaatcaaatctacttttcctttgtagaatgagtaatttacgcaaaaatgattaacttcaacaaagggcagatttttctctgttttaaaattttactccccaaaacacaagctaaggacttctaaaaacagtaatttggcaggtagattttatctctatttcatgtaaatataattcccaactgtcatcagtttctgatggctgacaattctgacgtttgtatctgcagcccagacttcggcttcctactccatattctttggtcctagcctactatgcatctccatttggaagcctaacaggcgctcagacttaacaagttcagtttccaacatttgcttcatttcattaaacctgctctttctgcactctttcatttttattagttgtagttatattcttctaggttttcttgatgaaaggcttagagtcattcctaatttctatctttccctcacattttaattcttatgcatgagaaagtacagtgcagatcctgaatgctaacatttttcatgacaaccatttgcccaagccactattggacttctgcatcattgtggtatatgtagaatatgtaaatggataatattagtaccaatctgacttcctggcttccctttacatcaccccatcgacttcaacctcagttttctccatataacagccagaacgatgcttgatacaggtacatgagattgtgtaagcccttcttcatggccctccaatggtttcccataattgctgtcagtctactattttccaccaacatacatactgtgggcttcaaggcactgacgttatcttctagtattctccgcctctgcttttatacttacttggacacatcaaataaatatccacatttcagattttgtacttgctccctcctcaaccttcccattcttctgcatggacaaaggacttgacttgtttcctttattcttgccattctctttcatatgtcaccttctcagtgaggtctctcctggccacctctccattatactggctctcagcttcctaactttaccttccatgtccttttagctgtagccactattggatgttcaactcctctggaatataatctccatgaaaacaataactctgcctcctgggttcactgcctgtagccccagcacctgacatagtgcctgatacagagaaggcaattagtaaacatttattgagtgaatactttgctgagagttcaatcatttaagtaaatattaatgtatgttactggcaatataagtaacaactagtggatacagataaatagctagatagatgtgttcacctttattaataatatgtaatcttataatcaccctgaaatgtaaattaatttcagtcaatatagtttgacaaatataataaatcatcatttagtattttagagtttgtgtaaggtgagtgatctaactactttgtttataaatctaactgtcaccattaagacagctaatgtgatttataaacacatgtattttggaattgatatgtaaaatctgaaatgccaacaaacatttggttttggagtgtgtgttagagtatgttaatgttgcattcccttctactttttttgaaagagatcctcaagagaaaaacaactctagaaaatggggtactgaacaaacacaaaagatggaaaaataagttgaaataattatggttaatagcattctcatataatacctaaaacgtcatattttctaccaaaagaaagtactttacatttggaacactatttttttagaacttattttatggtagagttttggatgttcaaatttatcattatcagatgatctcaaacaatactgagttcgtgctaacttgactccactgacaactgattagtgaactagtttgtgtatgttgcttactaggtaatcaagctccgaataaaagagtacagttttcaaaagttatactattgccaaaacaaatactatatgttggaacccaatatcctcaaataatttattttccatggaagtgtgtaatctcagcttgagttgtctaatcaatccagcaccacagccaacatcagttcaatatcttttcttctcaaggaagagcacgtactgagagtttctgctcttgcaatgtgatcttaggtttccacgtacttgtgggtcaggggagtggtgtttagtagtttccacattcttacatttgcctaattaacatataacaattgttgcaaaatgcctaattacagttgggacacatggaacctctttagcttttctgataagtctgtaaccatgaacatcatcataagattaaaatgaaacacttatgtcagttcatgtaatgattcattttttaaatttcccactgagacacagggatgatttatacttatattggatccttaaatatatctttataaaggttagaatattagaacttcaatctagagattaataaatgcaaaaaatacagaacatagctttcattgttattatgatcacatccttattgtattgattgtgtaggaaacagaaacaggaaacccagaacaatgatctgtaacagtggaataatatttcttccttaatgtcttcagaagagccaggagagctattatttcagaagagttgcttttatttaatacatagaatagtttgttttactaaaattaaacaaagtaattagattgactttctaaaagtggtaaattgtggttgcaataccattggtaagacactaagtgaaaggatacataattggctaacttcttgaaaagcatgataatatcatttatcatagaagtttgataattattattgttggaagaatgacgaatttgaatgtctgaaaaatttagcggaatatattcaacagataaggctcaggactctgaaaccaagaaaaccatgaaacaggagagggtaattcaagaaaatactgtggagagagacactgtgggccaagaacagaatgagggtggctgctaatatattaaaagtcgagaaagaagaaataattcaaaaaacaaagacaaaatggtcaaggaaatgcagagactctcagaagaggttacagtcaagagtcccaagcgaatagagcttcaagtaataagtgctcagcagtgctgaatgcagagaagctgttctagtatctttaatttgttagaaactagtaaagtatcaaccacgtgaaattctgaggtggttactttaagctacaatctaaggagtggatcagttgtcttatcataacctcaaatcccatgttatttagtgtgccatcaggaaccccacacttcaaaagagcattcacatgtgcttgacctcgagatgccatatatgtatatcagtcaaacagcacgctcctttataaagtactatgaataatattacaaataagttttcattactgaaactagtggtcttcaagagatgttagactgactgaactatttaaagatactcttaataggataaggatatagaaagttctgtagtgtgcgctcttatagatggagccgttacatttatctctaaattgccctgtgactggctgtgaatttaaaggattctgcttggtgttagccttaactaaatcttgacctaagagtattgtcacatattttttcttaaatgaacctttcatgcaaactacagttaccagatagctgaaatatccttgcattttcaaaataggttgtatgattttattgtgtatgcatgctaaaaatatttgtataataaatagctacatgtgtgacagatttcaatctgagacattcttttattagacctaaaaatatagttatgggaataatatcaaaccttaaagcagagataattatcttctaaacaggaaccaagtgttgtgcataaccaaaatgttttccagttgacatagagacccatgaactaggataattgactagtgaattttcaacacagaagctgttgtttctttgtggcagggagagttcactgctactgtgaaagtgtaaatctacctgaaagagattgaggaggaaataagaaagtgcagaaaacatctaaattaataaagttctcattgtcattgtctggtatattcttctattttggtaaatagtaagtatggttgaattttccttcattgtaagattaaagaaggcaaaaatatttaaaatcatagactttaaaacagtaaaattactaaacaatgtcttaaaataacacaaatacttgtttttcagttcaacatatattatctttaaaaataagatattttgctttagctaatatatcctcatcctgatataaacttaataatttagagcatgaagaaaaaattttaattccagttacaaaaataattttaatatattatttgacatatgtgtcattttatattgaataatattttaaaccaatatatttcttattcaaggacagaaaaagaaatgaatagagtcattattctctggaacaatagaagaaaatgttatattcgtaggtctcaaacattgtttcaaaaaaggagtaccttttgcaaactaaagaactaccttttgcaaattaaagaactatcgagaattctgaatgactcagataattttttataagagcatcctcagctatatcttcttatggattcacgatggaaaattataatactgtaggtttccatgtcaaatattaagctaattaccaatctagttgtctagtctgagagttaatgggataagtttcagatagagaactgtcattttgtctaggcagctagatgagtaggtaacttaaaataaaagataagtcattttagaaatatgtgaggtcaacaaagatctatctctttgttgtttaaaatctctaagttttaaagtttaaatctctaagtcttaattgaaactgtcccaactacccctattctatctgacaaactatgagcaagaagataacaccacagttccttaaaaaaaaagcaccagcactttccacacaatcacaatttttaatggaagtaacttgacaaggaaatagaaagtaagtaaattaatatgagaacatatacctgatatttttctgagcctgcttctctagttaaggcaaatataatgtgtgccattatatagctagctggggaattatatgtactagtaacattttgcatccaacgaatattacaaatggaaaaagtatatgatgagcaatattcaaatataaaaatctatctttatagtttttagcagtctatgcaaaaagaaatcttttttcttcaataaaagtgacattttttccatttgtttaacatgtgaaataccactttgtaatagcttaagcctaccacatgctatcaaaaaaacacaggaataattaagagaaattataaagattattcagaaatcttgtgatctagggcttttgtgattccacgagagctatttaaatatttttcctattttccaccaatatctcagttttgttacaggaaaaatgttgaagactttaaagatgagattgtctgtgtctttttctctaattaaaagctcctactggaagctctccgttcttctccttctttacttatatatagttccctctgcacttattttcacgtaacgtttatgattgcatttatccatataactgtttgtaacttgtgacttcctactccactggaggactgaagaaaagttctcttttctagttcccacagtccacagtcacatcccgtcatgcatatgaaaataaatactactaaaatattaactgaaaataaggatgctagggttttccttttgtcaggtaagaactaacttcttttgtcaccttaaacttggaggtggagataatgatgttgaagggactgtggttaagcaaaagtggagttttatcttcccttacctatcagtctttttatataattggccaagtccactgcggtaactactatctaattccattgacttgtttcctgtgtgaagctctgaactgtagaagccttaaagtttctaatgctgtgggaaaaaacctgtggtggagcggttacaaatcatggcttcagaattaaatgtagaactggattctagtcctgtcatactcccattcttttttttttttttttttttttttgaaacagagtcttgctctgtcaccccggctggagtgcaatggtgtaatctcggctcactgcaacctctgcctcccaggttcaagcgattctcctgcctcagcctcctgagtagctgggactacaggcgcccaccaccacgccaagctaatttttgtatttttagtagacatagggtttcaccatgttcaccaggctggtcttgaactcctgacctcagggatccacccacctcagactcccaaagtgctgggattacaggcgtgagccaccatgccgggcccacactcccattctttactcagcagcatgcaagcaaacaaaacaaaacaaaatcctatttctaacaacaaaaattcaccaaaatactagcaaaattaaacacaaaatgttaaaacttcctcaaaaaaaaaatgctggacacttacccatatgctttttttttctcacattaagataaaagcaattatagctaactggtgggatcagtgtgacagttccatgaaataatgaatgtaaaggtcttagcaaggtgcttggtaaattctagcaacaaatgaatgtagctgttatgttaagataataacataatactctttgggttcagcaatctttgacatttattttctccaatttatcttctaatggacaaatagatggaagttataaagactcttttttaaaaaagtatataaagtagcaccatcactcagggacaggacatttttctgtaaagaaattaaggtatgtttacatgcagtataatttgcacttttaatgtaaaattttgtaagcccttagaaatgggcatggttatttaaccaccacaagaataaaaatacacaacaatttaatcactccccacaaatttccttatgtctttttgtcatgaacccacaatttatccctaacccctgacaacctatgatttgttaactgtctctgtagttttgcctttgtaagtgtcgaagaaatgaaatcagacacaacataacctttccagtttggcttcttatatttaatataatgcatttgggattttctacacatttatatttatcagtgggtcacttctttttcattggcaaatactatttctttaaatagacctatcacagtttatttatttacttacctgttgaagtatatgtgagccatttccacatctagaattgtgagtaaacatttcacatacatacataaattgtgtgggaacatattttaattttcttgataaatacccagacgtggggttgccgggttgtatggtgtgtgtacattcagtattataaaaactgctaaagttttcctaaatgatggcaacattttgaatttgcattgcttcacaccttgttgaaaatgcacacacacacacacatatgtacatatatacacacacacacatatgtatatttaaatatatatatttttggattatattgtatttcattgatctatatatccattcttttgtcaatatttactttcttggtaattataggtttttgtgtttttttgttgtgttttgtttgagacagagtctttgtcacccaggctggagtgcagtgcagtggtacattctcggctcactgcaaactccacctcccgggttcaagcaattcccctgcctcagcctctcaagtagctgagactacaggcgcgtgccaccgtggcttgctaattttttgtattttcagtagagagggggtttcaccgtgttagccagaatggtcttgatctcctgaccttgtgatccgcccacctcggcctcccaaagtgctgggattacaggcgtgagccaccgtgcccagccggtaattatagttttaaaataagtcttaatatctagtagtccaagtttctcaatattgttctttttaaaaattgttttgcctctctaattcccttgtcttctcatatatttcagaatcagctcattgatttttacaaaaatgtattattttggagagaatttacatcttactgctgctgagtcttctaaaatatgaagactatatataccttaatttatttaaatcttttatttctttcatcaacattttatagatttcagcatacttattctgcacatatttggtaagatttaatgcctaagtagttcatctttcatggtgctgttgtaaaaggaactttttaaagtttttgatcttcattgtttatatatataaataagttgctttttttaacccttgtatgacagtgctaaactcacttgttagttctagaaagttcatgcatgttctttggaatttcatgaatagataaaatcctatgtcttccttttcagtctttccagtcattatgcctcttgtttcttttgtagccttgttgcactgactggatgcagtcagtgcaactcatggatgatgttgaagaggagagggaagagaagacaattttgactttttcccagacttaggggaaaagtgttcagtctttcacctttatgtatgatgttaattataggttttttatagaggctatatgtcagattgagggattttccttctagtcttagcttcctagtatatttttttcatgaatggatgttgattattttcaaatattatttcaaagattagttgtgggttttccattatataatcttttgatatggtaaattgaattgcatagccttcaatgttgaaccagccttggttactggaagaaattccacttggttatgatgggttgtgcattttgtatgttgttggtaatctttgctgctattttatggagttttttgcatctatattaataaggtacattggtctgtagctttattttttcctcttgtgatgtcttttctctaacctcagcaactgctatcctcaaggaattacttgagaaatatccccttctctctgttttgtgcagtagttagtatagaatttatatcattccttgcaacttagtggaattttccagtgaaatcatctgtacctttccaattttgttggaaagtttttaattagaattcagttttgtttaaagtcacagacttcagtggagatgtaaaggtcacattacagaaacaattaggtagtgagtgtgaggatggaggtggagattgatagcgtttgggttacatggttctaggcagtgatgtaaagacagggttattaaaattggcgtgatgggtcaagtttggcactaagtgtatttatggatctacagcgccattgcatactatagcagagatattttttctttcataaggtcatgccatgatgcttatgcagtctgtctcaggaattcatgactgcaaactggaagatccagatatggttaggaagaaagaaatgagaatgagtgatatagacagagtctgatggaaagctataggtgctctttgaccactgtggaggaaaaggaaccacttttgctgtgattagtcatggcatctttgttgcttttaaaagcaaattatatattttgataaaaatcttatttatattgctaaggtatagatagaacaatgatgtgtattccacatttgtgtagctaatattacatattttaacaatcctattacatttccaccatttactcaagtataaccatcaccagtggtaagacacaccctgtccacctggttgtgcttatgagtcccaagtattctttccttcatcagagaaccctttttttctactcctcaaaattaccaagtcctggttcccagaataatttacagtcttaattctttttattctttctgtgtgtttcttcaacctcatttatatatgaaattcaaccacctttcaaaatcttaacaaaatgttatgccgataatcacaaaattaattttaaagccaggatatggccgggcgcggtggttcacgcctgtaatcccagcactttgggaggccaaggcgggcggatcacgaggtcaggagatcgagaccatcctggctaacatggtgaaaccccgtctctactaaaaaatagaaaaaattagccgggcgtggtggcgggcgcctttagtcccagctactcgggaggccgaggcaggagaatggcgtgaacccgggaggtggagcttgcagtgagccgagatcgcgccgctgcactccagcctgggcaacagagctaggctctgtctcaaaaaaaaaaaaaaaaaaaaaaaaaacacacaagtcagaatatttgtactttctgtgtcagactttcatttctccttacccccaataacactttcccaaataaattgttcacttaatatttaagctgcacatttaacagctctcatttaaataaaactgtctctacatatttttattctagggtgaacacaactaaattgtaattgtgccatcgttgagattctcagggtgttatgtatttatgcaagagcaaatggatgtgaaatgcttccattatttcaaacttcaatgcagaaacagcagtgacagctgcatttttttgctggtaatgttcaacttgatcaaactgtcctgttttattaaatcaatgttgccgcatacaagactaatggaagaatggcaattagatgtagcttttaccctgagactactttgctaggagactaatgctctaatttgtgtttcagaaacttgctattattttaaagtcattttggctaaagtttgaatattcttgaaacaaacgaatcctaacattcttattaagcacagagagcaatgaaatacaagtttattacactgaattggagctgctggatattgcatttaattcttcattacttgtatattctttttggtgctattggaatcatacaatattgcttttagttaatattaaccattaagtaatgaaaacatcttcaatcacttaccagggtatcttaatactcactgttcaggccataaatttgcttttgtaaatatggactactgattttattaacttctttactaattgcctttaagacactcatgcccagtattttttaaaagtccaaatgagatgaattggagttttgttgtttagcttattacatttaaataccaaacagagcgccaaatgtttttaattttttctatgattttatgaatggccattaccaacgtgaatacattgtgtcatgtccaaaatggtctatatatctgtatattggccaaagtacaaagcatgagcaatggtgaaactgtctttactaaaatgtataaaacatcttatgattctgaactgctgtgaaaagggaagtcagattcagtttagtcaatcatttggaaaaatgtgcttaatagccaattgtaactttagtaaaataactttagtaatttaaaatttgtattttagtgtacatttatttttgctcatttcctcatcatctttgtcttcatctttgatctcccctcccctttttctttctttttggctaaattataattatatggaggaaattataatgttaccaagtcatagatgaagtaagtggttgaactgaggaagaatacaaataattctggcaacactgtcttatttataagaaaataaaatgaaacaaaatgaaacttgttaacagaagcaatgaattttgaagagagaggtgattggagcaaacacattgattcctgttgctactgttgttttctttacattaaaaatttctttcctcatatcctatgcactctattattacagcattatctgttgacagttatgtagctcttcaagaccttgaaccatctttctcccatatcatctgttgtttttgtatcttggcacattgctctcacacattaaaatattccttttttggaatgcagtatataagatgaggcacaaggtacagattcataacattgttattattttagagagagagctgtagtcaactctctaaaactgaacttcttttaggagatgagatctaataattattatacttgcctaggaaataagggtaaatatttgaaggactcgtaaaacaaggggtaagacatcttcaaaatctataaaactttacttcagtgttatcattcatatgcagatattaaaggagatgaagcctgttttacacataagcactttgtcattttcccaatatactatgattattttataccacaggagatagtagcaataaataggattaggcccatactgtcattgttaatatattaaagatttttcatttattgatctccttaacggttattacagaccaatctcatcccatctgtaaatttataattagcaatgtgtcctgcaaaatattaaaccatttgccttgttaattgtaaaatatgaataccttactatcaccattgaaaccatagttctttcactaaatctcttctagaatctggctcatttaattttcattccaaattaagtattcattagactaaaaccacataaaataacacatatcagactgttaggtaagcatgagaaatatgctgggttggtaagtatgaatgtgcaatgtaaaggagattggactgataatatcagttggattatgtttgggcagatgcttgggttgaccctgacgatcacaataatggtgtttctagtggatttcagttgttttttcctgttcatcatcgccccatccccccacacgcacccccccacacacaatctttaggtttaaaatatattttatttttgtggaaattatattccatatttgcagatgggtctccttgtctcggtactccccccaaccttctcttacaaaaaaagggcaagaaaccatactcaagccttgtcaatcaatgcaatcgatgctatcttgagcgtcatactttattcaaatgttggcatttaggtcaagccaaccccttcgtctttgctttcttcttctttttttttttttttttttttttttaggtagagtctcgctctgtcacccaggccaggctggaatgcaatggcgcaatcttggctcactgcagcctcccccttccgggttcatgcaattctcctacctcagcctcctgaatagctgggactacaggcgcccaccaccatgccaagctaatttttgtgtttttagtagagacagagttttgccatgttggccaggttggtcttgaactcctaacctcagttgattcgtccgcctcggcctccaaaagtgctgggattacaagcgtgagccaccgcgcctggccaggctttgctctttaatccagcaagaaacagttcgtttttaatagtgggggtgggggaaggaatcctgagtattagcccttcctacagtattaagcatggatatcattgttgataaatcaatcaatatctctgtgacttagtgccccgtttagataattgagaattggtttaaatcaatgctttctacgattattctcccttaaaaaatggttataacttttaacaacaacaaaaactggtatgtggattgcagctattcaaatttcctttaaaatctggtattccagatgtcacatttcgttagtgtgaatatgtatcactggagatgaatgttagctaaatttttaactttattttattatacaccacaattagctgattttattaaatatatgaggtaaaatagtatagaagattgaatttaatcttgagattatttttcattttatatctatacttaaaataacaaagctcgttcactaaatgtaatgcatgttagttcaatactttatgttttaccaattaatgtactcatttctgttcacatattgttattaaaaataagaaagaagaggaattaactcttaagatttatgattgttgccatgttttagaaactatgcttctgtcctttggtcaaaagcttaagctaattaagtttctagcctgactgctaatactgaactcagacacacgcctttgagcacgtgcgtgggtgcgcacacacatatactcacgcacacacgcacactctctctcagagtacaatctaccctaatacatcttgccatactttgcttatgagaagcttccagtcactccagataatgaggatttccagcaataagtggtttccaaagaaaaagataaccctttgttttctaaccaacatgacattgctagtgaattgtatttacctgttgggtttaaaactagatttcactgtctgataaaatacataggagcctttctgtcatctgaaaatcttgcataatggagagatttttggataattgtgcattatggtaaaattcttcagcaacaaagcaatatacaggtggtgtgacagtaattataaaaaaaatttcagttaagctaaattgcttagcagtgaatcaatgcatttgtatttgccaaaggatgaacatgcttcttggtgttataaaactgcaacattataattttatcaaagaaaagataagtgaaaatacaatttataattaaaatattactataatttgcattgcaagttagtatttgtcagattaaaatttaataaaatgttaggtatctcgtaaggtttaaaatacatattacctctagttaggttttattttagcttcttgtcaatgcatgtaacttattgattttatattttaaaatattatgtaacaataattcaaaaatcaatatatgcaaaatgaacaatgtaagatcctttttcatttagattttttctcttgaaattttcttgaaattatttgattacctgtttgtgtaaatacttgaagcctgtaagtatgcattttgatttctccaagtactttttactgatcactttgaggtcaaaatattgaatcaaatataagataaaaatgtaaatgagtaaaaaaaaagaaagggaaacaagaaaaaaggagggaagaagacatgaagacgacatttaagaacacttttctcctttgccatcctcttgaaaaattaacaagacttgcctgacgtactatatcgattttcaaatctcctctttgtgccaaatttccaagtggaagaaagtaacattcttgaaaattttaataggatattgtgttgtaaaatattgtttaaaagtcaaactagttgaatgaatcctgagctgtaataaataactcatctgattcatataggaactttaaaatgaaaaacatagagtacatataattcatatagacagttctgttaactataagcaagtaggtagttattttattaatttatattgggaacaaaatcatgattaatgtcatttaaccagcaagcatattaatttatcccacatctttcatctaaacaaatttgggtaggttttttgtttttttttaagaaactatttttattttattttaaaattaggctgttgtctttgcctatattattatacaacatgctacctcctactttgtagaccacatcatgactaaagctctccatatatattttttttttttgaagaaacagatgcttgctatgggctttgcaggcattgccattcagctcactcagtgttgtcttctgttcatagcctcagactgattagaggctctgttcagttaatcagatgacacagtggacaattttttaaattactgatggtgaatcttctatgagttatatcagctattcatgtgtatcagctcttggctaatattaagatgatgacagctttccgtttgttttaagtgtttaacctatctccactataatatttaaaacacatgagatgagacaaacattcttatatcagaatgatttatccagagtgcttaattgtgtagtttagtgagttctatgatttcttcctaggcttcttttagaccacacaaggattaaatgaggcatcgtgtaaatatttatagtcaagaaaaattgtccgtatgtttgtgggagataacctttctaatgcatatgaaaggaattataaatattttttcctggtcctaaggtgaacatgacaataaattcagcagcctgtgtgcttcagtgttttccaatattcactagataacctgctttttactgttgcttcgtcggtcatctgtctttgttttcctttgtttctgggccacctgagagtgtcattgccataaagccagtggtgtactgaataaatgagggattcaggcgtgaactaacaaacataaaagctatttttaatattatttctttctgctacagctcagaagaaacaaaaatagaatagacttgaaaaagtaaacagctttctaaaaagaaacaacaggaaatgaattagagaaaactatgaagaagtaacttgaaagtgaaagatatatggttcctaatctttccactctcacttattttagttgagtaactattttatgccaatatatttgagggggaaaaataagttgtgtaacactaacttcatagaataacaatatatacatacatgtacacacagtgtatgatcaaataagtttggtaaatgttacaattggaggatgtttcagcattttcaagcatgcaaacagatctgaatttctcagatttatgatcatgcatttttaaactcttgagaccacagattaatttccaccgatattcacactgttttgatttcactatttagaaaatgctgatcagttcttaattttctgtaactttgtaaattccaacattatttaagtttctatttcagagaagtttgtaagacatttgcaagcatactgaaagcagggaccttgtctggtcaccctggagtgtctggtgcaccctggtggagtgcgtataatggcccaggttgttttacaaagtgtgctatctccaagaatgtttcacattctaggtattgtactatattctgggagttaagaagatccttttttagaatttaaaattataccttatctagtgagaatagcagaaacacaaacacataattatgatacaaatattagtggtacaaattagatttgaataaaatccgattatataatgagagaacaaccaactctgcctgagggaacaggagagcattgtacagtaagtgaactgagtcttaactttcaccaggtgaagacaagaagaaagtgttatggaagagggtgtatgcaaagacatagagacataaacgaaacacttcatttgcaagaaacaatgagatggtcattaaaatgtactaggcaaacatttatctaaaggcaaagagatttgtatattgactttttattatggaacaatattctatcatattatcttctttaatgttgttttggctgcactagataatctgcattttcacatttaaaagtactatacttttttttttcttttgaggcggagtctctgtctctcaggctggagtgcagtggcacgatcttggctcattgcaacctctgcctcccttgctcaagtgattcccctgcctcagcctccggagaagctgggattacaggcatgcaccaccacgcacggctaattttttttttttttttctagtgaagacgaccgtttcaccatatttgccaggctagtcttaaactcctagtcttaagtgatcaacttgctttggcctcacaaagtgctgggattacaggcctgaaccaccatgccaggcctaaaaatactatgcttcttatctcctctttctccgtctacaagaattttgaggttgtattattttaaacaacaaaagtttgaatattgagattgtaatttttgaatctatttctcacagttccgtttgtggatatgaactcataggagattcttggtcaataagtgagatgttaaaatactctctgaagacccctaagtcagaatagagtcaaagccaagattaacaagtggtcttattaagcttcagtagatggatgcatttatattcactgtctaaatataatggctgagtgaattagatctccatatgaccatgtgaaaccacctgacctctgcataggggaaaaaaaaacattgttttgcttatgtaattttttagattttattcatattattagctcttcaattggcaactcttttttcaaacttatgaggaaaattattgacattggtcattaaacttgagacattctaggctctatttgaatggctgattgaactatatagagccatgggagtctcttctataatccggtcctctagatgaatcatttcttgtatgtatgtatgcattgactgattgtagctagaagttgagctgtgttgcttttatatgtttttgttcattattactttcagttttaacttagtattcaaagaccctgtctctaattcttagggcacttcatttgagatgcctttgaattgtatacaatctgtattcaagagttgtgctatacagcttggtttttttttttttaatttcccataaccttttcttagagatactgtgttccaagcagcaaatgacgtggatgtgcggatatcagtcatggaatagcatttattatatggaactggactgtcctctgtcccaatttaatctttgcaggtgctgtttaccttgtaggctagattttctctacatcaactttcacacattaaatgttagcagcactacagctgcctcccctagccaaattacatctttctacatgagctggaaaggcatggcttttaacttctcttggtggcttgcctgctggccgctggcaaatttccatttatgcatttctttgagtctcttaataatttagagtatcattattacatgtcataaatactacaagatttacttaggatgcttttcagaactccttaattttgggaaagcattgccggtctgataaattgaaaatttgtttccataatattacaattttaaaggaatctactggtaaaattgtaaagacctgaataccaacatttctaaaattctctcctacttatccttccctttccttcttcctcctcttccttctctttttttccttcttctgctctttccttttcttttcataatgtggtgtgcccttagtgtgggctgaactcctcttttgtctgcctctcttctctacttattattctgatcttgcttcctcaacagcccccttcttatggtcagttataaggaaataccttggttacttacaaaaaatattgcattgcaatttaaatatttttatgtattatttaataaccaaaaatgtttgcctgaagacatcagtaggttatcacagttgaggtcaatgactgagtttagaatttttgtatcaaaattacatgagatggtaactgtgggatatgcaaaaatatttggcaaggtgaataatatgttgataatcttttcatggcattatttctttggctaaagagaaaacaaaaacagaaagaaaaatctttaaaaacatttctaaaaaatatgtatcaaagttaaaatcatgctatgtaaaaggaacatatgatggaaggaatccaatagaagatattgacctggtgtagtgtctttaaattatgtattgacgtttcactggatataatggaatatatgttggcaggtaatcttaccactgacaaacctgatggtggttttaaaaattgtcaggtacataaagttattttctactggtagcatcttccttagtcactctgtatttgacatggaaaatctttcttacgctctgtgtgtttcatgtcaattgcaagaggaaatgaagaaaattaccaacagcatattgtagttggctttcagaaattttcctaatattaaaaataagattaatgagtataagaatgggaatattactcattttttggctccactgcacagattttgtattgagcaccagagacaactactgcacaaatatttatgccatgaatcactagaatagaaaattgttttgaacataatcacaaattttgacagagtgtatattgatgcagacttttggagggtaatttagtaatttatagtgaagaaaaaaacacaaacctcagtaaccaaattatactcatagccacttactagtcagactaacataatcagaatacagcagcagaagacaataagtcagatacaagaatgttcatcactgctttatttttgttattcacacatacaagaagaaaaaaactgaaatgccacaaatatgaaaatatctaaataaattatacagaatcataaaacattgaacatgaagacaagagacttagatgttggctaaaatgttaggtgtataaggaaaattaaaagagttccataattattagaaacatataaatacaatcaacctggaagaatatacttgaatgttttaaagagcttctttggagtggagactaaaatgcattattttatcagttttactgtcctgaatcttcagtagtgacattatattactttcagaattataaaaattttctctcaaagtgtttgaaataatgactggtaagtcacatatgaaatatggcatgagaacgtgactataatgaaaaataatggcattaatactcataactgtattatgctggcattgtcaataaacccttaaatagaaaagtcagatacatttaataagttgtgtttcttatttttaatttccaattttaaaatgaaatgttattgttcatgattattttaccacacaaaataatattgcctaaatgtatctgaggcactgttagcctgagcagcttgattttaaataatagtaagaaaaataaaacttcctattttcttcagtgcagaggaaataactttcaggacattgaattctaatgttaagtcaccataaaaaacttgacatttattattattaaagagaatttatgcacttaatagttacttgcaattttagttaccctcaatgatgttcctgaagactctttaaaaaataatgctttttaaagaaaatatatttacttatttaaaacaatttctattagacctagtcaaaaatatacagtgcactgttggatttgggtaaggtgttagtaatataagctaatgtaattaaatcctattatcctctttgtgtgatattaaatatacttgaatagtatgtatgtcagtgtgtatgtttttttatcttacttctcttatttctttgaatcactgatagttttagatgttttctgctgctcttttggaatacaggtagagcattcctaatccaaaagtctaaaatcgaaaatgctccaaaattcaaaattttttgagcaccaacatgatgcctaaagttgaaaattctacacataagtaattaacacaaacgttgtttcatgcaaaaaattattcaaatttacctccaggctatgtgtatatgatgaatgtaaaacataaataaaagtttgtgcttggacttgggtctcatccccaaaatagctcattgtgtacagtatatgcaaatattccaaaattcaaaatatccaaaatctgaagcacttctggtcccaagcatacacaacctatactaggtaatagggtggggttagcctgaaatttttctttcaattcaattcaattcagttccgttcacatctatgaaatattctaggctctacctaaatagtttgagatataatgataaaaagagaggcctcttaattcaactgtgcatgtttgtctgagtagaatatggaagcaattaatgaaatgtggaaagtgtgatggtaataacagtaaagattctgattgcttaaaagacatcagtgtatgaatgcttagtctttaacaggtggtcatggtagaatatctgttgtacacaacagatattactgtagttgcaaactcattttccagatttttctattttatgtaaccatctataaacattatagaattgttcttaaacatctagcatctctatgaatagattatggaccatgaatccgagtttcttattttactgttgcatgttttaagtaatatatacttatttgtcatagtatgttaaacagttaaaataatttgtaatctcgatcatcaaggttcctgtattttaaaagttgaggagaataaagaaccaatcaaatcaagtgacaccattctggcagtattttaaccaaagtgtttttttaggaagtatgctgcatccaatgccttaaattttacagtcatttaaaaaaaaaaaacatgtgaatcaaagtttatttccatctttgcaatttttatgaaaggatagttcagttttaagtcaacacagtattttaagtccatttaaaaaagacaatgagtaaaaacaccaatgtttaatttctatgagtggggaatatcgatttgaggattaaatttttccttaattcttctagtagaaaacagagtagagaatctatgggtagaatatctgtccattatttgcacatagaatcatttctaatgagtacaaaggtacaattaggagaaataagttctgatacactattgcaccgtagagtgactataggtaataatgtattgaatattatgctcactacaaagaaatgataaatgtttcagttgatggatatgctaattatcttgatttgatcattatactaaatgtgcatgaaacgtcatattgtaccccataaatatatacaattattatgtggcagttaaaatttaaaaaaattataatataaaaaataaaatctcccaaactgtttagattaatgtcttgatttatatttaaatatgaaccttcagcaaaatagtgaaaatttccatctttactaaataactaaaagttccagtgtttttctttcatatatgtgttgtacacacttaggggaagacaataaaatcaactgaatcccttcgaatggacctgagggataattttacacagtgtctttatgtttgcgtgccatttactaacagtatattgttggttcaaaacaaaccacacacacacacacccacacacatacacacacacacacgagttacccattgcattagtaggaaacaaatggcaaatggctgaagggatcagtacttcaacttcggaggtccccaaacacaataaagctttatttggaacttgtaagacttcaactagaaccaaatagaatccatttttttctgaagagagttgatagctaagtaagattatagacaaagtacattcagagtgtatgtttgcaatgactgtgctatttctaaaaaatttaaatctatgcatatggagtctttacatacttatggatggataatatcttgattgtctaaatttttaggctcagtatacatgtattgatttaaaaattaatgattaattaaagaaaaagacaaaaaagtagagactcacaaaactaaattattctttctcagagaaatatcgttttaaaccatccttctacattctggatttattagttaactaactaggtttggctaaaacaaatgttcctcatggataatttataggtagtattctgtccaacttttgtgatatctccttgtgggacattgattactgttccacattattgaactctcttctagctattcaaaacccaacaaattatcgttaagtatgtgatggagaaaagtatatctatattttccagtctccttgcttctttcttacgagggtaggttctagagatcaaagtgtgtctttttctgggagccagttgttgagtgtgctctgtaagaatggaagcattaagggatagctatttcctgccagagaaagacaaagagaagctgggaaggaagatctagaaagtgggaccagagggaagcagattttctaggcttcgccaggggaactttggtgttatcggaaatgtgtaatttaaatttattaccaagtcactctgtggtgtgtgatgcaaaacctctctgcatccaaagattatccaggaaagccatatttctgaatattgattcaataaagttctgcatcttccacggatgacagagtgaacaatggaagctgtacagacagatacattttcatctaaaagaatgattttgtgaaatgtgtataaggaataagaaaaagtcataataaattaaaatatttgattggagtatttatactgacatattttaagttttatgttccacaagtggtttctaaacagttttttaaagataattaaacaatagctataacatatacttcagattgaaaataattaccttatcacctgaagaatcaagtctaaattcaaactctctcaaaccaatttaatgtaagatacatacaggaaatcatctattggatttatccatttgttttcttttttacttgaaaacaaatgtttattcaatggttaaaaacattttcactttaatagttttatcaaatactgtagaattgatctcccaccaaagaaacaattttttttttctcttggaagtttttttcttgtctctttggtgttatttattttgtttatgttgtgtttttgtaactgtttaggtctagctcaagtagcagtgatccaagaaaatattgctttgtcagcaccaataatgtgtgtcatgctgataaccccatgaaatctcttttacttaaagtaatggttacaacgatttgaacgacagagaatgcatgaacatcatctacaaatgcattctcagagcatgatctaaaagctaaatattgacttggaaatagatataaagctttttcaagttcgtatttttatagtctcaaattttctttcaacttccatctgagattttcagcaattggatagtgaagagttatgtctaaaactgtacaggtgcagaaccaattctattacaggagatttttatccaagcctgtgtgctttattcaatgacttttgtattctggagtggatgagatgctttgtgtttattttatgtttgagaaacatgttaattgtgtagctctgtcactgttttagacaatttggacaattttgcataagaattaaagttacatggtgaattaatcattgaaaatgtaaaaactgaacattctattcaattacacaacccaaacataaaaataaaatgggcaatacttccaaatgttttatagtgtagttaaagtgtgtcttattaaacattcttcaactttcatatgatttatgcaatttaaagttttgttgctacactgagcctctgtgtgaaattagagtgtcactttcattgtacttatactccctaaatacagtagtacgtacagtggcttaacagactagaggagtgtggacaatagcatgtagtgacttttagttggctaaataggttctaattagagtttagtttagacaattacaataatcacaaatatacaaaataaatctaggtcagacctattcagaccattccgaacattagttctttattttataaacaactaaaaatgttcatttgaaatagaaatgtaatgaaaaaccattaattttgaagccacaataaataatgatttttattaatatgtggattatgaaggatttcaacctaatttttaaaacaaagtaattgtccagtagcctataatcattaaacaaatttttgatttgtttgtttatagaaaagaaatagggagagttttttctctttccagtcatgtattccttccaattattggacaagtcgactttaattgctatgcttgcaaattcactggagagatgagaaatgctttttcttttaataaatggatattaaatgaagattttcagtaaaaaaacattaatttttgtcttgtattagtatataaatgaatataaaaatattttctgaatttaatccaatcaatattatatttctaattcattttagatggataggtagaaattactaaatcttgtacgtctttaaaactatgtaagaaatggaaaatgacttgattttgctaagtaatctttgtttatagttttagaggtaattatacttcagattttttctttattatgcataataaaatgcaaccttgattgttaccattatcctcaaatgtcaaattattctattctaaacatttagattttctttatttcaatttaacttgtattttttctttatattttaaaattttaatctaaaactctacataaatatttttgaaatgtgtcatgaataattttgcacatttctggggggtttctattttacattgaaggtttgagaaatctctaaagaaattgaaggtggtaattgttatagagaaatgattcaatgataagaggactgaggaaagatgaatgagtaattattctcttgtcctctttgtcttaaatccaacatctcctttcatctttagtacacttgccttggttgagatatgtactactacacttgccatttccctgctttcaaatactccctgtgaatgggaaatttggcaatttcttctctgtaaaaggccagagagtgaatattttggactttatggatcataaagtctcttttacagctactcacctctgccactgtagcataaaagtagccacagacaatacataagtgaatgtgctccaataaaagtttctttatgcacatcgaaactttcacctgccatgaaatattctatcctttaatttttccaaccatttaaaaacgctacaacttttcttgacttttgagtcatgtgtaaatctggcctgtgacctgtatttgtatggctcatgaaacacacacagtaaagtttgataagcagtgatctatacaatttaaaaattattcattattaagccagtatgtatataaatatattattttaaaatacaactacacatactcctacatccctcattaaattgttattacggctttattaaaatataattcatatattatagaattcacctatttaatatatacaattctgttgtttttagtggattcacagaattgtgcacccatcactacaatcaatcttagaacattttcatcaccataaaaagaaatcccataacgatgaacagtcattctccatttctcctcatgctcccctaaccctaggcaaccactggttactggtttctgtttatttgtctattacagacatttcatataaatggaatgtacacaatgtcagcttttataactgactcctttcacttagcataatgctatcaattatgctttcagttaatcagtattgtggcatgtatcagtattgcatttcattatattgctgaataatattcctttgtatgaatatgctacattttaattattcattcatcagattatggacatgtgaattgtttctactttttgactagaatgaatgatgccactataaacattcatgtacaagtttttgtgtgtacatatgttttcatttctcttagatatatccctgagagtaaaatttctgggtcatacagaaatatgccacatttcttttcttagtgatttctaatttcttcccattgtgctcttagaacatacttagtgtgatttcagttcttttaaacatactgagatttgttttatggtccagcatatggttgtattctgtagaatgttccatgtgaacttgagaagaacaataagtgctgagagaccaaggaaatatatctgtgttcactaacacatgtatatacatatatccgtaaatatttttacatggaaccatctgtatctatgttaagctaaatgtgagttcctgcttctgtttccatagatcatttattatcacatggatcattcgatccccttcccttgcttatctgtaaccttctgctcagaagaacaatgggaaatccacctcccaccatccaccacccattgcttgtttaatcccagtacacatgtacagtggtttagcattgttaatgtactcttgtataaaacaactttatcgattagattcagcacatatgcattgttacttctgtctttagtcttacagtcttcattcatttgcaaatctacttaattcagcacccaaccctccacccacttcactgagtttgtttcatttatttgtaatgtgtattagtccattatcacgctgctatgaagaaacacctgagactgggtaatttataaaggaaagaggtttaattgactcacagttctaaatggctagggaggcctcaggaaacttacaatcatagcagaaggggaagtaaacatgttcttttcacatggcagcaggagagggaagtgccaagcaaagggggaaaagcctcttctaaaaccatcagctctcctgagaacttactcactttcatcagaacagcatggtggtaactgcccccgtgattcaaccacctcccactgggtccctcccaggacacgtggggattatgggaactacaattcaagatgagatttgggtggggacagagtcaaaccatagcataatgcaattagattatttgctcccattctgcattccatcttaaatatacatactttccactgaaattcatctggcaactactgatttgtacaaaaaggaagcctacttagaaaaggcaaatgctgagcttttgttgatttaacttcatatttataaaaaccactggttttgattgctttttatagctaaataacagtcactgttggtgaactttaaacctagttataatcataaaggttacttcccagtaaaaatgcttcacctggccgggtgcggtggctcacacctgtaatcccagcaatgctgggaggccaaggcgggcggatcacgaggtcaggagatcgataccatcttggctaacatggtgaaaccctgtctctactaaaaatacaaaaaattagccgggcatgatggtgggtgcctgtagtcccagctactcaggaggctgaggcaggagaatggcttgaacccgggaggtggagcttgcagtgatccgagatagtgccactgcagttcggcctgggtgacagagcgagactctgtctcaaaaaaaaaaaaaaaaaagcttcaccttacagatgcagaaactaagatgcatagcgttgcataaagtaaattatccatatctctagaaagaatgttctttcctccattctttcccatgttctatcagatgcaattattgtcataaatataacggttatattctctaatcatattgccttcaggacttaaaatattctaacgtacttaaagttagtaaaaggaggaaaacaactttgaaataagcaagtatttaactccccagtaggttttaatgcgtatttcactttagaataagggtgaattagtgcagggagaactttgatttctgtgtttggcatttatccaggagattccctgaagtatagcctgactcattgctggtaagaatacttctcctaaggaaagctctaatcttgccaatttgtatggtgccagggaactctaaatagtcctgcatttcagcatgtacttatttaggctttctgtttaaatgtaaggtttaataaaatgtatctccatagactgtatccatcatccatgacgtagctctatctgggcctcattaattaatcttcagcacagtcatgtcatatgtaatattactcaacatctatcttggttcgaaactatttaaacagcatcactttagagcaactgactgtgcttatgtttttactgagtctcaccttttgctaaacaaggtgaaaacagaagtgaattttccttgccctgacaggtccacagggcaaaataatatggctcttccagtgtaaaagggatcaagaactccataaatcacctgaaggaagtcaactgcatttctagaattccagcccttttgtaggcagaccttgcaatgaatacggtttcttggtttagtactcttattctccctttctctttgtgtgtgtgtgctttgtgcatagatgtgtgtgcacacgactgtcctcctcactacctgcaacgaaaggaaattatttagttaattaggtaatttactgcataaccggaataggagtgatataccaggaattattgaaagcatcataatttttattccagtctttatttaaaaattgaaacccctcttacatgtcttttttccctcaccctcctatccacctaaccaagaattcttttcattgctttgtgaggttttgttctggctacttctttcaaattcccatagtcagcactattttatgtcttcatctcatatttttgactcattgttcagtggaatccaaactgagctctccaaaaagggttttcctgtctgcaacctccgcaatctttatttatttgtgcatttaatgtttatttagtgcactgtgccatccacttggaaaggtatacaaatgtttcttgagtctcagcttctgctatgtaaaagagtaattgcaagatagcgtaatgggcactccataacataataaatatactccctgcactgaatgcctactatattttcttcctttaaatctttgctcaagttatcattattaaattgaaaagacctcttttcctacttagcttattaaaatccaacacagccatcctttaaagttaactattaatgttgccctattccgtgcaatcttcagtgacaatccaaatcagaacagtactcttaaacttcaatattacttaattttggtacccctgtatttcatatttcacaattcttcaaaattgtatcaaatgtataataatgatatgttaggcactttacatatattatctcatatttgtagcttcagtataacaaatatggaatcagaaagtctttagtctatatcttgtttctggcaagtccattaaccattacttatctatcaaattagacttatggttcctcatgatgttgttttgaggacaaacgagtttatgcatgatcctataaaaagcactcaaaattattattgttattattaatattattaccatcttagagagtactaaactgatgcccaaaaggtgcagtgaactgaacaagatcataccaataacaaacagtagattcaggtctctgattccaaggcacactgcttttaaataccacactatgttgactactggacaccttttttttattattaactaaaggtttggtggtagaactttatattgcaggcactgggcagacattagctgcatcttaaagcaaaaacactttgtatgccctgtatgctttggtttgtgtaatattgcacacccaaaaatggcatctacatctatctgaatcaagtagttttgactttgaacaggtaaagtgtggttgtcagcagggcctggatagcagatatgctttcagtgattcaccaaaggttggagaaccaagaaagatgagaagtaccaaagaataattaaccaagaaagatgagaagtatcaaagaaaaccaagaaagatgagaagtatcaatgaaaaaaaaatgactggattcaacaccagtttctcatagtcttcttgaaaaggactttcagaagtttttacatttgctgaggagagctttacttccaactatgtggtcaattttggaataagtgcgatgtggtgctgagaagaatgtatattctgttgatttggggtggagagttctgtagatgtctattaggtctgcttggtgcagagctgagttcaattcctggatatttttattaactttctgtctcgttgatctgtctaatgttgacagtggggtgttaaagtctcctattattattgtgtgggagtctaagtctctttgtaggtctctaaggacttgctttataaatctgggtgctcctgtattgggtgcatatatatttaggatagttagctcttcttgtggaatttaccattatgtaatggccttctttgtctcttttgatctttgttggtttaaagtctgttttatcagagactaggattacaacccctgcctttttttgttttccatttgcttggtagatctttctccatccctttattttgagcctttgtgtgtctctgaacgtgagatggatctcctgaatacagcacactgatgggtcttgactctttatccaatttaccagtctgagaagttttttaagtatatatataatatatacttacatatatatatataatatattatatgttatatattatatatattttaatgaaagaaggggtattttcttattttataaaaaagtgaaagtagaaattttccctgccaatttgctggacagaatgcacttacccagtcaaaaatctagttgaataataattataactgtctagtctttacgaaacaaaaataagtccactaccaaaagatattttacaaataaatgggtgagtccactgccactgttttttttttctggtttgagaattccttaaatgaaggacgtgaacagccattaagagccaaagccacctcttatgaagtccagacatacagaacctgtagttcacgaaattatttcccttcctcctcattgtacgttcattccttttgttctcatgagatcactccaccatttcagattttaagcactggacattacccacttgtatctttttgccctctttttactgaggccataatattttcattcccagtgaaatattgccattaccttgaaacatttagatattcctttttaaaggatatctcctacattttcatgaaaatttaaaaatgccgaagagccctgttatggactgagtgtattccccaccgccatttgttgaagccctaatccccaatgtgatgatattaggagatggggtctttgggaggtgattttatttagatgaggtcacgagggtggggcctccatggtaggattagtgttcttataaatataggaaaaaacaccaaagtttattctctccaccacgtgaggacacagagagaagacatctttctgcaagccagaaagaaggccctcactaagaactgaatctgctccgactttgaccttggacttcctggcttccagaactgtgagaaataaacgtctgttgtttaagccacacagtctatggtgttctgctacggcagcctgagctaagatatgccctcttgcctatctgaacagagctctggtcccttctcccggttttactgtcagtgttctgaggaagaggagcatttatcaacaaacatttgcagagctctcagtgtcatttttagtctacacagtaagactttctatttttatgattctgcatgcaataatatctgttaataaaagaaggggtattttcttattttataaaaaagtgaaagtagaaattttccctgccaatttgcaggtcagagtgtacttacccagtcaaaaatctaattgaacaagttaggtaatggttttctaaataacttgggtaatatttttctttcagttaatattcactgccaatagcattaagttgtttatggaaggcaggtgtggtggcccttgcctgtaatcccagcattttgggaggccaaagcaggaggaccacttgaggccgggagttagagaccagcctggacaacatagggagactctgtccctttaaaaatttttaaaaattagctggacatggtgttcctcacctgtgaccccagctcctcaggagggtagtgtgggagaattgcttgagcctggaaggttgaggctgcagtgagccatgatcatgccactgcactcctgcctgggtgacaaagtgagaccctgtctgaaaacaaaaaaagatatttatggaaataaaactgctttagaaatgaaatttcagtggtggataaatttttgtcaaagtaaacattgttttctcagaaaacagctttatggaaaaacatcaatttcaatgtctgttcttttgggaacaaacagatagtcattttgaaaaatgacaatttttgatactctaaaagaaataagaaggaatatcggtgaagtatcctcttaaaaaatatcacatttagatgtgctaacccaacatcctttgcacctccagaaaaaaaaatgattactgaaacaaaacagttcttttcattgtatggaaactgcttcaaatttattttaaatcataaactacatatgttcaagctgaattcatgtatagtattgctcactaataacataactccagtattaattcaaaattagttctgacaatttttctcctttttaagccattttaattgtgttctcattatcccccaaaaaattatttttagtgtggcttgtcatgtcctctataatacagaataagtcatgtctaatgtcatgccaacagatttttctcttcaaattaaataaaaagaagatactaggcattatctcactgaaaaatacaaacatgaaatgattcgtattatgcaaatataagtattaatctgacaactgcaggaaaggaactttagtaattgttttatttaaatgactaatatgggaaactcagattataatctataaaatatggagttatttttatttcagtatccaatagaaaacttatgtacttaaacttaagttatgagataatgaattctaaatgttgtaagtttagagttttagtagactgtattattttccttttttattatttcctccttgatttgaaaattcaggaaattatccccctttttataatttctaaatgatttggtttttattctttgatagaattgttacattggattttaaatgtcatttatatcatttgttctactcgtttaatttcatatttctttctctaaagaaaagcttttccaattcattctctttagatagagatagatagatagatcaataaataaagacagataaaatgtagatatgcatgcctacatgacctccagtactttcagacaataacattaacctttttggactgctaattttgtctcaggcactggcacaaaagtacattacacgtattacctcattaaatcattgcaacaactcttagaagctcttttttaaaatacatttttcaatctgccaaatggaaggctagtaacttgcctgtagtcccactgctattaagtggcagttttaatgcaggtctctttgactatgctatatgtgtctcatagatatgggttctattctataaaataacaattttctgtaatttaacaaaaatactatagttcatcttatacaggaatttagagttatgcaattgcaaatgcatgaaagtgataattgaatattttagaagctgacaacttcgcaattatctatgcatttgctacatgggtgtcttctgtatatacatgtatgtgttttagatatataattgtttcccatctaagaattccttctcaagcccaatgtaatacacttattattctatatttgcttctaaattttttttaattttcttattcatatatacaatatttatgcatgggaactgattctttgtatggtgtgagtttggagtaaaacttgttctttgtttttttccatatgaatagccagtattctcagtggtccctcactccatttaaaatcccagctctgtcatgtataagcactccacaaaggagtatgccagcagatgagctccctaatagtttccactcgttcctttatctatcgttgcatcaaaacaacatattcttaattccaatacttttattataagtcttcataccataggcaaaacttcctcattcttctttagcatctgctatgatcatcttggataaattatataagacataaaattattcacaaggaatattccactttgattttataaagacttttgaacgttaggctcacttctgctttctggctgtgatattgtctggttaactcagtctcactcatgtcttctcttcccttaagcaagtttccttcatttaggcttttctcctcaggctatatcaatgtgcttccctgtgtctcagtgcaccttcattctttagcacctgttaagattttagctttgtaaagttgcacaagagatcttataagggttttggttaaaattgcatttatagattggtatgaggggaacgaatgtgaatcaccgtacgttgtgcatgtatctcttcatttccttagatctttcaaaaaatttatattttcttcataatagtcttaatagtttttcttatatttatttccaagctttatattatcactttcattgtcattgtaaaacttataattttctcttacattttctgtatctttgttgctggtagacaggaaagcaattgctttctgcatattcatgttacggttgactaacttcctgaaatctctgtaattctaataattttcaagggattcactttttatgtagacaatataatttccataaacaattatggtttggggtgttttaaaaaaccttttcaacccctagatttttaaaaaaaattttctaggttaatgaacttgctatgaatttttactactcagttgaatatatatatgtgattcatatatatatgtgattcatgtatatatatgataatggacattatcatcatgtttctgatttttaagagtattacttctaatattttattattaagtgtctttacttaggctataaaaatataataccttaagttttcaggtttccaaacagaaaagaaaatgatttataggagtcccaaatttcattatgaaactgtggatttcagaaaataaaaaaatatctacagagttctgagtcacaggagatgttatgcaaaaaatatcatacttggccaaattatcagccaaataccaacgtaacaagtataacttcctaaaaatgaatggtctttgtaattataacagctaaaaagaactcttgaaaaccaattatgaaatccagaattctgccaaaaaagtaaatagagagacatagggagaagactagtgccagattcaatgtccacataattagcacactgtctacaaggtcccgtataatcaggcatttaccaagaactttaatccagccaaatagtccctgagtataaagaaagcatatggtcttgttcttcaaggatataagaaaggactcaaaggatcacatctacaagcccttcttgaaacacttaaggtggcagtaaaatcaggttccactgatacacgtataattacctcagaaatgcagaatctgtggtaaaaatgacttggtacatattaaatccagtaatattcagataatttactctagtatgagtagaatgcaaggtaaatactgtagaatttgctctgtaaaaatatgactgataaaacataaactgctaaacatatattgttaaaactgcaaagtaaaagggaatgctttgtacttatcaagtatagtttttattaagtatatcttatctttatgaaattaattctgaatatccatttagccatgtatataaacaaataatatataattttggttattttaataatcatagttatttctggttgacaaaatgtttgtgaatatctttctatcttttctaaacttctgtatgtttgaatttttattcttggtctaaacatcatcactttaataaaaattgttacatattttcaattattaagtttaaacaatgaaagatagagatacaccctgtgtagtcacatgtattgatatatccacaatatatcacaagattttttgttttaaagggacttttaacagcgatttagttcacctgcttcattttacaagagagaattagaaagtctaagttgtttggtaaactggccaatatcatgtagctggttagtgactgaaagaacaagggctcaattgaatattttcttgaattaaattaatcaaaattatcatacagacacaagaatgttcacattaacatacacgacagaagatttatcattattattattattattattattattattttataaaatagacacgaggtcttgctatgttgaccgggtcggtctgaaactcctggcctcaagcagtcctcccacctcagcctcccaaggtgctgggattataagcgtgagccacctcatccggccaatacagaagttttaaaccctattcaagtaagacataaaattattcacaaggaatattccactttgattttataaagacttttgaaccttgagctcacttctgccttctggctctgatattgcctggttaactcagtctcactcatgtcttctcttccctttaagtagagttccttcattcaggcttttttccgcgggctatgtcaggtgcttctctttgtctcagtgcacactgagaatatcattatcacggccctttcttcagtgagttggatttatttatttgtatgctggtctgccccaccagactgccagttccttcaagctggaatcctttcattctcatatttgccagtgcctagcacagtggaaaacattgtttcatgtgtacatttatttaactgattgaattgcatttagcaatctatacactcaactaattattgagcacttattatgagaaagacatattgaggagagctggattattcctttgtttctagacgagttggtgaattttacacaaatatgcaaacttctacttcagttccaattttaaggttttgaataaggaatcatttatgatctttgcctagcaaacatatttcaaaggtatcatcaataggtacctggccaaaattccagtaaaatctctttttcagaggacattctttctgtttttatatgatttttataacactatgtcttaaaagtatattgacataacagtccaacatgtctaagatgtatcagaaatatggtttccagtaaaaataagctccttagaaagcttttagtattgctgttcttttctagaagaatgattgaaggatttttaaaaaggacttgtatccaagcagagatttaaaataaaactgtcatgttcaatttgatgctttatgattgtgacatgcaaaaaatattgtaaagttacagggctatcattattttattgaaatctaaggtaaataggctcttttctcatgtatctatcttcttgttcagaacaactgcattttgagaatagaaatgttatgctgaaatatgagaacttacatgaaaggtaaatatgaaaagagtgagaagaaaaataagtcttagagcaagccctgtagtattttgaatactagggagaccgcttgaggtctaaattttagtgtctttttttaaagcatgctattcattgttaatatttttttccaataagaataatttaaaagtttgggtgccttagatgatccatttctcctttttttttcccctctgagacagggtcttgctctgttacccgggctggagtgcagtgatgtgaacacaactccctgcagccttgacctcctgggctcaagcgatcctctacctcagcctccaaagtagctgggactacaggcatccaccaccatgcccagctaacttttgcatttttggtagagataggagtctcactatattgcccatgctggcctccaactcctaggctcaagcaatctgagcatctaggcctcccaaagtgctactatcacagctgtgagctaccgcctccatttctctttactacaccaacctttctattcccactgccttgctcaccaggatatttcctctctagttactctggtcacctctctgattgtcttcctgagaatctcatcccttcatttccctttaaatgtcaaccttcctcctcctcccttcttcttggatccctttttcctctccagccttccctgcaaatactgcccttgatcctcctaggctattggatggtttatctaagtctcagttgctctctgtttcttcatctgtaacgtggaaataataggagtagctttcacacagagcagatgtgagaattgagggacagagtgcttggatatgctctttcaaacataaacagaagtcgtgtaatgagtatcagctgttattataatagaagcaaggtcaactaagagacatccctgccttaggctttttcttatcaaactacactacagcaccagagttaaccatcctgaaatacaaacatgatcatgaattcttcattggttgtcaatataaatttaaaaaaacaacacctcacatacctctgtcaagcatttaatctgtcgttcatcaaatttagtatttattaccagataggcaaatcactagcacatgattcgtgaattgcgaagtttgtctcctttcattttggtagattctgcccctgaattctgtagtggaaacttatttttcttaaattcatttttttgtagttctagagtttttttgtgaagataaaaaaaagtgaccatacatttttaattatttttctttctcatacaaaaacagctttttttttttttttccacatatagtgatcctcctgccttagcctccaaagtagctgggactacaggcacagggactccaggatatacgtatatatcctccaggagatacatatgtatcctggatagattgtcatgtcagcatatagaaagctttcttattccagtaagtgcatgtaccattgtttatttaataaattcattattaatggctaattttattttgcaggttttgctatatgaacaattctataatacagaacttatgcacgtaacattgttatggatgcagatgtatctaagatgtacattttagaatgtgggaatgatggttcaaagtcacatgtatgcaattttgatatatatatttttcaaatgaaatatgtattagtttgttctctcagtactataaataaatacccgggactgggaaagaggtataattgacacaattctgcatggctggggagacctcaggaaatttacaatcatggcagtaggtgaaggggaaggaggcagcatctttcacaaggcggcaggagggagaaagaatgcatgtgttggaggaactgtcaaatgctgtcaaatgcttataaaaccatcatgtctcctgagaacagcatgggggaaactgcccccaggatccaatcacctcccaccagggcctgccatcaacatgtggggattatggggattacagttcaagatgagatttgggtgggaacacagaacctaaccatatcaatgtttgttatacttcctgcattgattagagatgccacctttatcatcatatcctctttctagattttctttgctttcctattctgattactcatctgccattgccatactgttttaattattgaggcattatgttttaatatatatttggtctcccccaccattgtatttatttttctgagttttactggctatttcttattttaccacaagttaaataatgtgtctagttcccagggactgatttactattcattgcaatcaaaatttaactaatatgggagaatttaccatttgtccacaatcttggtggatccttgtattaagtcataatctatttcctccataaatgccttctaatgaccctttggtgggtttcaacattctcttaagtgtatttctcgacgtcttcacatttatgtggccattgtaaatgaagttttttcttccatcatagtttttcaatgattacggtatgtatattcaaaattatagacttttgataattaattttattaacacttatcttagtgaaattaattaccttatgctttgttatagattcaagttgattctattgggcttttaaatatataggcatttcacctaaagttattttagctcttactttgtaatatttctctctttcatttctttctcttttgtaattgcattggttaacatttctactaccacacaaatcatagttctgttaaagaatctttgttgttttcctcattggcagaaattcgccattaagtttaatgctaattcttgcactaatttgagtgggggaggaagaaaagagtgtgtatgttatcctactagcatatattataatacataaaatgcatatcataacacttttctgaacctacttactagtatgtttaattgttcctttgtttccccaaactgtttgctccttgaaggcaactatgagttttattttacccaaatataactatgatgttcccccattgtcaacatgtacttactgtataattagaattgtaagttaagccactaaaattgcagactactgtaatttgctctcatgctctggaataattcctaagtagaaatatgtacttgcttgtgatggggaaattgatgccttattcataatggcttaatatataagccttaaagcaaggaagcagcagtgggtgggatctgtgcattgatgatgtatgtatattatccacaaagactgagtgcattattatatattttaaaaacccaaccatttccaatcatttatgagagatattttattggagataggtatgaaagtgttattaatgtatataattgcatgtatctaggtttgaaataatcgatactggtcctttattaatcttaggcatgagtttatgccttccatgaatatatactgagccatgaagggaatacattgtgccagaagctgtttgacatacaaagttttaccttccacaaccatgcactctcacaggagaaatgaaacttctatatgctgatttacaaaaacagaagagtatgataatggtcatgtttgtggcaaatagagcataggagaatggaacctgtaggcattacaatgaacaggaaagcttgatttgccaaacaattccttccttgaaaactctgtattgataggaaaaagtaatcaatttggccagatgtcaggatacctggaaagcacaaagaaagagagctatctgtgacagactctgtctcataaataagtaaataaataattttaaaaagaaagggagttgacaagtagttgtgagtccctagagcttagtttgagtaaaaagaagtggaagttagtctgaaaaggcagaatggagatggtgtggatggccttgtgtgtgggatttaggcagttagaatttacctgctagacaactggatgctctcaaaggtgccatgaaattacaaaagcattagtatgattatttttattgtggtttatagaacagtttggagaagaagagaaggattaaataggaaaccaacttagcaaacttaacaataatttagtattatgccaaactttaagctacttcgcttttctgcctgaccgacccattttgtaagcaggaataatgatattgcctgccttgatggatttgggtgtggcttaaactatgttaatgtttgtaagtcactttacaatggtgggaaacagaagaaattaagatgttagttattattactgaaagtcaagattgttgctgctaccctatgaaagtgatgaccaaaatgttgacccaagagaaaaagataagttaagccataaaattaaaataatattaaaacaaatctagaacccctccaagtccagttacgtagcgctacacgaaaagctggtacattttacacagcagctaacattaaatttaggagaacaataaaaatgaaaatataaagtaggaaagaaacaccatgtactttttgcagtttcagagattgatttttttttctgagtaaaaacgcttgcttaagacgtttcatttcaagggagctttgtacatttgaaatcagtcattcttgaagttatttcttccatgggctttcgagcctctgaagctttcatgactcgttcatgcaatgaggtgaaaagcttctgttcatacaccgagcgtggattagttcctaaggctgcaaggtgccatggtctcaaacatcatttagttgagatcttgacatttcttttacttttgattttaaaacatacttattattgcagtcgatttgtcttcttctaatgaaaggatagaaagattgtccaaaggggtattttcaaaggagtctgctttgggacaaaaatctattgataactaagtacatgaagtagagggttcttcactggtttaatcccaagcagaccccgtaatggccttagattccttaggtcttagaaggaggaaagtaagttgtaaaccctttttctttctttacactcctttcaatttacttttattttcggctgtcacttgggctttcagacatgaaaaattgcaactgtgctgaaattttcagtgtgccagaataaatggtgattctccttcatgactggtttccagtttgagaacaaggactttcttttagggagtttggatacacttcactctcaggcaggtgaacagagaacaagtgagaagcgataagtatgaggaaagatagagaagacctttcccacacaaaggtgacttcacaaagaaacaaggatgaaggaaacagacaaacatatacaacctctcatttcaactacatctctattttctccattctttttttcccccaagtccaagttctcattcttgaagaaagccaacctgttttccttggtggtgtaagttttcccaacttttaaaccaatacattaatatcttgcttaaggctcaagtgtataatgtatgagggagtataattttgtaattctaaatccaagccctgaagctagactttcagggcttgatttttgtatctccgttactaccttttaaaaaaatatttctgcaccttgatttcttcatgtgaaacaaaatgataataatgtagcctaattatgttgttttgtggatgagattaatttcaaagacaacaaagaacaaatgataagggaaaacattataaagcatgtacatttttaaaataagggaatttcaggtaagaaataatgcaagcaaagaaatggaagcaaatatattgaaggggtaatgatgactaaaccagtccaatttgaggaaaggatttaatagagaaagggacaaatgttccacatgattttggggttagttcatgacagttcttgcggggctgaggtgggtggatcaggaggtcaggagtttgagaccagcctggccaacatagtgaaaccctgtctctactaaaaaaaaaaaaaatcagccaggtgtggtggcgtgcatctgtaatcacagctatgtgggaggctgaggcaggagaatcacttgaaccctggaggtaaaggttgcagtgagctgagatcgagccattgcactccagcctgggtgacagggcaagactccatctcagaaaaacaaaacaaaacaaaaaaacttgtccagaaactcagtgctgtagatatcaatgttatattatccatgcgttagtgatgctttcatacatttttcaagggagaaactgtacacaaggaataaaaggtaatgaggaatgatcaaatttaggaaaacgaagttaaaaagaggagtgaatgaagaaaataatgggaaagcagtcagtaaaggaggagaaccacataatgaaaacactcaacaaatgtaaaacaaaaatactgtggtcatgaatgtcacaagttccaaaattagcaggaagtgcctatcagaagcattgagaagttttaaagagaatatagttgtgctcaggccacagtttcaaaccatacagttagaaccttcaggaactgggtcttggcatgatcaaaccctatgctaactggatccataaaataaaaacaaactgaactgctcgtacatagaaatacggtttttatatattactgactttcacctctatggctgattgattaaaataaaacatgaatttcagaagcataactttatatagaggcaaaaatattttgatttaaaaaaaaattacaacccgccaggtgcgatggcacacgcctgtaatcctagcactttaggaggctgaggcgggcggatcactaggtcaggagctcgagaccatcctggctaacatggtgaaaccccatctctacaaaaaattagctgggtgtagtggtgcacgtctgtaatcccagctactcaggaggctgaggcaggagaatcacttgaacccgggggtggaggttgcagtgagccgagattgcgccactgcactccagcctgggtgacagagcgagacaccataaaaaaaaaaaaattacaacccatgatatcagaaaacatggctttttcctagagttcttgagcaaaaacaaaggactatttattccgcatcatttcagttttgagctctctgaaagctgggaacttgaagggtgtaattttaagtatccttccagtgttgtgattgtttccaaaaatttccttctgcttggggtactgctgggcaggtgtactctacaactagttttcattcttattgtaatgatgacagtttcacactgttgacctaaaacttgctgctgtttaggaaacttcatttctgtctgtaaatttaagccatgtgtgtattttctcctggtatttcattgatgatctggtaacaaaatcagcagagatcactatttctcttcagtgaaataccaaaaaaaaaaaaaaaaagaaaagaaaaaacacttgacctcctcaaaaattgccactacttagaattttagaaccatcatttgcccattatgaattttacagttgttttcctggattattaatatgaagagaaagctaaataatagaactggaaaagactactacattcattttggtcttttccactatacgaaataagataaattgagatatacatattgctctttaagcatttttttctagtatttcagtatactgtaaatagatggcagtattcacattttggattatataattgcaaatgatgaaatttttaagctacaaagttggtaagtacattctcttataaaaatgagcttatgctctaaaagaaactaaacctagaattttaaaaagtgttggtcctatgatttatatttaaataggtgttttatacctggatagatgcatatattcatgtatattatttatataaatatgtaaactacgtggtggcttatgcctgtaatcctagtactttgggaggccaaggcgggcggatcacttaaggttgggagttcgagaccaggctagccaacatcgagaaaacccatctctaataaaaatacaaaattagccaggcatggtggcgcatgcctgtaatcccagctacttgggaggctgaggcagaagaatcgcttgaacctgggaggtcgaggttgcggtgacccgagatctcaccattgcactccagcttggacaacaagagcaaaactccgtctcaaaaaaaaaaaaaagtgtaaactaaaattgagaaaaatagatatacatacatatacctgtatgcataaatataaatggctagcaccatatacatacaatgatagcatgtgtctgcgtcctctcttcctgaacctctcactttctacctctgctgttttcagtcatagattccataaccaggaatggctaactttttaaaacacttaaataaaaccaacccttcgagcagagatatgagttcttacagtttgtggggtactacctataaaataaatatatttagatttgtaaatatttaagaaaatacaatcgtatttcacagtccaagttatatgctctttgccttttatcactatggactgcttggtgcctcttaaaacagaggctgcttttttattggtacataatattttgcatattcttggggtacctgtgatattttgttacatgcatggcatgagtaatgatcaagtcagggtatttggagtagccatcaccttgagtatttatcattcctatttgttgggaacattttaagtcctctcttctagctgttttgaactatatcatatgttgctgtgttaagctgttcttacattactataaagaaatatccgagactgggtaattcataagaaggaggtttaatttgctcacggttcttcaggctgtacagaaagcatgacagcatctgcttctggggaggtgtcagggagctttgattcatggtggaaggtgaagtgggagcagacatgttttcacgtggaaaaagcaggaacaagagagatagttgggtcagggaacgtacccttttttgttgtttgtttgtttgttagttttttgagacggagtctcactctgttgccaggctggagtgcagtggtgtgatcttggctcactgcaacctctgcctcctgtgttcaagcaattctcttgcttcagcctcctgagtagctgggattacagacgcgcaccaccacgcccagctaatttttgtatttttagtagagactgggtttgaccatgttggccagactggtctcgaactcctgacctcgtgatctgtctgtctcggcctcccaaaatgctgggattacaggcattagccactgcaccctgccgggcacacacttttaaacaacaggatctcaggagaattcattcactatcacaaggctagcaccaagaggatgttactaaaccattcatgacaaatccacccccatgatccaatcacctcccagcaggcctcacctccaacagtgcggattacattttaacatgagatttggagtggacagttatcccaactatattaattgctattaactacagtcaccctactctgctatctaacgttagaacttattccttctatctaactatatgtttgtactcattacaaccaatgtctcttcatccaccctcatccatacacccttcttagcctctggtaaccatcattctactctctctccatgagatccacttttctagctcccacatagaagtgagaatgtgcaatatttgtctttctgttcctggcttatttcactcaataggataacctccagttgcatccttgttgctgtaaatgacatgattttatttttatggctaaataatattccattgtatctatatataatatataatatatatataatatatataaaatatatatatatgtatttttgagacagagtctcgctgtcacccaggctggagtgcagtggcgcaatctcagctcactgcaaactccacctcccaggttcactccattctcctgcctcagcctcccgagtagctgggactacaggtgcctgctaccacacccggctaattttttgtatttttagtagagacggggtttcacggtgttagccaggatggtctcgatctcctgacctcatgatccacccgccttggcctcccaaagtgctgggattacaggcgtgagccaccgcgcctgccctcatatatatatttttttaatccagttgtccattgacggacacttaggttgattctacatcttgctattgtgaacagggggcacctttttatagttgacttgtctttttcagttgctcttatatttttaggtatttctaataaactcacaggtggagaaaaacattttgggctttacattatcagagagccactgcatttatttcagagaattcagcaggctgtgaaccatatcctgacttacaattttgtacaaaggacggcccataatggatgtatgtattgtagcagcatacagtctgtttggctaagcatataaaagctacagaactgtagatattttaatgacagctgcagatcttacagcttagagacttgtagcttgaaaaaccgagtcattgaatacaagtcgacctgaaatacacggtcactcaaccagtctggtatattcctggacctatatggctgcttttaaaatttgattttatttatgaccttaagcattttgtttaagaatttttaattgtaagagcttcagtttacttaagaatttctaccttggccgggcgcggtggctcacgcctgtaatcccagcactttgggaggccgaggcgggcggatcacgaggtcaggagatcaagaccatcctggctaacatggtgaaaccccgtctctactaaaaatacaaaaaaaattagctgggcgaggtggcgggcgcctgtagttccagctactcgggaggctgaggcaggagaatggcgtgaaccccgggtgacggagcctgcagtgagccaagatcgcgccactgcacatcagcctgggtgaaagagtgagactccgtctcaaaaaaaaaaaaacaacaacaaaaaatttctaccttaacgtgccttaagttaagttgatgctgcttggagttctgaatctgatttaaatgttagtgaatgacttgcttcttagatgcatttagctatttgccaaaatgcatgaaattttttttagaaaaaatgctgtctaatgtggaatatcattattgtagccacagtacttcttatgggagctgccatatttaaaggaagttgtatgataggcctatgcaaattaaccatgctttttttattaaattagtagttgtaggatgaggcattcttactatcataatgatacaatcagagtgagaaaatgcatgagatgggttgttgcagattccctgctccctctacaaattcttatcgtgaaagttaacattttaaagttcataatccattaccccatttgtccagtcctttcctagttcttgattaggcatttaatttaaaaaaattgaatggcttaatttgggcatagtagttgtatacacactttttggtggcaatttccataaagcagtttgtatctcaactcatcaagtggtttgttaatgaagtgagagtttgttaaagatctttacttgaggatccttaaggaaaattgatgcctatgcaagatagacactcattttaccctcagggaatcagatctggaagcacttatagtctgtagagcttaatgaaacaaagtacattttttatttgaaagaatttattagatttatctaagaaaacgtggggaagagtttttaattttttttttttttgcctatctaggataggaaattaatgctaatagctactatttcttagataaagatatattaaataagagtacaacaatagctatatccagttttaatatacttcctacatgccaagatactttagaaatgttaattttattaagtttataaagtgtaatcatcttgcattttcagaatattagaacatagccaatccaaaattttacaaacatttttgacaaaaaataatcatggattacctaagattacttatttatttaataatacataaagttttaaaattcaacctcttctgcgtctacaaaattctattactaagaagcaaagccatcatttttaggtatatctaaacaacaaccttccatacattttcaggcacaacaaaatgcctgtatgaaaatgttcctggaaagtagcactgatgaaattttctgattctttccaataccaaacaactctggataagataaaagcacccatgggaaaaaaaataaagcaaaactaaaacaaaacagaataaaaacaaagatgctgtattaattaatttgagaaacaatatatttttttcctccttctcaatgcattttaaatgctttgagattccctgggtaaacaacaacttaactttgtttaatccagcattttgcagaatcatttacacatggaaccttggcttctttgctcagcatatacatcagtatcggatggtgttaagcacagtttgagaaagcttcttgagaaaaatatgaggaaaattatgaagtgtatggagagctaagagttattttacttcatgtatatgagaacaagttacatcattttgttttccctaatatatattgacagtttcttaagtttttttatttgtttgttttgttgttgttgtttctttctttttttttttttttttttttattttgagacggtcttactccctcacccagtctggagtgcagaggcacgatcttggctcactgaaaccgctgcctctggggttcaagcgattcttctgcctcagcctcctgagtcgctgggattatgggcatgtgccaccatgcccggctaatttttgtgtttttagtagagacaggatttcatcatgttgcccaggctggagtttttttttaatcttaacttatttacaggaagtaacatttactgtactttaaaaaatatactaatttaatcaaagcagtagaaaggaaaaaaacattagtgaaaggatgaagttgaatttttgaagaaagctttccttcttttataaagatatagtgataagtgtatggacaccaaatgattcctttgagaatgagttgaaatcataaattcatttgtccgagaaaataacacagttacattaaaaaatatgtgtaacatttcaagtactttttaggcatcgtgaagcttgtgcctgggctatctaataatcactgacttaatatttttgtattagaattccacagtttgaagaaaacagtgctgtgtatttttgaaatgtggtgttctgcaatcaacaagatataggggttttaattttcaacaactaccttttattcaataaatatcttgattatcatgtagtcataaatcattgacttaaaagtagggcaggtaatatttatactgtctatcagatatttgaaatacaaacaataattagaaaaagaatggacccatatggtataaaatactaaggttcctctgctcaggaaatccaggaggatatgtcaataaaaaaggtaaaacacatatatagattagaaacactacacagtcaaagtaatggaaagtcttcagtggctatgtaaagaaaatcactgttatttttcatcttattccagtggcttttaggaaattcatatattgaaacaaacatcaaaatttcactcttagcaaaactgtctgattttaatatatgtgtattgtttttaatgtttcactctttccaaagatgtatttacattttgaattttccaaattgattattaatgttcttacgtttagaaaatcacttctaaaatgtattgaaatctccataaataataaaaaataattgcaaaatgcattaccccagttcacatacttggctattcaggcaagcccgatcatgttcaagaaaggcaagtaggtttcacctacattttgctgagcaaattatattttggatgattgttatataaattaggagaggattttaaaaaatcactttcctggaacatagtgaggacttactggacaaaaatggaaaggacactgtttctacactttagaagctcattgtcttgtggacaaataaagcagaaaaatacttagggatttttatatattaatcaagatgtcagagctcagagtgttttggaaaaataaatctccatgttttaagaacttggtttaggacatttggaaatatattaataagtagataaacatcttaaatatataatcatatattaaagatgaattttaatatagcaagcattatactaaatattctatattaaatttatattatctatgtttgctctatattttgtagtgacaatatcaataaaatttgtatttgtaaatgtttttccataggaacctgtttggaaatatttaatacataaatacatccataagttaccattaaaatgatattatacatgtgtatttattgataaggcatgaagttcagaacatttgctatgtgaataagaggattacttcctccaggacttccacttcccattctcttttaattttcttcatactggttgttctttattataatctgcatgttattcagttattttttattttgtctttgtgtctgtactgagaggtgaactccatgaagacaaggatggcaggtgttcttgtttgtttcattcactgcttgacactaagcaactggaagtgtacctggcaaatagcaaatattcataagatgtttgccgaatgaatgaattatgaaagtggaactctttgaaaagctgtattcatagagaaaatgtgtgtgtgtgcacatgcgcgtgtgcgcacagagatatgatgtgctaattttagaaggctgtctatcaaaatgctagcaatatttttctctggatggtagtggaattttaaaatattctttaattggctttttggtattatttgtcattttaacaaaaagagatagaaattaagattagaaaccataatgttttaagatttaacattgtgattttaaaatatcaatttcttcatctctattcaccccaaacatattttgaatgcctatgttgctgcaggtgggaaaataattgctatttctgttcgtaagtcaattaatagcttaccaggaaagataataaaacatcgactggagaacaaagtcaaattgtaatgaaatccgtaacagttgtgcatagtgtaagtctattctaaagactaagtattgaaaataagttcattatttcacacaagaataaagagacataaatcatggccttctgtccatgcattcattgttgaagtgtatgtttaattaccacctctggtacaacacagtttagattagagatattatgatgtggaaataggtgggccagagagatgggctgaaaacagaggctttggagacagacaaatgcattagagttttcatagcaccacttggttttgtgatctttgccaaattacttgacttaagtggatgagacttacttacccttctgtgctgtagccaggattgtctgaccttgtatgtgaagcccccagcacggtgtctccctgctcaacaagtgtggatttaacaccctttgctaggtagaatcccagcttgtctcccttcagaagccccagtacaaccacttacatactcactccagactccaattgaaaatccagtcatttacttatttcttttaacagataaactaaagatgttggggctccttagaaacttgagcaccttagatgtcagtacttctgggatgcctgcatcttaaccaaaagctgtttgatgtccacctgctcctttacaaatttcagtctcatgagtggtttgtcgtaataccttttgtaacacatgtagcagggactgccttctgctatccttgaaaatcctagcaaaggatcaattcttctgtctctatctgttcctatatcactttttcttacaaatagggagcaataataaggagaaaaccaaaaatgggtcgcataacatctgcataaacttcaacatgtgatatttttaaacttaaaaaaattgtaattaaggcacccgtagagaaaatgacacaactggagactaaaatgactaaatggagagtttaaagcaaatactagtgtacatgcgaattatatcaagaaacagaactttgttagtagccaaaaagaaaccccaatcccaatacattccttcccattcacaccaggacctcccactaaatgaaccactgtgctgattacgatggaagccactttctcactctttatacacttgtcacctaagcatgcatctttgaacagtgtagttgagttttggcaatttgaggaatttatagaaataatccttgtatcatgctttcttttgtgtctggattattttattcaacataacgtttttgagatttgcacgtgaggttctatgtaaccatagttcatgtatttctttgattgctgcctagtattcaactatatacatcaatcacaacttctgcatttgagacttatgtgaataatgctataatggccattcttcttgtgcaatgtacagatatttctgttgagtacataaccaggagtagaattgctagagcctgtgtaaattgttagcagaattgctagattctgggtgtgtatctcccaaagtcatctggtgcacactctctccagtagagtgtgagacttccattgctccatatccttaccaacacttggtattatcagtatttttatttttttctccattttgttgcaaatgaattgatatcttattgtgcttttacttcaggtttccctgagtacgaatgtagttgagcattttgtataagcctattggccatttatacagctcctttttataagcgcctgctcaagtatcttgccctctttaaaactggattgtctgtcttcttttggattatttacatattctggatatgtacccatttaacagttacgtgtgtggcaagtatcttctaatcaattccttggtttttgattctctgataattctttcctaatatgtaaaaatttatattcttatttatttccgcttattttatcttacaataatgttttgtgtcttatttttctctactttgaaatcactgacatactaattaacatgctatattttcttcaaaaagctttaattactggaccttttacatgaatattaaggatccaccagattcctaagactgaaaatgttaagtgtcgccattttggaaaagagtaacatgctttaaagagcaaaaatcttgttgagtgggcattgtagcagttttttgaaataggtgtagtctttttttccgttaagaaaaagaatctgcctgattttgggatatcatatcaggaaaaggtcaattttcactttgttttcaatatatttatccaactatcccagagctatttattaaaaagtctttttccattgttttgaagtgctccttttgtcataaatcaaatatccatatatgtgtttattgatggttctgttcctgatctatttgtatttgtctgattctacggtgtcttaattacggtgtcttctaattggtcttggcattctatttagcaagtcttcccatcttgttactcaatcttatttgaatcctttgaattttctggtttgtaaccaaatatataatcagtttctctcatgttccgtgtgagcttgaaaataattcatattatgcaatcattgggtactgcattctgcagaggtctatttaatcaatttgataaatatttttgctcagatactgtgtatccttcctgatttgttagcagatactgacattttaaacaaacaaacaaaacacgttattgtggccttgtcggtttttgtcagctctgatttacaattctgaggctacattcatgaatgcatataaattcagaagagtttacacattctgctgaattaacctctgatcattgcaaagtgtctccatctctaataatacattttgctttgaagtagactttgatattaatatagttacatcagtttctttttgttaagatttaagttctattgtgttctctcactgcttagagcttttaatggcatcagagagtaaaagccaagatcccttcctgacctggcttgtccctgtctctctcaactccagccaccttgttctgattccctgccctccacgctggccccttgcagctcttgaagcagttcagaagctcccacatcagggtatttacctgtgcaattctctctggctgaaatgctctttcctcagatgtctgcatcactcattctttcatgttctctaatgctgctcctaaaaatctccctgggggttgagcctttcctcaccacacccaatgttcccttctccatccttgtgcataattctctccatagcacatagcaaaaaaaaattaaaataaaaaaagctatttacaaatgtgcttctttgtttgctgtccacccatctacgatattgaaatggtagtttcatgcagccagaactttgtttccataagggcagaaacttggtttttgttgttattattttattcgtttaaattcttttttattactctatccagagaatgtaaaactctcaagtactttttgaataaatgaatgaatgaataagaggaattgtagcattatatttatctgtgtacctatctatggatctacctatctatttaacagccattaaatataagctagtattaagatagagcaaaactcatttctctattgaaaagatagctaaagctaaactcatcagtgcgttaaagtgaatcctgtgcactgactacttttttacacaaaccaagtgtgtctttcaatagtactacacacgttttgtcaaagggcaaacacttaagaccaagtaactgaaattactcatagcataaacctgtaaataactcttctggatgggctttgctgatttgtttattcatttgttgtcttgatgtgtttgtctgatacacagttataaattaataataaatcttattccccaagatgtcattcacatggtatcttgctttcagaacggaacacaaacttagccactccagctacgacacttcgttctataattttttaaatctcaaggaacaaactttctaacaccccctttagagcaattgactctcaggtttgacaacttctgtaactgaaaattcttccgagtttctaaccaaaatcctacttgaagtgcagagttcattgggtcaacagcttgtgataaaacaggcccattaaatccaacttctggttaaggcagagcttgtgaatgagtcctagctaaataacgtaattacggctatgaactgaagccaagaaatctgccacctacttcacagtgagtcttaaatggaaacaggatatcctttgtgtaaaatcaccttgaaaaggagaaagaactaaggaaaagagattgctatgcggtaaaatggttttcatcagatggaaggggattaagaaggtatttaatgatggcatgctggctggctggttaacacagtggaaagctgagggtgtgaaccagctgtgatcctgggaattcctggagtcctagcaacaacatggaattttctatatgggaatcggaggggcacctaggagcctgtttgatgaaataactggcatgtttaggagatagttttgaatgagaaagtgaaatcagttaatcccccaggataaagtggtacagcatcctgaaatgatggggaaggaatgtcatctgccgtaagacagacactgggaaggtacattttcttgtaagcaataggttctgttgttaaccagccaatggtctctgtaccttgagatgcccttgaaagccaagtagtacccgaagagactgccccatctcttcccacctactgctaatggaggtcattaatttatgtcccattctcatgggaggcaaataaaaataaggtactgcatttcattcatgtggtgctctttcatgtactcaaagaatgtgtatctttcatttacaagcaaaataaaacctattcctttattattcttttttctccaaggagtgatttcctggtctcgggcagtcatttctgctgttcagtcctggaatttctccaacactctcacataaggcatcagttatagggcctaaagcagatcctaatgcactaataaaatctggtttgatgaagagtacagaaaaggtgatctccttgtacttctgcttattttatacttctggtacggaggtggcttttagtgtgctgactcatgcttaatttgattttacattgacacagaatgacacttgcaaattctccactccagtgccctttttattttactcctattaaaaagcaaaatactttgaaaaaccatgtccaaagaggggtagaagatggaactctgcatttattaaatgatttttttttgctactttaagtttaaaattcagccagagatctgatcaaaatatgactagtccatagccatggtgaattcatatttcctaataaattatatgctttcattatttgatgagatgtttattagacttttaaaatatcaaacataacttaattaagacaaacagaaatgaaggacattgtacaatatacctaaccattagacttccaaactgtttaggtcacgaaaaacaaagtgtcacatatcagaggagactaaggagacagaacaactacatgcaacttgatatcctgtgtcagatcttgaaacagaacaggacgagaaaaatctgacaaaatctgagcagaatctttagtttagttaatagtatttgaccaatatgagtgcattcattttgaaaatgtaccattgttatataggatgctatcagaggaagctgtatagagtatacaggaactccaccatttttgcaactgtttataaacctaaacttattccaagattgaaaaaaaataataacttaagggcttcaacttggtaaacagtctattacatagaatctttaaaaatcagtcttatctctgtgtgattgcctttcttaatgtaatagcaaagagataagatgctgtcaaaaatattaaatctattttttccttattatctattattaggtttattttaaaacaatattgagtgcctacatagaaatatgccttctggctcatgtttaactcactctttaatagaaaataactacagtaacatcagatggggaattacagtcagcaagtatgtgtatttacatatttccacgaatattgtaaggtttcatttaacatcatgattgttcccaagctatgagtaacaaagtgacagacagtacaggggaaagcattgttctgtacaaaaagacaacaactatattactagggatttgagtctcaattttactcctcaattaagactccaaatccattaatgaatagctaaaagataaaatattgataatctctatacatcccactttgcagatatctttttctgttagcagtctctcaaatcttagattcatgtaactgttttttacttccccaatattattactctgacaactaccacaaccagcactatcctaccatcactgctagttttaaaaaaatatatctaaaagtatcttagtcagttccagcttctgtaacaaaatttcatatagctagtggcttgaaccacagaaatttattttttcacagttctggagtttgcaagtttgagatgagggtgccagccccattgggttctggtgaaggattacttcctggcttgcacatggccacattctcactgtgtgctcatgtgacctcttccttgtgagtaagcagagaaagagagagagaaagcaagttgtctcctatgtcttcttgtaagagcactaatcccattatcaaggctcaaccctcatgaccccatgtaaccctacttacttcccaaaggccccatctccaaatactagcaccttgggagttagggcatcagtagatgaattctgtgggatgcagttcagtcatggcagtatcagaaacccaagagtttcaggtaagagtttgtggattacttttcaaattcacatgccagatgctttcttcaggctatgtcttgtaatcctcaaagagcatcttcatgaggtatattgatcttaatttaacttctgcaagtggaagtgtttaatgaatagcagaacctgcactaaaaattaaattgttgtgactaaaaaactgtttttaggcattacaatatcacatcctgaattctaatacaaaagtgtgaatttcactaaagactgagtgaagtgatttatcctgcccaaaaatttcatgctatatggtgaagagagtaattttaggaaaaccaaatttgatgccgattttttttcttttcttttcagtcatgtattagtgaatgtcaatataaatagttatattgcttaacaaatattccaaactactgtgaaatatagtaggaactcatatgtgtattcaatggaataaacggttttgtttattgatactatatataattctcgtaattatgaaaatcatttgaaaactttaaaactatactgatgcaagcaataatttgtaaagtacatgtaaatacccatattggttatagatgcactgaacaaggtctgttgccaagagcattttatccattttgaattaaaataccctgtgtttattgactaccttctatgcactgcggcatgagctttacatacttaattttttaacacttaacacttaattgtccgtagctaatttaaggacacaagctcagagagataaatgccttgcccaaagttatgtggctccagcaagggctgagctggaattccaagtccaatatttgtagtttcatagtctgtacttgggagatcattaatatgctttctatttaaaaaattatatggtgctctaatttttctggttgcaaaatatttgcatctgaatattctggagctgaatatttattagaattgtatatcactaggaaaaaagtgtcccttcatatggctttgtcatgtgcagaaaattgtacctactctataagaaaaaagcgcttgagaaatggctgagccttgtggagagtatgctgtgtactagaacataagcccatcttggtaaatcctccgtctgtttcttgaggtacccttctttatcagctaagacactaagtaatttgtgtaaggttgcacagctagtaagtggcatagccataatgtaaacctatgtctgtctgattccagagctctattaagtttccactatatcaaactgtctcttcttgatgtttgcatttccaaaatctgttaccacttgaaatgtaattacttcatttaagttcaaaagcagaattctacagcactaaataaatctatgtagaattaagttaattaaaggtagacaaaccatatgctgatcatattctaatcatctgtttttttaaatacatttcactttgggagtgtggataagtaaggggccaaataagcacataactacaacattatgtgtgaaatacaggagctttatgtagaaagaacaccaggagctctaaaggagtaatatagttcataattttcaggttaatggttaggaagtgtttgttagggaaggtgcatctgatcaggcagaggagaggcatgttcatgtgtgtaggaagttcagggttatcctgcacatgcttttcaaggctcctgaaaaggatgtaagaaagaaagagtaaaatcaacttacggatatgcttggttgttctacttttataatgagaggcctttatgtgattgttgcaagaatgccttttaacatggaaaagactgtcttctagtgaataataagcaatgcacacttcaaaggaattatattatctaggctatatttgtaaaaaaacaatatgacaactttgcaatttaaatgaagacatagaagagaaatattgtgatctagatttcagaagtttccttctattgatttcctcatgggcataaagaaattatccaccagcaaagaatacactagatttttaaatttaaaagttgtggccaatttgcatttttagacttcttcaattattggaaagaaagattcattttattaccttgtctttaaacatatctgttgagggagtgtgatatggtggaaagtagataatgaacaatttacaggtctaatattaatcagtcctataaaataaaggcaaggttcagaaattatggtttgtgtcagtgtaattagtagtctgggtttttttttcaatcaaagcttaagattcagacgtgtcaggtttgtcaaagatagatagttgtagatatgtggcattatttctgagggctctgttctgttccattggtctatatctctgttttagtgccagtaccatgctgttttggttactgtagccttgcagtatagtttgaagtcaggtagtgtgatgcctccagttttgttcttttggcttaggattgccttggcaatgcagactctttttacttgacaaaaacaagcaacgaggaaagcattccctatttactaaatggtgctgggaaaactggctagccatatgtagaaagctgaaactggatcccttccttacaccttatacaaaaattaattcaagatggatgaaagacttaaatgtcagacctaaaaccataaaaaccctagaagaaaacctaggtaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaataggagaaaatttttgaaatctacttatctgacaaagggctaatatccagaatctacaatgaactccaacaaatttgcaagaaaaaaacaaaccaccccatcaaaaagtgggcgaaggatatgaacagacacttctcaaaagaagatatttatgcagccaaaagacacatgaaaagatgctcatcatcactggccatcagaaaaatgcaaatcaaaaccacaatgcgataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaactgccatttgacccagccatcccattgctgggtatatacccaaaagattataaatcatgctgctataaagacacatgcacacgtatgtttattgcagcactattcacaatagcaaagacttggaaccaacccaaatgtccaacaatgatagactgcatgaagaaaatatggcacatatacaccatggaatactatgcagccataaaaaatgatgagttcatatcctttgtagggacatggatgaagctggaaaccatcattctcagcaaactatcacaaggacaaaaaatcaaacaccgcatgttctcactcataggtgggaattgaacaatgagaacacatggacacaggaaggggaacatcacacactggggcctgttgcggggtggggggaggggggaaggatagcattaggagatatacctaatgttaaatgacgagttaatgggtgcagcacaccaacatggcacatgtatacatatgtaacaaacctgcccattgtgcgcatataacctaaaacttaaagtataataaaaaaaaaaagattcaggtgtgtgtgttcaaatcctgacattggcacaaacttcatcttgaaatgaaagtaatgcctattttacattaatctcatttcactatgagtattaaatatgtatataaattttaatttattgcatgtatttaataaatacttcctattacagaagttcaaaagtgtgagacacatgtgttcataataaaaatatatttcttgctgctttcaaaattactaatgaacatctgtttttaaaaatctaaaattctacaagataagtaaattttcaaatgtgatttttttcaaagatagataattattatgtaagtgcttcacttaactttgttaacctgccactgcactagcatggaagatggagaattgtctgtcactaggatggtgataataatttatatggtactgacatccagatgatttagttatattaaagactactaaaatcagccagtacagtgaaaacctcaaaacgaaatcttttcacaaaaaattattttacatgaaatatcatatttaaaaatactgtaatcttaattaagaacatgtttgtcaatcaaaaacagttcctctctgaagtacacttaaaaaattgattaattgaatcaactcctaatgtcgtaaactcatgtaaaaatatggataatgggattcctttatttgctttcagattttcagacgatgctggttggttttcaagaaggcttctagcaaaggacccagaaggttagaaaaatttccagatgaaaaggcagcttatttcagaaactttcataaggtaagtcacagtcctgggagtccctggggaataactgggcccttgaagacttgtggagatatttctttgataaatgaaatcttcagtggcaaaaattaatggcttgggaaaaatgcccttttctgataaaatgcagaagttatttttctcctttaattatctgttgtaaatgccagtgctacctctgtgcaaaaccaaagactcatttttattgctactttgcaaaatgagatgactcataactcaaccaaatcctttcctaaggtgctgagtaggtattttctctctattgaggttaattatgcatttgttacttggcgtaaactgtgaacaatatttactagataaaaattagggggctgcctttaacagtgctaatgatattgttaacgtatatggcatttgctgttttgtaagctccttaacaagaaaatgatcatcgaatatgctgatgtgtagagataaggcataaatacttggaataaaatatcaatctcctaagaattaaaagaatgtaaaatataaccccaaaatgacgctaaatatatctttcatgataacatcaaaacacagctaggtattttatagtaatacaaaggattcatgatcaaaactcaagagttgtagaacagtgttgcttaattggtagaatgctcagtaaagattttaatttctcattggtcatacatggagtaagttttcctggataatgtaatgaatttgtggaattttattttatgtaatatattgttctaatttcttttttaaaaatagattatttgacaataactagtatttattattattagttatgaatattaactagtaatcatttaaaatttgagcttgtaaaactctaggaaccatcttctgtctctacgtgtgtgtgtgtgtgtgtgtgtgtgtgtgtgtgtgtgtgtgtgtgtgtatatatatatacataattttaaaaatattttaaatataaatagacattggtcttgctatgttgctggtctcaaactcctgatctcaaacaatcctcctgccttgatttcccaaagtcctgggattacaggcatgagctaccatacccagccaagtattccatacattgatatagatttactgccagagaatacaactttctgtccagtcacttactagctcatgtatgtttggttttctcatgagtagacgaattttaaaattgttatatatctctaaagattatttgatatatgatgtcataaacagccagcataatacttctcaatctcattatatgcaattatttgaattctaaagtcttgctgatatgtttgtgttataactatgattatgactttggcaataaagtgaaacctaacttaatgaggaactgccagtttgtaaaaatgtgagtccatgatatttagtttgtaagtaaaattttgatgggctgagcatattatatcttatttggatgcctggtcagagttcctgcctgctggttagtgacatatactagttggagctctctagccagtacagctcggtttatttatttatttatttatttatttatttatttacttatttatagacggagtctggctctgtcacccaggctggaatgcagtggcgcgatctcggctcactgtaagctccgccttcgggttcacaccattctcctgcctcagcctcccgagtagctgggactacaggcgcccgccactgcacccagctaattttttgtgtttttagtagagacgggatttcaccgtgttagccaggatggtctcgatcttctgaccttgtgatccgcccgcctcggcctcccaaagtgctgggattacaggcgcgaaccaccgcacccggcccagtttatttttatttacaaatgaaacaggaaaaattgtcaagaagcattattatgttatctctggactcagctatcttttatctgaaaaaaatagacacactctagtactctaaccccactataaggattggtaatttggacacagatgggcgtggagtgtctgctctacgctaggcattccactcctggttgggaattcaaagatgtgtgagacacagtcttgccccgaaaaagcttgcattctagtggaaaagacgcaaatacacaaataacttcaattcaatatagcaagtacagatggagaagtatttatagattgctgaagaaagagcattttacctaatttggaactcaggtaaaacttctctgcaaagatgatatttgaatggccaaactagtggtggtaatgtgtcagccaaatgaagagaaagggtcatctctaggaggcatgtggagcagcccttcctccttattttatattctcttgatttttactagcttgcccactcattatcccacagaggcaatcacaggcactccatggcagtgctcagagctaaggaaaatgccaactcctatttatcttacagattgcctctttaaaaatcacttagcttccactgtgagctgtgaatttcaaggcaaacttcattccttgagttattctgtgaatcgtcaaaacatggtctatccgttagcctggcatggaactccaactcattaacatcatcagacatgtttacggagcccttaccatgaatgtagcactgggccatgcactggggatacagtattagaaagatggtcctctagtctatcactgatcttcacttcttgataacataaaacaatgtaaatatgtaataaatgtgtctttattttttaaaaaaataggataatacagaattaatggataacagctatagatatgagtaggctaagactcaactgaaaagaaaaagactcaatccttaacaaattcggtgatataaagaaagatcattccaagaagaaagaaaaatttttaaaaaccattaccaaaaaaaaaatgaggcaggaacaattcggtgtgatcaaggacctgaaagagatctgttgtgactggagtgtaggaaaagaggtcataaaaactgaattagactacaagtgatgagagtcaatgacagggttttaagcctgggtctggcattacagtcttaaaataccactttgtattttcatttccagtacataacagtgatcctctgacagtataattctcccacagatgacatatagaaactctggatgtcaggttcaagccccagctgaggtccgaggggagtgagtggttgggggtagggagctggaagaacactcaagaaacgacaggtagatgacacatggctttactcagcagctctctcacactgtctgtctcatcagcagcttacttacattgtccacctttatctcagccgcttgctccagctgtgcccttctcagcagctgctgtggctcctgccgctcccactcacagctgcatggccagctctcccttacagggtcagcagcttcactctctccctctcagcccaagctggtttctggctccccgcggcctgccttcaggcaaccggctctcccttacagagtcagcaacttcaccgtctctctgggcacaagcccaacctgtgccctggctcccccatgttcaactgcaaaactaacacatttgcagagaccactctggctctctttctttctctgggcatgccatatgcacagcgtcagcagggcagttagaccttttacaaacaatagtggctccaagccaggtaatgagccttcccgtgttatggctacatagctgtgtttacataatgcatggaattgtgcacctgcactccgatcctgctgagtcatgcaggatgtttacctcggcctgtacttgaccaaagcacatccatttaccttacactggacaaaatacaaaaacaaagaagtccctgggtctctgaaaaaagctagtcattttggaggaaagtcagatctggaatcaagggaatgacagcttctccctttctctgggtgcagctttaggctgggggcagatgtagtcacaccaaagcaatattggccatggcaatgggatgactaaaaccagcagttcccaactaccagggcatgaaccagtgctgggctgtggcctgttagaaaccaggctgcatagcaggaggtgagcagcagtgggcaagggagcaaagcttcatctgtgtttatttacagctgctccccatggctggcattaccacctgagctccacctcctgtcagatcggtggcagcattacattctcataggagcacaaaccctattgtgaactacgcatgaaagggatacaggctgtgcgctccttatgagaatctaatgcctgatgatctgtcactgtctcccatcacccccagatgggaccatctagttgctgtaaaacaatctcagggctcccactgattctacattatggtgagttgtataattatttcattatgtactacaatgtaataatagtagaaatgaagtgcacaataaatgcaatatgcttgaatcatcccgaaactgtcccccagcccccacaaaccccctggtccatggaaaaattgtcttccatgaaacctgtccctggtgccaaacaggttgggaactgctgactaaaacaaccacagaaagattcggcatcattgttcagaaaccaggagaaatctaggctgccagaaagggaggaagaaactccaccaaagagaatgctagagaaggggagctcttaaatatgtacataaactcagaatgagagtgtggctgacacttgaaccagttatgaagtggcaaattgaaagcaactcacaactaaagcttaagcatctcactgaagtttgagccacaccccaccacaggtgtagcatttggcaattcagtctaagcaaggtaattgctggctgaaacaaaacactaaccatctcagataaatgtaacagaatccagaggctacacgtgacaattacaatgtccaatataaaatccaaaattcctcaagataaaaaatactatgaaaatggagtccaatctaaaaggaaaagaaaatcagcaaatgttcaacctgatatgattcagattctgaattattagaatgggatttaaaaccagctattatgcctatgcttgatgaagtgaatgaaaatatccttactcttttaattttaaaaaaagtatttttggcagaaaaacaaaaattatttttttttagaaatcctaatataactcattctaccataaaggcacatgcacatatatgtacatcgcaacactattcacaataccaaggacatggaaccaacctaagaaaatgttgtacgtatacaccatatggtacatatggatactatgtggccatgaaaaaagaacaagatcatgtataacatggatggaactggaggccattatccttagcaaactaatgcaggaacagaaaaaccatataccacctgttctcacttataagtgagagctaaataatgagaacatatggacagaatgagaggaacaacaaacactgggatctacttgagggaggagggtggatggaaggaggtttcaggaaaaaaaaaactgttgagtactatgcttagtacctgagtgatgaaataatctgtacaccaaacccccagtcacaagtttacctatatagcaaacctgcacatacacccctagcctaaaataaaagttaaacaatatattttttaaaaaagcaaaaacaaaattcacctgcaaaaaggagaaaaaagagaaatcttaaatggaaattttagaactacaagtaagacatccaaaatttaaatttcactgggtaggattaatagcaggaagaaaataatagaagaaatagtgaacttaaagatagaacaacagcaacaacaaaaaatcactggctatgaaaaagagaatttttaaaaaacaaagaagtaaaaccgcttctgggacttaagggacaatttcctagttagtattcccattgcaaagaaagaagagaatgagaaagaaaaaaatttgaaaaagataatggctgaaaaattcccaaatttgttgaaagacatgaatttacagatttaataaattcagtgaatttgaagcaggatgtttggaaaaagaatcatgcctaccaggtctttcataaaagagaaagaaaatcttcaaagcacccagagaaaaaagacatgacatactgggggtcagtgatttggagggcagtgatcttggaaaccagaaaagtctgtgggacatctttaggatgacacacacacacaaaaaagtatcttcaaccaaaaattctatgtctgtgaaaaatatcctttaaaatgaaggtgagataaagtcactttcagattaagaagaaaaaacacctaaaggtatttatttccttcagatctatactccaaaagtgttgaaagtgagttcttcaggcagattataccagaggacttgaatcttcaggaatagatgaagggaatcaagaattataaatatataggtaaatataaaatactaactttgtcattatatatgtatacatgatttataatgtatgaatatttaatatatgtgataaatataatgtaaagatgttggtggtgagtaaaacggactcataccattgtaagattttcatggcttacataaagtggtacaatattaagtataagtagacttggaaaaattaaggagtttattgtaatccccagaataacatttttaagttaacataaaaatatgtagctcaaaagtgaataaactaaaattgaattttaaataatattcaaaaattccagaagaaaataagaaaggagaaaagaggtaaaacaacaacaacaaaaatatgaaaaatgtaaacaaagaagaaaatagtttatttaaagccaatccatgaataattacgttgtgttagtaaacattccaattaaaaaggaaaaattatttgaatggaaataaatcaagacctaacaataggctgtctacaaaagatgcacattaaatatacaaatagcctgaatgcaaatggatggaaaaaatgattggccatgaaaatagtaatcataagaaatttggagtggctgtattaaatcagagaaatagacttccggacaaagagtattaccaaagataaacaggttgtttcatgatgacaacagtatcaattcatcaggacaaataaaaatcacaaattttatggaactaattacagaacttaaaaatacataaagcaaatttgacagatttaaaggaagaaagaaacaatttcacaatctatattgaagattttaaccccctccctttctcaccaaatgatagactagctagaaaaaatatatatatcagcaaggatatgagatcagacttaacacaatcaaccactttgacttgatacttttataccaatacacaaaacaactatagaataaaggttactttcaagttcacatgacatggtcaacaaagtagaccacgttcaagaatattaacaagtcctaataaattgaaaaatattgtgttctttgaccatagatgttttaaatgtgaaatcaataacaatgtattatctagaaagctctaaatatttgaaaattagcatatgccaaggagcaatatgcaaaagggctaaatagatatcacaaaagcaaatattctaaactgaaagatagcaaaaatagattgcaataagccttatttcattgtttttgattaaaaggacaaattttggatatggtgtgtaaaaacggacaggacttacttatgaattaagtgtcgggtgtgaatgaaaggtagaactcatgcatgatctgtgggtttgggcttgagcaacaatgtcaaggatgatgcagttcatggagatgaggaagcctagaagatctggctttgggtaaaaatcataagcttttacttcatatatgttaaatttcaaatgtctattaggcattcaaactgaaatgtcaagtagtcaattcgataaatagttatgggctgaggtgagggaaatgtcactgctaaagttgttcctttggttatctttggcatattgatagtaccttattctatagttctggataaaatgtccttgggaaagacagagaagaaaaagaagataattagcaatccaacgtttggaagactagtgaaggaaaaaggaacagcatagaaatctagggaaaagaacagtaaaaggtgagaaataacattaagagtagatcattggaaaccaagagaaaactatttataaagatgagcaaatggtattatggctaacaccaacaagagattaagtaatatgaaagcaaagagaccatttcatttatgacacagaggtccttgatgactttgacaaaagctgtttcattcaaatatggggactaagtttacttgaaggagcctataagagaatgatagatgagaaaaagacagctacttagaaaatgttttcaagaagttttgagccacgacatgtagcaggtatgttttcaaatatgacatatatgttacctacaggtaacacacctgtaggcctatgggaatgatctagtaagcaggaaatgtgatgaggagaaagtttatgtgtgtaattatagggttttggccttgacagaacctgggatacttcattcattctaacaaaaaagctggaagagaatatgagtattgatataagtaggttggataaaaattaatattggaaaactgtgatcaacatttcagaaacacacatgctctatgtgtgtgatttttccctccaatgtgtgaaaatgaagcggcaaaacagcatgaagagcccaatgagaacaggaacagttaagggaatcatcttgtgattaaaaactacacagactttttaaattaaagctccctgaagctcttttgtaactgtgttcagtagatatgacagctaaaatttacctttttgtggcaatgctatgaagatgaaagtttttattattacaactttcctttcatagcattggaaaggtaattcactttcccggtgacttaagtttccctttgggaattttattattatttttttctgtgatggatggtgaactgaaacagcaaagttcaaccaatcctgatatggaaaaataacataggcatgattcatcagtagtacaaattttaaggtttttttttaagagtgtatgcaaggccccttttctgattttgattttattttagtaaatattacctaaggcttgtttctttgtatcaaccttactatgtctcttctttccactgtcttaactagttcaatgattctgatttctgtttctttttttcccttaggacgtacatctggttttcttcaaattctcttttaccatcctttcgttattctataacgccactctttatcattcaaatgtgatctattcttcctagtcatcaaaattacattactattaagcaagtctgaattgctcaaattaaggtaaaagccatcaataggaatatatgcacttgttgagtgagataagtaacatacgggcacatccatctctagaagttgttgcctctgtgctaccaaggaaaagagatctgccctctttattggggaattgctattaagcccaattcatatatgatgaatgcagtatgattatgaatgtaatcatataatgtaatataaatctttgtgagacactatgtgtagtgacaatgcagaccccaagtttcagaaaatgaagatgctcttcttgtttgtacactagggatcgtaattgtcctaatcttctaggaccaggaggagacttgactaagtttctacatataaaaattttaagagtgtttggaggagtcaatcaacactaagagttattatcattattgttttgaaattttacaatctgatgaagtaaggtttataaatagctaactataatgaaatatgattaaatgtagagtgcaatgttaaaagtacacaggaacagttaattctgcttctggcaactaggactttaccaaggacgtgacacttaagggacttcttaggtttacttagttttgacaaagtaaaataatgggggaatgcactatatgaagaaaaatgtgaccacaagtactgaaaagctacattgcacaatgatttgaagagaatttgagttatctagtgttggcaggctctgaaaggaggcctggagtgggaaagatgagcccaaaaaaattgcatggggcaataattgggtataaataccttactatgagtttagtttttatctttaggcaatagcgaagttgtgaaagggttaaaatgttttttgtcatattctcaaataggtatttcagaaaaaaatccatttttgtggtgtcatagccaatggatagggtaatacactatgtaacagagaaactagttaattaaatattataatattcccacttcccaaaaatagatgtcagagtcctgaatggagaaaggtacgtgaatggaaaggaggagatagatttaggtgacgttctccaggcacagtcaagtagaattaattacttaatggatacagtgtacacccttcaggccatggtgaaaagcctaggcttccctactgcacagcatattcatgtagcaaaactgcacaggtatttcctaaatttatacaaataaaactttttaaaaagactttgtaactgactgtgtataggggaaatggaagagagaggaatgaaagttctgatcttttcaagacagggtggtggatgcatgattttgcactcacagaaacagttaccatatgaggagcagttttcactggtaaagaaaaatgtcatccttggcatggtatgaggcatctatggtatattcaggcatatattttcattaagcaattagaagtacagcagattgtagtgaaattgcccaggaagcctactgaatagaattaaagttaaggtaggtgtatatcaaagcccatgtgcaaaagcagatccatgcaaaattaaactttataataagcccttttctctagatgacatggagtttggtatcagccttagagtaacatccgtggtatttcacaggtatttcaattccgagattattgagagctacaaataaaaaaaagttgagccctgacaggaaaaaagctaatttaagaaatgcttttaaaaattgcaaagagtgccacttaaatgagtagctgttagtggaataaatgttaaaagactaaacagcaaaggttatagtaattatcaatactatgtaactatactcctaaggaaatagtaataattctaaagagagaatatatttattttaacaaagagaaaattgtttaaaattttttatatttacaaaggagaaggagaaagcacattattggaggccatgggtgtttccttgggacaggacaggtggctgtgggtgacttcaatgtcaccatagggatcagatggtgttattttgtccaagacctagacaatcagccatcaaggcaaaaaaaatcacagaagtttttaaatatttttatgctcaaatatactcttgctcttacaaaatcatggactaaaccataattcctcatggcttgctccatttctagaatcattaaccctttttcttcagaagtgtacattggccaagttgtaaatttggtcatagttgcctctgaggtgcaggtaaataaaggaagctccttttatgagaaaggcgagatgtggaatctttgttttctcttagataattaatggccagtccaaatattggatctccagaattgggaaaaaatattcatcatcaagatggcttagagaaatagactagtgtggatttctcaaactgttctatttgtgagtgtttaaatatcttgaacttgtaactaagcagttactttgatataccctaaaatcaaagtaactggttagttacaagtttaagatatttatgctgtaacactcaatagcaataaattaaaataatcaaatgaatgaaatgtttgcaacctaaatgagagatttctgaaaaaataagccaaggatacaattatttctttaccaactttaactttgtgttacgccctatctggaacatacatattataagcttatgagtattaatggtctcatttagacatttgatatgtttactgtgagagtgatcttgcagcataaatcaatttttatatgaaactgctataaaatggtatatactttttagaaacttcttggcagagagaaatttgaaattcaaatcactagctgctgagggaagttattaaaaatgcattagggttgaaaatgtagctgtatataattgtcataacagatattgaaaacaaatttatcctcaatgaaaactgaactagagcaatttacatagaatcagctaataaattttccttaattttctaagcagatgaaaaagtagcagtttatagacattttaataaaataaatatgagttctgtctacagggaggaaaatataaataaaatcccttagaaggatgaatgaagataaaacaacgtgaagttccatgaaaactgcatgatgccagaaaagcgatgcttgtattgggaccaatctcacttctaaattccctgtaacccaacactgaaaacatcattttattctctttgtttggccttggcagtatttatccttaggtaaagcaaacatctcagaaagttggggaaaataaaggcatccttgtgaaaaacagccacctataaatacactatttcttcaaaactagaagaaaaggcattggtaaatgcagaaatggcacatgggcataatgttctgttggacactctaccctcattttgattccacgaagaaacggccctatgcttggatgagcacatatgtcatgcgatgtgaaagctgttaaagggcttggtgtctcttgaaatacctgctggaagttcccaaagtgatcatgatttgtttagattaaggtgtcttatctattcattaatgtattcatccatcttcaatctcttatctggaagaggtctcaatttcttgaacattaagcacttactaatatacacatcggtttctaggacagtgacacctcaattcacaatcatttactgattgatttacttatattaccacatgcaggtgtctcagggaagactcaaagaaatggaaaatgaaaagttcatttttattttggatgaagagcagggaatatgcccacagactgagcaccatctgtgtagagcatctctagagagatgttctggttatgaatggaaaactcgaaaccagagattagcgagaggcactaggtgttaagactttcaggtggagggtatctgtaacattgtgatgtctaaattctaggaaccttccagagctaaacttgatttttgtaatagttgaattaaagtcaattaaaattttacaaaatcttagatatctatcgccaataagaattattctatgtggcttaataatgccgtggaaagcagatcactcagtacttcggatttctgtttattacccatttctccacagcagttatgattcagactcctaggaaaccaccatggcacatacatacctatgtaacaaacctgcacgttctgcacctgtatcccagaacgtaaagtaaaataaataaataaataaattatttaaaaagaaaaatacctgtatcactgatctgggattgacttagagtatatagcagcatgatttatgttagcaaaattactgtccttattccactttttaaatttatccattttttcttttgtaaagcaaccgtctataatggtactatataggaaaaatcatagtataatttaaacaacatatttccctatttgtaaaatgcaagtaataataacatcatggcacacaaagtgaagaggtgatcgcgagtaacataatatgtaaaatgtaaaatgattgttgtgtaaaagtcatttctgccttagagtttgcatttttgaaattaagaaaataattcatatcaactttagaaagtttttgagagaaattcggatgataatttcaaacaagtcattctacatgggaaatcagatagtgtgaaagaatgttcggtactgcaacactgttatgacattatttccatcatttctggagcatttttgcatttaattcacagatttagatccaatgcttttcattatttcagagtatcatcagtgcatttttgaattttaaaactctccctttttaatctatcaccaaattctgcctaattgcataatatatgacagatgcaacaggagaaatgcttactgcataatgtccaaagagaataaattgtttcctaccattaatggaaagttatatattacactttaagttataaatgcacatttatttagaacttacaatttcaacaatatttcagtgagaaattattcttgaataatactttgcacttcactataaatatctagcatcctttgaaataaataataatgttgcttcatatttatttcaaatttatatagtattttaatatttttaagctctttatttactttagtaaaaaacaacagtacacttttaattgacctttgaagtatcttaatttgcagactgagaaaaaacactaaactagttttatttgagagcaggtccttaacctagggaactgggggttttgagacagtgaaattacttgttttgatcataactgtttaatttctctactcagaatattgtcacacataaactgatctcctgaagaaatggttcaatttctcccacacaatatgaaggcaaacaagtttttgttccctgacttatttggaagtggagagaggaagagaaagaaagattataaatttttgcttttaaatgcaactatttccccatagttctccttttctactttttagaatcaagttaatcatatttggatatcaagtatactataatattaaaatgtaactggattttcaatagcctggaattctctaattgtttttattctttcataaaaggttttcctgggtataatggaaactgtcttcctatttgatattctctcatgctggaagctatcatgttaatctcctagtcctaaagctggtttgtccaactctccgaaggtgggccaaaagaagccaacttttctttttttttttgagacggagtcttgctctgtcaccaggctggagtgtagtggcacgatgttggctcactgcaacctccagctccctcgttcaaatgattctcctgcctcagcctcccgagtagctggaattacaggcacccaccaccacgcccagctaatttttgtatatttttgtttgtttgtttgttttagtggagacgggattttcagcatgttggccaggatggtctcgatctcctaacctcatggagagattctctcacgaggagagatcctcgtggagcggtcgatccgcccgcctcaaccccccaaattgctgggattacaggcgtgaaccactctgcccggccagaagtcaatttttttaatgtttcattgcagttccatcttccaagcaaactgatctggtcagtctcaccattatcccaaataattgaattttttatgcagttcaaatactaacaataattgaagtacagctttagttttcttttgctacataataaatcaccacaaactcaggggctcaaaaatacccattttttagttcacagttctggggtcaaaagcctgattcagactgtttcagggtttcagaaggcagatgtcaaggtgtcaggtggactgggttttcatctagtggctgtagagaaaaatctgcttcaaagctccttctgttgttgacaggattcagttccttgtagctgtagagctgacttcctgtttccttgctggctgtcaataacaagctgctctcagcaactagaggctgttgcaatctgtaattctctccctctccaagccagcacggcacatcaaatccttctcgtgctttggatctctgacttccgtttcagtgaccaactggagaatactctgcttgcttttagaaagcttccatgatgaagccaggcatgcctggggaatctttctttcattttcctttttctgttttcggttttattattattattttcaattgacacataataattgtacatatttatgggatacagtgtgatattttgatacatgtgtacaaagtataatgttcaaatcaggataattcacatattcatcacctcaaacatttatttttctttgtgttgagaatgttaatcatctgtccttctagctatttgaaaatatataatatattgttaattatagtcaccttatggtgccagaacactagaacttattcctcctatctagctgtaatcttataccatttaaaaaacaacttctcaatattccccatcccctcaacccttcccagcctctaataaccacaattctactcttcgttatgagctcaactttttagtttctacatgcagtgagaacgtgtggtattaatctttctgtacctatcttatttcacttaatctcctccaaactcatccatgttgccacacatgacagatgttcattcttaataaattcagaattattttcttaatttcttgtttatggctgaatagtattccatcgtgtatatacggcacactttctttatccattcatttgttgatggacctgggaaccgctctttcttaaagtaaacagtgtcatatgacatgacctaacttaaggcatgcatagcaggggttggggcatcttggaggacgttttagaattctgcccaccaccaatacccatttgacatccttgcagggcccagtggttgataacttgtttgctgtggctcatcactcatgccttcccagccttgtgacaatactttctctaatttatggaaaggtactggtaacagtacaactttactcaaaaaagctcaaaacatatggacgtgcttacactgtcattttaggctatttgttaaaggaagaaaggagtaaacctttaaagttctgcattgtgatctaactctagtagctactattacaattttactttagctttctaatgggagggaattttttaggctgacaaaattaagagatccacatttccctcatggactgtaggaagtatacacctataggcatcatatttgaagtgaaacatgatacaactttggcaattcaggcatgggatataatttaattagttgctaactcaactcccatttgtgacacattacttcctctcccatctctactaaagggactgaaaaagcagaatgatcacttttctatacttcctacagatagggaggtacatttctggcaaatgagatataaattaaagcctgatagaagctatcaatagggctttatgttttctgatatggccaataatgcccccttattctttttctaaattgaaatcatgatggctggacatgcagcagtcattttgtggccacgaggaaacaagcctgtgagaaatgctaagaaaaggatagccagatgggcctgacatgctgcctcttaacagcatcaaactgctgaaccaacaccagtaactacctacttcaaagttctaatgtggaacaaaaaagatcctgtttgttgaaattagtcctcagaggaaactttttttaatgtaaagggtcagctagtaaaaaatgtatgctttgcagaccataggtctttgttggagcttaaagtctgcctttgtaatgcctgaagcagccacagacaacatgtaaagaaatgggcctggctgtgttctgatataactttatttacaaaaacagaaggtagacctaattggtccataggctatagtttgcttgggttttctatgatttaaagctatacaaatttctagctgagttcgtgaaagtataaagaaacctgaatattatgaaatatgcctaaatgcaataagtgtataggtgaacgtcagccaaacatgattggcagttaacttgtagatctcacctagggttggtctcaggtttaggaaagtaaaatttcctagcctttttgtaacaaagagttgatatatattaatgactgtacaaatactctttttcatcttccttccttccttccatctttctttctttctttttctagtgtagtaaagctcagctgcacaagttgagttaatcatattacttagctatcatcagtggtttctataatatttgattaatctgttttattcctattccttaatcccattcatctttccatctctgtaaacaatcattacagtgagtttgatggaaactttgtattttatataattcttacacatttgtactattgatttcttgtacacttactgcattgttaactcatgtacctgctattatgatataacccttattctgtttcttatttttactcagcttgcattatggcttttaagatccattcgcatttctatgtgtccattttgccagttgcttctaactgttacttgatattccatggtttaccttcaccatattttacttttccatttctcctagtgatagaaactagattgtttgcaacttctcattatctcaaacagtgctgtaattaagattttgtatcctctccttgtgacccagtgtgagaaactttggggaatacatataaggaatgaaataattctgttaaatatatgtagataacttacatatgtactacagatggttttccagaatggcagttcattctacgtattcacctggtatgtgaggatctctgtattctcacattctcattgatgcctaccctcattcattaacttttccaaatctgatgggtgtaaagtcatggtcaacagtgttttaacacacatttgtaattcttaatgagtttgagatattcttcaggtgcatggttgctttcaggttttattaatccaggaattaattgcctgatatcatctgttttgtttttttactggagtttctacattttccttactgctttataaggtttacttgtctgttttaagcactagactcactttagttttacacattggaaataacgtctcacttgtattatctgtcattaactttgtgtatggagtcctgcattaaacagaaatctgaaaatttgatatgctcaaatttttcacgggttgagctgctgtagtttactttaagaaatacttccccatcccatacacggcaaagatttcatcataggccaggcatggtgaagcacctctgtaatcccagccctgtaagaggctgaggcagcaggatcgcttgaggccaggaaatcaagaccagccaggcaacatagtgagattccatccatacaaaaaaaaaaaaaaaaaaaaagcgttatcttaaatattattcaattgaccttaaagttttggctttaatatttgggctgggcgaggtggctcacgcctataatcccagcactttgggagaccaaggcgggaggatcatgaagtcaggagatcgagaccatcctggctaacacggtgaaaccccgtccctactaaaaatacaaaaaattagccaggcgtggtggcgggcgcctgtagtcccagctactcaggaggctgaggcaggagaatggcgtgaacccgggaggcggagcttgcagtgagccgagatcgcgccactgcactccagcctgggcaacacagtgagactccgtctcaaaaaaaaaaaaaaaaaaaagaaaagaaaaaaataaaattctaaagactccatcaaaacactgttaaaacagtatcaaacgaatttagtaaagttatcaccatataatttttaaacatttttcatatctgggttttttcttttcctttcacttttttaaaatcagggttttttgttgttgctgttgttttttcgtatgagatagagtctcacgctgtcacccaagctggagtgcagtggcacaacctccacccactgcaacctccacctctgggttcaagcgattcctgattctcctgcctcagccactcgagtagctgagattacagctgtggccaccagcccggctaacttttgtatttttcaatagtgacgggttttcaccatgttggccaggctggtcttgaactcctgacctcaagcagtccgctcacttcggcctcccaaagtgctgggattacaggagtgagccaccgcgcccagaccatatctggtttttgcatcaatattaaaccagactcaaatagctaagcagcttttgcttttttttttctggactatcttagagaagagattaattcactgtcccctaaatgtttggtaaattcaattatgaaaccatctggaaatgggctcttggaaaatgaatatattgttttactcaagttttctgtttttttttctgctgacaattttgatattttatattttcctagatatacagtcttttaattgatgtttttaagttaattaatatatagttgtttagaagctgtttattactatttggatttttctttgttcagttttccccttttcatcctgtacttgatttattcctaccttctttcatctagcttgccagaggtctcttattaatcatttcaaatggagcttttgtttagatttttttttcatttcattgatttctgcccttatcattattatgtctttctttatggaaatgctctgttgctttattttaaatcacattttcagttgaatgtctaaattctttgctgtcaacctgttttgttcattaaaaatatttttaaagctacatgttttcttaaattgtaatatatactgttcaatttttgttaaactctacatgttttgtaatttaacttataatttccttttaactcatgttttttagaaatctgctatttatttttatatatgtagaatatttaattatcttattataaattttaattgtattatggcaataggatataatttgtataattttgttcttttgaacttactaagacttttttatcaccatcttttcagttttcacaaatattccaaatgtgctagaaggaaagtgtctattttgtttgctgttgatagtggatgtgtgtatatagggccacatagataatataaaatagcttaaccgttttttaatttcatataacttccatatctttgcttatgagagtgataggtttactgcttaacttccttgtcggataattttgtcacctgtgattaaatataatgtgtcttttttttcactggacagtataatttactggacaaaagtcatgtgcttccaaaaccagttagggttgtgtgtagggatacactgtactgcttttagcgtctatgtaatcttgcctgagaactaagttgaatgggttgtccatgatttgaacttgaataacattcatagactgatacaatgtcatcacatgcaagcagtttctcctaagcttttccatttttatttccacttagaacccagcttgtgacacttttaaaagttgatgtatgtcagcaatctgtccctaatcatagccttgtatcttttgaacagctgcaacaacatttttaaggcaatgatctctcaagctgttgtcagtgtttttcatgccaccagaacttgatctctctatattttctgtcttatatataatggtaggtcagcaatcctggccaactcatggtagttcttcccagctgtcagatgtgtgcagtaaacagggaacttctttattaaacgagtaaacaatcctgttttgattccagaaatgccaacgagaagcagttaccgaaaccacaactagcagaatgacttgcttaaatattagccacgtattttctcaagatctttgtgaaaatcccaagtttatgatgatagaccacaggagtataaaggagctttttgacaaagaaatgttttatctgtttgaagagggtgacccggagactcctcataattttattatgggcaagagtggacctactggctgtcttctccagggtcattcagcctagcatctcaggttgacagcaggccctctgccgtgctactcttttgttccctgttaatgtgcccaagccagaaaaaagtaaataaataaataaaataaactatgattggttacaaagaacagagcaagccattccctctgaaaaattcaggacttcccatctgaacgtttgaatgacctcttctgcaggtggatgtccccggaccctactggctagtttcccagtggagaggaggtagccccagagggcagatgaagagctcaccagctcagtaacaggtcagctgtgctgcttgctgcggcccccatcagatagcagtaaattatttttccaaagagaggctttgtgcttagctgcgttttccctgcatttcctcctggggccccgatactgacagggctcgttgacaaggagctcttgcccgaatggaacttcacctcccacaggctgcccatcaatcacctgcccagcctctgggggaggcacattagagagctgtgtggacttcctagcaatcaaaaataaataataaataaagaataaaaaaagaaaagcatatttaatgccttcaggtgacactgaataagcagggatgtatcccttgcttttaaagaaacaaatatcttactggagaaatggggctatatagaaaattttcgtggttgtctttctattttacgttcatgtaataactaactctaatacagacggcactgcttatcttctcataatctgtgtcattgtagtaattggggctggcctcacaaattaccaaaaacttggtggcttaaaaacacagaaatttattctcttacagttctggatgccaaaagtcagaaatcaaggtgtctgcggggccacactctcccaaagcttccaagggggtctccttgcttgcatttttcagcatccagtggttccaggtcttccttggttagcgcaacataacttctatctctgcctccatcttctcagggccatctccctgtgtctttgtctcaaatctccctctcctcgtctcttgtaaagacacttgccattagatttaaggcctacactaaatttagaatgatgtcctctcaaggtcctcaattacatctacaaagaccccttttccaaataagggcacatacgcaggttctagggactaggacttggacataccttcccaggacccgctgtgcaacccattacaataatgaagagatttaagtttgtccatctgctaggtaaagccatagtagctgtatagtatctgataatatccgtgtggtaaaattgcagctctcaaagtaagagcgatgttgtaactgactgagttgttttgtgaatttttgtttttggagtcagtggagcatgttattagatgtaaatttaaacacacacacacacacacacacacgagaagtaagtgccaagattttctacttcggcgcctatatttctatatactgattttctgtatttcccagacttgaatatagattgtctttctgttttatcatagacagtctcataataatttaggcataataaggtaatgaggtttttctgggcttcttttcatcatccctgcaatttgagtctcttttatagttgaattcttctctgtaataacttcttgttttagctggtatttaccattgataaatcacatgactttcagaataatggctattgcatgaattggtggaaaaagtgtactagcctgagaactaagaaatttggcccttattctctctatgacattaactgtatgatagagaccaaaatcaggatagccattttgccatttgtaaaatgaggcaagctccactctaagcttgctttatcagttagaaattttagggactgtgaataacagaaacccaacacaaacaagtttcaaatgtacattattacatattatagcagaaaaagaaactggcttcaaggttgcttgattcggtaactcttgctaaacagttaaaacatgtgtgtttttcctctctctgtgttcttccatccttaggattgcctcatcctcttcaatctagtagagtggcagctgtagcatttcttagttatgacattccgatagggcagcagcactagagaggaaggctggttttatcatgaagctaccactaggagacttctagtcacatcacattagccatgtgtggctcatattcccttttctaaactaatcacaggcaaggaaactttacccttggaataatgagttgtactgagatactagggctgagagattcccaccaggacacacactggctgcttgttggaggggcagataacggaacaaaatcaggttctggtaagagtgaaggaattggagctggatgttgagtagacagccaatggagagagtattatagttaattttaattctaatatcattatgcatataattatattataattatattgatataattcattttagatgaggcattttataatgtggtttatgtcaaagatgtaaaagattaagcttgtaattattaataataaacgtattgggatagtcaagtggtgagccatgggagaattgtgtcagagcacatgtctgtcacaggtagctttaagaatgaattaaattgatttctttttttgtacacattcatttttatcagcaacaggaggcaaatataaggaagcagctactggaaaattgatataaatttagttggaaaaaagcaatagtaaaatttctatgcaaatttcatgatccagatattgaagcatataatgtatgaggtaatacaaatatttaaattattgttatgaaagcttaggattcaagcatagagagattaacctatatttattgtaataacgaaaatgcagtaaaattttcattttcttttcttagtagaaaataaatattttccatcctaataaagttgtattaaacttgctcctagaaggtactattttactctcaaaagtaaaatctttgacttaattaaaacaaccataggagattagtaaaatacccagattaataagaattattagtaagattagtatgaaagaatagtaaaatttatgttctaattcatttgactctacttgaaaaaatctagaaagtaatttcacttttcaaaagataggtttaaagaaagaatattagtgctttaatggtcagataatctaatctcaattatcatgatgcaaactgaaaagaggcacattaaagctaataattatagtaaatatgtggttttgcctatttatgtatgtagtaaatagtgtaaatgcaattgtagtgagtaagatctgcattgagtggtaatattccacttaatttgcccagttaggctaaaagaaaagatgcataaaataaatagcatgatgtttttaaaatgcacagttaaatataaattatatattccaaattttaccgagcatgcaaataaaataactgaaaaacttgggcttaactggagaaaatatcgctatgtccttaagcccatatcatatacctccacttaaatggtagtaatggtggaacaggtaaaatcttattaacctttttgaactaaaattgaagcaaagtttctctctgatgtttgttcttctatttataactcctaaaatatctaaatatgccctccctctcacagcatataccctaagagaataaatcctattcttcagtctttgcttctcccataggctatgaaaggaataatcacttaataaatgcctagtggtcttcacagtgaacagcacactgtcaaaactcacaaatgaataagtaaataaatcctatgttgaagtctagatatgcaaagaactaagtaaatgacattaatgaatgaaaattaactatttttacttactgtgtcctgcataagaacacaaacggatttcataatgagccagaagcatctgagtttagatcaaattgccaagttctagagaaaaggtctgtccaggaatgaattatgaactctgtatgagtcactcagggaagacctgcccattggtcttgaagaatgattgttagtttgatagaaatatgcgagatcagcatactccaagtggattattttgtgaaaaccttcctaacctttaaataccatgctttttattcaggaaaattgaaagactttgtatacggctggaacttagcttgtgttgagagttggaaaaagatgagattagatgtgcaggtagcaactaaatcatggaaagccttctagttcttgctaaagactgaaaatttcatttttaagatgttatcaaataggcttaggtccttgaagggcatgattaaatgtatggttaagaaatattagtctgaaaacagtgtgatcaagataatgaaaggtgaggaccatggaggctgatgggaacataatgaaaatatttcggaagagaaagagtgagggcttaaatgagtcactaatgtgaagaggaaggaataggtaggagaatgttcaagaagtagaactgacaaaatttcatgacagaacagatgttgtgggtccaggaggaggttatacatggaaaagtggatctcagagtggtccgtgaaaacaacaccctttcatcacaatgcttctgtgttacttgtcttttctactggttttcattttcactgttttggtgcatttgcaacagtaattaaaactataacatccatcaaggccgtggctccaaacaatagtagcagttatattttttacaatcatgcagttacctaaataagtaaacacacaaataaacatgccaattttattctcattttacttaagaatctccttgatgaagtagtaagaaatactaattttacatctagacttccaagtgtgtctttttaatattctacttgacaaaataaatagaactcataggtcacttctgctgtatactgatatgggatggctgtcttgaggagagcacatgtgtgatggttgaagtcacaagcctaacagttacttaaagaaaaaaacagctattttaatgaatgaatgactgacagacaaccgtggtcattcagactttggtatttgtcacgtatgttctcaaaaatgaactaagggagtcttatcaaggaaaacaactgagtgcttactgaaaatttgaaaatttaagcttgcaagtaaaaattaaaatttgggaatcttgtatctgcatttttcaacttgacaacttctcaaaactggacttttctgaagagactaaggtcgatattaaatatttttttaaaaatatgtataataaaataatgtcaatattgggaaggtttgcataactgagtaaatcagtattttcccaaagatcattccaagatgatacaaaaccataatggataaaagactcattaaaagttgaaactagacctatgaattctaggagtaggaaaagcatgtgacatggtatcagactccctgttgcaataaccttcaataaaacatttgctgagcttagagaaagaatcaaaggagactaatataggttagttgacaagttcatatctgtataaggccttattttcttcatatgttcttaatcaaaagaatatattaaacagattaaactcagaagcagatatgagtattaagctgtgttgtattaagccaggtatttgagttttggaaaaatgcaaaaacgttgacactcctcttcgtactatttgggaattattttcattttaaaatgctgtttgtgttggtattaattcatttattattttttaaacacataataaaaatatttaagaatgtataagttctaatatctcttatagaaatcactaacagatataacccacatgaataaagttgggtaagagtaaggtttgggagttggtggcttttgtttttcttttttcttttttttttttaaacttaccctttaaaatccaagtgtcatgtctacaaagaagtggcagaacccacaaattaaaataaagatctttcttcctctctgctcccttaattctgatttttccttctttcatagggtttactagagttattttttattttcccactccaaatcaattatgaaatcctacaaaaacaagatcatgtgtttcatctttgtctctactagcaccgtgaattgcttagggatttctctttaaaatgacaattaaataacatctgttagcagtgttgtcatttaggtaaatttatacttaggcattagtcttgtcatttatcagaccttaatattttaaatttttcatcatggaacgtattgatttggatgtgaacaacctgaattattttcaagtaatttttccttcaattcaattcagtcaacttcatatttacttaaaataattaagtttaatgcttttattaaactttaatcagtactttatgcttttacaaccatgtgaaaaatcaataatttaaaagtacatattatttttaatgatgcaataatttaccgatattgaaaagctcaaggatttcacaattttaatacatgttgataattttttatgttacattgacaggttttagactaataaaaacataattttaaaacattttagaaattttaaaagctttctttatgtaagtaaatacagagtttcccatgatagtcaatccatatagtattgacagtaaaaaaagaaatgaagataggatattcaaatacattagatcttgtcctaaattttcatggttaaaatttttttttaagtggaatttggttaggcacagtggcatgatggatttcatgcttgtaatcccaacactctgggaggccaaggctggaaggtagcttgaggccaagagtttaagaccagactgtataacatagagagagcccatttctacaaaaaaattaaattaaaaaaattagttgggcatggtggcacacacctgtagtcccagctacttggaaggctgaagcaagaggattgcttgaacccaggagtttgaggctgcagtgagctgtgatctcaccacttcacgccagcctgggccacagaacaaggccctgtctcttaaaagaaaaaaaaaaaagaaagaaaaaagtagaatttgatactcttcattatatttttcttttctggtatctgtttaatttcttagggtacatgctgaagtggataacatcacactgttgatcaacaatgaaaaaccttgcattattctaaaaactactgtaacaatgtgggcttgaagaagctgtctgcatttctaaatgtaaattttacagaagagcaaacactgtgtttgacctacatcatctgtcagatatcctaaggctctgaaattagaaaatccctggggtttgctgcattttgctaggctatccattagcttattttgtcaatttttattataagaggacaaaaaaatagaaatcacaatatctgttctaatattcttttatatttgcaagtaaaaacctttggaaaaggttctcaaatagatttataaatgtttttattatatggtacatctagctattatatgtaatgtagtttaacagtatatcattcttgtgtttatctttttatgtaaattcttaagccacacataattttcattaagatcctttgttcaggtaaaattagtagcatttgaaaatggtatatcttttcaaacataacttcaatttattttgttgtaataaaatttgttgtaaatatcacttgattccattaatcatttaaaaattacaaagttaagctttatttcagaacacgatttaatgtgcttaaaatacaacccgtgaatcactcttcctaaaaaacttcatatttctctccagggtattaattctcaggaactgtaagacattgatgtttattttttttttttactgaaagggaaaatgaatgttttcagatagatggatggacagatagatagcaaattgtatacacatacatgtacacacatacacacacatgcacatatatacacacatacatacatacagatacatgcatatacaaatatatgtatttttatatataagcaaacctctttaagtattttacttaaaatcacccatattacatattttaatttttcaagataattttaaatgagataattacaaatagggagaaaacaaatataaataacagatatattaaaactaattttctaagctaaagcctttcctttaagaactgacataaaaaaagaaaacctactttcacccctcctattctacatagcactagaagtcctagccagagcaaacaggcaaaaaaaaaaaaaagaaagaagaaataaaaggcatccagattggaaaagaagtcaaattgtcaaattgtccctctttgcagatgagatgatcttatattttgaaaaatgtatattttggcctcacacagtggatcacacctgcaatgctaacactttgggaggtggaggcaggaggatcacttgacatcagaagttcaagaacagcctgggtaatatagtgatactctgtctcttacgtgaaaaaaaaagaaaagaaaaaagaaaaaggagcacctaaagactctgccaaagtggatttagatatgataaattcagtaaagttgcagcatacaaaatcaacatacaaaaagaagtggcatttctatacaccaataatgaactagttaaaaaagagatcaagaaggcagtctcatttacaatacctcaaaaaataaaataaaatatctaggaacaaatttaaccaaggaggtgaaagacctctacaaggaaaactgcaaaacactgatgaaagaattgaacaaatgcaaagacatgccatgttaatggactggaaaacttagttgttaaaatgaccatactactcaaagcaatctacagattcaatgcaatccctatcaagttaccaatgtctttttttacagaattagaaaaacaattgtgtggctaatctaagcacaacagttttggcactcactgagtggaaaatttgttcaactttaatttttctgtcagacttgtataagctgaaccaattgagatgactgtgggtttggctattgttctgccattaattgttggtctttcttaaggcaagaacaagatgatttttttccctcaaaaattgatgtggatgatctgccactgagggcttcatcttgaacatcatcttgtctcttcttaaatagacttatttatttgtaagctgctgatttctttggacattgtttcccataaactttttgtgaagcatcaataatttcatcgttcttccacccaagctttgccctaagtttgatgtttgtctttgcttcaattttagcagaattcatgtttctctgataggagttcttttcaaactgatgtcttatccttcttagtgcctcaaactagagtctatttagatatgttacaacaaaagttgatgagtttatgtgaatttatgagttatgagattaataatttattttggtgcaaaaaatttttaatccatgcgtagttttttcactataagcattttctatgaacctttcaaagacccctcatatatactattcattctgtttctccagagaagcctaactaagacacacggcttagagatttttgccctagaagaataaagctgaccataaaacagagttctcagtctctttccaaaaacacctgacttcattttcaaccgggtgtggaaaagtttaagcataaggacactatacaaaagcacagaggttgtgatgaaaagcaattgagagaaaatgataggtatatgagagatataagctaaactttaggtcagcaagtttgctggacaggacctggaacatagacacctgggaggagcccatctggatttagaaccaatgtaaaacaatgacctcaggaactatcactttaaaagatcccaaattggattggccccatatgtgaagtaatatatgcccccaggatatttttttaaaaaataaagaaatcagcctgcaaatagtggagctaaataattgggtgtggtcatggaaagaaagagtgaaaggtagtcctgattaaactactgtcattccagatccagaagctcaattaactcaaagtaggataaatgcaaagtgatataccatcaggaatgtcatagtaaaaatactgaaagacaaagacaaatggaatatcttgaaagcagcaaaagaaaaactgctcttcacttacaaaggaaccccaataagattaacatctgacttctcactaaaaacactgtagactggaaggcagtggaaagtatattcaaagtgcttaaagggggaaaaaaaacacgcccacaaagaatcttgtattcttcaaaaaatacgatgaaataaaggcatcgtgagacagactaaaactcacagacatgccttacaagaaatagtaagtgatcccagtccaaccgtaacaaaaaacagtatcagtaaggtaattataaaagacagtataaatgcatatttatttttttcctctgaactgacttaaaaggcaattacataaaacaatacgtatataatgtacttttaggcctataacatatagagttctaatatatttaccaataacaacacaaaggaggtggtggcagcaaagttgtatcgactatggaaatgacttcagatagtaactcaagtcaataggaacaaaagaaaagatacagaaattataaagaaaatgttaatgtaaaaagcaataaatatacacttgatctcctctcagcttctttaaaagatataaaattatataaattaattaaaattataaatatgatgtaatgttgggtttgtaacatttatattaatagatgcaatatgtataaaaataatatcacagtaagggaaaaagctatgtagatatgagatttctatatttcactggaacacaatatcaatctaaagctaattctgatatgttaaaatatttatggtaaaccctagaacaatctctaaggcatgtagttgattttcattattcattgtagttatggtctataaagcctctgcaaacattcagttgcaaatcatgaatgaattaatgaatgacctctagtcacaatgcttttgttaactgatcattatattacctcgttttattgttgctctttaaagatatctgattgctaataatgaacttagggcaaacagcactgtacctcatgctgaataaagcttatctaacacatgtattttctccataaggggtatcacagtctctttaacttagggacactagacagcagtttagggctgcacttggggagccatttttaaaagtgtagtcaacaagaaaaatcacaaaaatgcaaaagccatggctctacgcagagcatgaaaaggacatgtgtctacagtatgaccacaaacacaataagacacagcatcgcctgctcaacctcagctggaagcgtgcacatctggagactcaaacgcctgctcaacctcagctggaagcgtgcatatctggagactcaaagttttcacccctctgcacatgcacatgtctacaaatgaccacagatgtgccatgtgtatttatgttggggttgtaaatacatttttgcaagtaggtgaattcacagattcagaaaccacaaataaagatgatcaactgtaactttaaaaaatacctgatgacttgggtgattttccttgacaagtaactttcagccactctctgtagtctccattccaacatatccaattgctcatttccatccacattatagattactcgcctgtgatttttaggtttttttgtgttcttattggggatcttagtctagtctacatagtgtaatgttaaatacagatataaatgcttgctaaactaaccacacttaatattaaagataataaaatattatttccttaggaaaatagatcctaaggaatattacttaaatattgattatatttgtattatatattagattatataactataatatgcaaatgtgtatataaatatgcatgtggttaattattgtgtttataaaaatattaatcagcaaaatagccttgaaaaagctagttatatcctgtaaaaattctacatttggagaagagaaattaaagcatagtcaaaaggtaatgaatttattataagatcatataattatagatataatatcataggttgtcataaaagaggatattaacttgctgtttactatgctagttaatcctgtcttctttctgttaacagtatggatctagaaataagaaatcttataaattagaagaaaaaattcgcaccttgataagcagattttaaaaaattaactcattgaatattattattgcaatgttgtgtttgcagagttgttgaggaaatatacatttgtttgtttctgttgactgcgggggaaattaaagatgcacaaattgtagcagaagatcttgtaccaataaggagtcaacatccaaaatacataaggctactagatatttattaattgcccaataaataaattgttgttaacctgggtgcataaatcttggatgggctttggtgggagaagtggtgtatgggtctgtgaacactatgagcatttttctggagagcaagtctattgctctaaaatgtaccttttggagcaatggacttgctttccagtcacttttctgacagatatgtgtcagttgcctcaggaccataggcctacaggaaatttgcatgacaggtgaaaattaagagagaggagatattaaatacaatcaatattcagcagatatttaatgaaaatcctctgttataccacaactgctattatttgccaggtatatgcttttaataaaagcacaaagtccatagaacccttctacataatgtgtaggtcatttcaaaatgcagcaaacaatatagtctgtgaccaaagttaagggcataatagaagacattttgtttttttctttactgtttttggctaaagtcaattcagaatgagtacaaatatcccgtggaaattcatgtaagactgtgataacttatcattttgtttcagcactccaacatacagcatacatactgtacactaagttaaatatattttttctttcaaggtaactgaactgcacaatatcaaaaatataaccagactgccccgagagacaaagaagcatgcggtggcaatcatctttcacgatgaaacatcgaagacatttgcctgtgagtcaggtaagctattattggccatctaccccttgaggaaattgagctgcttgtgagacaatggcccaggcggattaaggtacactattgaacaggatggcctactgtcatgagaatgtgctgtagaagacttcgttcagaagctcaacgtattgatttctacagatgtttttgtgcctgttgttacatgtctgtgtctggatttggctcccaggtggtctgcctgttgaggtttccgttcaagctttgagaattaagtaaacaatacctggcaggtgttgttcgggtgagtgcatgaccaatattctggttcttgctcattgtgtctctaggcattttgtagggcaggaatcagggtgctgtgcaaaagcatggcagagcacagccccagtccgcagacaccacaaaacagaactttgaggaatgtattgttttcatggattctcagtactacaagtaaatacatttcagattgaattttagcatctcagttcgtaaagcactctgacattattgagacacaaggcagtttatagtttgaacttgcagtatttttcatgttggaatccctgtggtgtgtaatatattagttggcttgtcactttttaaagattttgctcaatgcaatggtgcattcattttataatggatgttagcagaaagtaccaagggtttgcaagatgtgaacttaaactaatgattaggtctttaggagaaattttattcagcattttaaaaaagtaaaatggtccttctagttttgtatactttgtttatggatgtcattaatgtcaggttatattattctaaaactgataatatccctttgcctaactgaaattgctcacacctctcaccgaccttatcttagtatggctaaactgaactggaatttatctccgtgttcctcttttcttgcgtgcctttatccatctgtcccggcatatttctcttcacttgccatctgacctccttgcatcatttaaaatcgacattttggagttgcacagaagcctgttaaatgatataaattcccattttgtaataccccctgtcccaaccttgctggtgtaatataatatcatccaatgatttttctgccttcctgtcagctgtcttaaaactggtaaaccactttatttttctctgggctcttaatctctcatattaaaactagtatttaaaaaaaaactaaaaggtaatgtttaatatttaaatttctaattttcccaattactgtacattttcaaattgtagtgagcaatattttgaatgtataggaaatactggagcctattaatttgttaaagaatgatatttggttatatttctttatgtgaaaatcttatttatgttgtgtttggaaaggtattgacctaaaattcatgtttagttaataacttaatcattcaatatattgctgctttcaatctgactacaatcttgaatccgatattacagtagaaagtcatttaatgcaattttatgtatttatacagatgttttttgatttacatcattataatctactctccatttaactttctattggttgtagaataaactacgcttgagaatattataaagcttacaagattctgccttttcaaatttctatattcttggaagttagagaaaatacatattcctaaaattttgtctaaatatctttgctgctccatgactcttttctgcctcatttatcctggtatcgcctgaatgtccttgccctcatagatcacagaatacataccaatggcccaattgaaagcaaagctctgatttacatcctgatacttagagcattttaatagaaaaggtgtattatttgaatagtacatttgagttctgtgctcccatcatctcaagttcttagtttataaatgtcagtctctataatatatcgatattgatctattaattcagaaactcatataaacatagttgaaattcagcagtacttgtgtttatatactatatggaaattctgaagtatggtttgttgaattttgttggtctatgcccaacagaggaccagggtgttcagacgggaagtgtgataacagagcagcgcccaactcccaaccaggggctggagtcagagcaccttatcgttacacaaggttctgtgcaaacaaaacattctccctggtgcgttggcttaacaaaagcatttaaattttaatttaaaggccatcaagatttagaattttaaaataaaactcccaagtacacctagcatccagatctttcttggtttttagtaacaggaaccagggcttcttggagaaatggtagattctaggaccggggcatgaaatacacaagacgagcccagagcatcttgtagtgccagaaagtaaggaagtaccacacgaatgcttctgtatgtcagagggacacaggagttcccaatggccaaagatggaacaatttgaatactaaaataaagtagctaaggattataacccaaattataaatgaatatttatgagtccatgctttagcaatgcttgatgaataaatacataggagagtatagaaaaatatcccatgcagaaaattgcaaataatttatgtagatgctctgtccagaggaggtggagcatgactccctgtgccttaagtgggggctgttcatagttacttcctccctaggagaataggatagaaagggatgggagaaaacagctttgtggtggagaaaactgacagacactgcctcagccaggtgaccaaggtgaagatcaacaatgataaatcatgttgatagactctacccttgatatgacgtgatcaaaaatagcactttacctctgtggtcttcatcctaacaacctataaacccatgagaataacatcagacacatcccaatgaagggacattctacaaatacctgcccagtattcctcaaaactttcaaggtcattacaaagaaggaaagcctggaaaactgtcccaaccaagagggagctaagaaggcctgatgaataaatgtaatgtggtatattgatgggatcttgaaaccaaaagaggacaataagtaaacactaaggaaaacttaataaaatgtggtgattagttagtaaaaatttatcaatactagttcattaattttaacaaatgtaccatactaatgtaagatgttactaatagaagatagatataggctatataggaactcagtattatttttgcaataattctttcaatctaaaactataccaaaatgagatttttttgtttaaaaataatgtggaagtgaataaaaatatatcgatgacctacagtagactcaagtataatagaaatatagtgcattatcaaggatatattaaaaattagtaaagaaaattatatcttacaaataactggtgtttgaaaaactaaattcttacaccatcctattatagaatgctttcagaatgatgaagtgatattcattatttctcaacaatggaaatgacaatactaaaatcattgccactgttcagtggcttgataggaaatgttagatgtttacctagtgtcatgaacaataatgaagaaccagacttaaagttgtattgtgagagtcccatttttcaatgtaggtgattcagcagaaggctgagcctaccacatgttcttttagcgaactgagcactcccttcagggtcattttagaatactgttttattgctaactttgaaataattatcgaggccctgcttggttttctctgaaatgctgctgtgtgagcttaccacacatctgtaggacaaatggaaaggttacaagatggcttaccttttgacactgatttcatagcgcaaaaacctacccttgtagcccctaatcctacaattcagccggcctaccttacagagtgccctgtagacatttgttaccagtctatagatcatgtaaaacctataccagaatctgctcatcacagttattgctaccatgttagtctcttccaaagatttctagataccctaaaatatggacatctgccgggcgctgtggctcacacctgtaatcccagcacttcgggaggccgaggcgggtggatcacgaggtcaggagatcgagagcatcctggctagcacggtgaaaccccgtctctactaaaaatacaaaaaattagccgggtgtggtggcgggcgcctgtagtcccacatacgtgagaggatgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaggacatctgtggaaaactttactcagttcttgttgagccaaaaagttgacattaaaatgcatgtatttgtgaagcataagtttagggaaactattttggatattaagttattatacgatttattctcagtgaaaaacatttataaagaaataggatcataattttattttaactaggataatttcaaaatataagcatcaaattagggtcattaatagcattcttcattgaaaatgacaagtagtggtctcaataaatcacagtgataatttgaatccataatttaaactgaaccctgcaattatttttaatataaacagataatttctatatctgactttgaactttcccattatcaattaccagtggggaaaaatggcttatttagtatactaattaaggaatttaggattagtataaccacaaaagacaaggttctgttttttaaaaattttcgaacacacagaaacctcttgctaacaaagactgtttcttctcatgtctgaatttcacacgcacaagtctgaaatgtgaaggtttcttaatgttggttttatggttcgtgtaagatttttgggaaatgaagggctcttcattaggataaaatggtcttaacttcccagagaagaatttcctgacaacgtggctgaagttagatacaaatgttaatatagaagaatgcttttatttgaatttctagcaaatggttttcaactactttaaatatgacctacttgaaagtattatttcttttttaaaactactttttatgtatagatctaagtctgcttgaagctagtagttaaagtgtttgagaaataaaggcaagattttttttaattgtctcaaccttcatgacacatgctgatcgggataaaaaagaacttgaaaatcataatcaagaaattttattactttgtaatgcaaattatttttagataaatgttaagctacagtagtttatatctgttaataaaatttcatcctccaagaaaatgctgtgtcaagtagatattgtatagattattaaatactcaaaggaattgccaagcaataacaagaaatccactttcattttatttgtataaatttgagggtacaggtgcagttttgttatgtgggtacattgtgcagtggtgaagtctgaagaaacccactttctaaagtttaatgagtgtcgcttctccttgtcagagagagtatctgcaccatggcctctggatagaaaatttcaaaaaatccttgtagttttttgagacccctgttaggagagatccctttgtgtgtgtgtgtgtgtgtgtgtgtgtgtgtgtgtgtgtgtgtgtgtgtgtttcagaatcagctgagaccaaatcattttgcagcattcaagaagtattggtcatttttaaaagcttaaacatacaaaatgataaaaagtaacagtaattttactgaaacctttctataaggttaggaaatgtattaataagagtaggaaatgtattaatccaaaatgtcctccctgcagccccatgcgaactgacctgtccgtttaaccaaagaagaaacagaggtactttgaacctcagcacatgctcttaacaactaggtcacctgtacaagttttcacctaagtcctgatgctaattaccaaacgtatattcacttaacatagatgacagtcatatgctgtcttttccttgaggtctctccttaagcacaaattattactaagtctaggataaaagttaaaacatcacttttttctggtggatgacttgagaaatgaaatgtaacaacaataaaaggtagtataattttcaatattcaggaaataatcccactcataatctaaagaataaaaattatattattatattgtcacagaaaaagtatttcacaatattcaaagacattcatgataaaaactatgagaaaataaaaaatagatgggaacttcctcaacttgataaagaacatctgcagaaacctaccgctacatcacacttaagataaaaactgatgctttctccatagactgggaagacggaaagctttcctgctctcctctgtgctgtgcaagacagttctggaagctctgttgccacagtaaggcaagaaagagaaataaaagacatacagattggaaagcaatgaatataactgcccattttttgaaggcgacatgattgtctatatttaaaaaatcccggccaggtgcggtggctcacacctataatcccagcactttgggaggccgaggcaggcaaattacctcaggtcaggagttcaggatcatcccaggcaacatggtgaaaccctgtctctactaaaatacaaaaaattagccgggcgtggtggtgcatgcccgtagtcccagctacttgggaggctgaggcaggataattgcttgaacccggaaggcagaggttgcagtaagctgagatcacgccactgcactccagcctgggcaacaagagcgaaactccatctcaaaataaataaataaataaataaataaataaataaataaataaataaataaataaaattcccaaggaattctaaaattatatggaaagaaagacaactctcaataaaatacgtataaaaggaacaaacttcaacagaataatggccacttatgaaaagcccacagctaacatcataatccatgaataaaaactgaaagctttttcttaaagatgtggtacaaggcaaggatgttcacccttgccacttctattgaacatagcactgtaagtcctacccagagaaattagacaagaaaaagaaacaaaagacgtccaaattagaattacctctgtttgcagatgacatgatcctacatgtagaaaccctaagactccatttaaaaactgttaggacaaacgaattcagtgaagatgcaggatacgagatcaacgtacaaaaatcagtagcatttatttatactgataacaaaagattcaaaaaggattttttttttttttttttttggagacagagtctctttctgtcgcccaggctgctggagtgcagtggcgcaatctcggcccactgcaacctccgcctcccaggttcaagcaactctctgccttagcctacctcaacaaggaaattttaaaaaataagcctatctatctaaattgtgttaaaaataacaaaatacttatgagtaaatttaaccaaagatggttttatgtgttactctttcatggatcccagcacatgacaaaagattcctgggtcagatacaataatttttttttcccaagtcccaaagaggcaatgtgattagcccagatggatgcctgcacatgcaatgggtttgtgtcacagttgcagaacccagaaccagaaactaggccctttttgaacaaccagcacatattgcaacaagcagcaaacaagccaacccccttacccccagggggagtgagcagtttcctggtagtcgcacttgatctactttgttgcctttgaaacattaaaactcataaagaaggaatatgatctaatttattttatgaagccagcatagtaacatctgatattattttgttttaacatatttttaactttaagtttaaaaattaacaaaaagctacagcaatataccatagcaggaaaaaggtaaatattcgagagcgatttaattactatataaaggaaaataacaagtcttatttataaacaaaatagatcatttccttggatataaaaaaaattaaaataataaacttcttccaaaacacaatattaaaatataaacctctcccatgttaatactgcattttaatatagttcctacttggatgtcaacaaaattttacttttggagtagggaaaattatttaaaatttatatggaataatatctatgactaaccaaagacaatatgttaaagtctaaaaaattttcaaagaaaatttggaaaactgtgtgcataatctagggagagaccttctttataaagacagagctccaaaactataaaacacgacaactgatacatctgagcctaaaaaatcaaacagctctcctacagcaaaggattcacaagcagagtcactacacaaattagagttttagaataatattggaaatgcaggtaacagataaaatgttaaaaactataatgtgaaaaaacccttataaagtgacaaggaggaaatgttaacaattacagttatgcaaagattatgactaggcaattcacatttttataaatacaaatggcaaaattgtttttttaagaagacttaaattataaaattgttagagatataaaaaatcaaaatgataatgagaataaaaccaagattaaaaggaaccctcagttcaagttataaatttatttaaaatcttataacagcctttaatctattttgatttgatgtttggatgtagtataagataagggtccaatttcattattttctatgtggatttccagttttccaacactatttgttgaatagcttattctttgaccactatgtgttcttggcacccctgttaaagatgagttgactatatacgtgtggattcatgtctgggctattctgttccatcagtctatatgtctgccttcacgccagtattaaactgttttgattatggtaaacttgtagtatatttgaaatcaggaagtgtgatacctccagctttattcctgtttctcaagattgatttggatattcatagtcttttgtggctccatatgaattgtagaattttttttatttttgtaaaaaaagtcattgaaattttgagagggattgcactgaatctgtggattgttttgggtaggatgatattttaacaatattaatttttcaaatccatgagcaatagatgtttttccatttgtttgtatctttttgaatttctttcataaatgtttgtattttaaagcatagaaatttgggaggccgaggcgggtggatcatgaagtcaggaattcgagaccagcctggccaacatggtgaaaccccgtctctactaaaaatacaaaaattaggtgggcgtggtggcaggcgcctataatcccagctactcgggaggctgaggcaggtgaatcgcttcaacccgggaggtggaggttgcagtgagccgagatggcgccactgccttctatcctgagcaacagagcaagactctgtctcaaaaaaaaaaaaaaactttcacttaacttttatttatttaagattttttcttaactattttcttaactattttattctttttggtgctgttgtaaaactccaagaagaaaacttaggggaaaacttttgtctccttggcctagaaaaatgatttcatggctacaacagaaagctcagataacaaaagcaaaacttggcgaatggaaattgtgtcaaactaaaaagcttctaaacagtgaagaaagacatcaacaggatgaaaaggcaatctacagaatgggaaaaatacttgcaaactatctacctgatcagcagttaatttccagaatatattaggcatgtgtacatctcaatagcaaatacataaattatccaattccaaaacagaataaacatctttccaaagaagacatgcagatggtcaacaggtgtatgaaaggtgctctgaacataacaaatcattataaaaatgtagatcaaaatcacaatgagtattatgaaaatgtaaatcaaacctgccaggatggctattacaagaaataaataaataaataaataaataataaaatgacaacaagtgtcggcaaagatgtggagaaattggaaccctagtgtattagtaacggaaatgtaaattgatgcagcttttatggaaaacaatatggaagttcctcaaaacattaaaaggagaattaccatatgatctggcaatcccatttctgagtatttatccaaaagaattaaaacttggatcttgaagagatgttaacactcctatgtttattgcagcactattcacaacagccaagatatggaaacaacctgaatgttgatcagctgatgaatggattaagaaaatgtggaatatacatacaatagagtattattcaatctttaaaaagaaggaaattctgcaatatgcaacaacatggatgaatcttgagagcattatattaagtgaaataagccagtcacaaaaaaacaaatgctgcatttcacttatgtcaggtatctaaaatagtcaaatttgtaaacccaaagaatgaaatagtagttaccagaaggtaggggctaaccaatgggcataaagtttcagttaagcaaagtaaataagttctagagatcttctgtacaacatggcacctctattcatcaataatgtattgcctttttaaaaatctgttaagaaggtagagctcatgttaagtgttcttataacaataaaataaaattttaagaaaggggaaaaatgagttctcacgtttatttcccatgaaaatgtaggtaaaagtatattctcataatggctaataggaatatgaattgttttccttaggttttcaagaaaactgtctattgctattaaataaacatgcgtacccttgattctatgaacctccttgggaatatatctcatataagcatatacactaatacatgaggatacaggtacaagaacattaagtacattatgtataacggcaaaaaaattagaaatatatgcctatcaagaaaacagttgagcatttatggtgtatccttattccatgaagtattttgcaatcactagaaagaattctaattaaatcctttgagaagatttcaatcaaacttagttcttcaggcaaagcaaccacccaagaagtatatacaatgaacacagtccgccctccatatctgcggacactgcatctgtggagtcaaccaacggtgaattgaaaatatttcagaagaaaaataacaatacaccaataaaaaacaatacaaattaggaaatacagtataacaatgattaacatagcatttaaattgtattacatattataagtaatcaggatgcactttaaagtattggggaggttatatgcaatcactgcaggattttatgtaagagatttgagcattcattgattttggtatttgagggtcagagaaggggttccttaaaccaatcccctacgtatggatatttaggagcaactgtcatcacatatttaaaggaaacagagagagagagagagttttaacaactgctacctgaggtaagggaggatgatggtgaggtggatggaaaaggaaaagggacaaaaaaggcaaccaaaaaaagaattttaatttttatgtacccataaaaattaaaattacaaaaaagaaagaagataaaatgagcaaaagaaaacatcaagtatacaatttatcgcattcacatgaaattttgcctatgtgaatttgtgcatgaatgtgttcagtatttttaagtaagttaatcatcaggaaatgcaaattaaaactgcagtgaggtgcatagtgacacacctgtcagcatgactgacagtttttaaaattagccacaccaccaagtgctcgtgaggatgcagaagaactagatctctcgtatgttgctgatgggaaatgtaaaatggtacagtcagtttggaaaactgtttggcagcttctcataaaattaaacatgaaattaccatacaacctagaaattacactcttaggcatttatcccaaaaaaggaaaaagaaacaagtacacgtacacacacacacacacacacacacacacacacacctgaatgtttatactagctttatttgtaagagccccaaactggaaagaactcagatgtccttcaacaaactgtggtatcttcacaccatgaaataaatactcttcaccagtacaaaaaagaacagactcaatatatgcagcagcctggatgaatcttgaaggaattacactaagtgacagaaagcacatcccaaaaggttttagataccatgtgattctgtttacatatcctttcaatgacaaattttagaaatggaggacagattagtagttgccaaaagttaggaatggggctggaaccttggggacaggagggctgtatggtcactaaaaagtaacagagcttgtattggaactgtgcagcattgattgtggtggtgcgtacacaaacctccacaagtgattaattatataaaacttacacacacacacacacacgtataagtaaaactggggaaaccagaataagatcagtggactatcaatgtcaacaccctagttgtcatattatactgctcttttgcaaaatgttaccactgggggaaactggacaaaatgtacacaggatgtctctatcatttctcataactacatgtgagtctacaatcgtctcagtaaaattttcaacaaaaagtaaattaggtatatgtctgtgatcttaaggttgtctatagtgtatatttaagttaaaaaaaaccagggtgggaagacagttgcggaaaaaattgttttccttaggttttcaagaaaactggcaattgctatttcatataattctaatatgctaaaaagaaactaactacaaaaccaaaaacaatcctcaacctgtgcctgtgtggcttgtgcatgtttatgagcacgaagagactttgtgtgcgagggcgcatgtgtgcgagggcgcatgtgtgcgagggcgcatgtgtgcgagcgtgcatatgtatttcttgctcttttctaacatagaggccgtgcatgagctgctcgtctgcctaccccagcctggcaccaacacctcacccaaccgactcctacatttccttccattttcagcgtaaggttctcctgctttgttccccctcacgctgcttagtgtctttgctccccactcccatagtaccctaaagcggggcttcacactctgttcacggtctctctactctggcagatttgaactcagtgaggacatgcacatattggcttgcttacccctgtattcctagcaccacatgctaataaaagtgtgttgaattattaattaatacctgaattagtaaaatttatacttgttttatcttaatgatatatttatattttttggataattatttttttcttttttgcttttctttctttctttttttttgccttttgagacagggtcttgctctgttgcccaggcttaagtgcagtggcatgatcatggctcactgcagcctccacctccctggctcagtcaatcctcccacctgaagctgggactacagctgtgtgccaccatgcccggctaatttttgtactttttgtatagatggggtttcgttatgttgctcaggctggtctcgaactcctgggctcaagccatccacccgtctcggcctctcaaagtgctgggattacaggcgggagccaccgtggcttgcctattgcttttttcaaaacaaattttaaagactatgtgctttgtgcttgtgatgtgagagtgaacaaccagcgtgctgcgtatgtgtgtgtgtgcatgtgtgtgtaaaattggttatggcaaaccaggcctgtggcagtaactctgcaagtaaaacattgctgtatacaatgagaaattcaacattttgcctgttcattaaaaggagagcccttctttcttttactgagtatgtcccagtctcaaggcaatggctagtaaatgaaaaaggagatgacgtagagaaacccaaagtttggttaatagactctgccactggagaaataaaccactaattatttttaaaattaataaatgaagagaaataaagggaaataaaattaatactttgtcattcctttcctatgagcggttctattgaggatccaaaaaaatagatgaagaaaaatttctcttataaaaaaaatagattattcttaccttcattaagaaaaagaggaaaaaagagtataactgtgtcagcatatgaaacctaaaaacttatcttcaaatgattttggacaagtaaatttttaagtctgaattacctgtttaatttcctaaataattacatgaagcattgaatgtattccataatataatgaggatatttttataggttcttccctccaaaatatgtaatggaatatgtatcaattgaataaattcttccacatgaaaaattgtaaaaatgaatttgggtaaatcccagatctcaatatatttatatatttataattaatcttttattttttattttattattattatacttttaagttttagaatatttttaagttttctgagtattattacctcatacctgaaatacctggttatcagcttatcacattgcagtttattcaaattttatttatcaaattctatatctttatttcaaagagaacatcatttactaaagtaacaccttttccccataacgatttgtgttaggtgatatatttgtatcttacaatattatcactaatttttctaagaatttttttccagaggaatctctgtagttttctgcttctcagacttggcataatctttcctaccacaagtcatctagaaaagatgctgtccaaaatcatccttgaattcaaaaaaaatcatccttgaattcaaaatgacaggcagtaggcatacatttcaacctttattttcattagcatttttcagttttactgcggcatagttagcaagtaaaaattctgcttatttaaggtatgcaacttgatgtttcaatatatgtatacttcataaaatggtcaccacaatcaagctaattaaaatatctgtcacttcacgtaattatcactttattttttctttgtgtgtgtgtgtgtgtgtgtgtgtgtgtgttaagaacacttaaaatctaccctgttagcaaatagatgctatcacaaaacctgtattggtttcaatatgtggcgtagaaactgtaaatagaaattaatttgttttgcatccgtgttacagctgtagacactaaacaaataatccatacttagacataggtgaatggagcctactgtaaagtccaattactattcattaacattataataaataatatatatgtatatacacacacacatatgtgtgtgtgtgtgttatttcaccaaaaatatttttacttgattttttaagaaagcatttctattaccttattcggaaatccttttgaagcatgtagattattaaagattggaggggctcactttctgcttaagaatagaagaagggtccctcatataaaggttgtatagttcaggtactcatcccagattatagaacttttcatctttatggccacaaagctgatttaataaatgtaagatagtaaaacaactaatagattttatcgatgttagatcagtgttatagtcaaatatgactttaagttgttgcaaatatagtatatataaccccaaataatagctggtatgtatccaggacaaaggagaaaatcaattttattgcatttaagaagccaacttagggtatgacattagaaaaattattcactaatgctgcttagagttacatggtctgtgggcaaacatagtacttcagtttcaagtgatgtcagtccagcacttttatgaacattccattactttggggataatgggaaacatttctgtttgctgattgttcaatacaaaagacaacttgaataaagctggaacaacttatatttctagctgactcaagtcactgtggaataaaatttctggtttataaccatctgcttctcagccatcctgctaagagatgtggaagaaatcattaaaaacagaatatagtggccttatgttatctgaaatgtattgagattttgaagttaattctttagagaatgtggaaagctatatagcaatgtcaatgtaatgagactttaaatttttaatactcttcacaatttcacattgaagaaaaataccaaaccttaagctgcacacacctccaccaaaagtttacattattttggtgaaatttgggtatgccgttgtcagactggcataacaaaccagagacagaactgatttgagcaaagtttgatgaaactaaactgccctgtagtgaccagcctctaccgtgcatggggtatcagagaaattgatgtgttcagttgaaagtagtttctctttgacaccaaaatcataagcacggtgaactgatttcatttaggatgagtgtggctaatgcattttttctaaaagaggtgcttgtatttgggacattggaaataagaaagaaatgagttcccagtgggagaaaaacatattggctgctaaacaactaatttaaggatagacaatacagttaagtgtgacatgcaaaatactgatgtatcctggtgtcatcactcactaaacactgatgaactctagaaattaatggcataagaataaaatccagaaatccagtacatatcctgagaggcttctcttcctgttcccagcttcagtggagtgttactatcacactggtgctgctttgtttccctgtctttgaacttgatgaagagtagaaagagctaccactcatgactgtctgctctgcgtcggtgtccgtgtgtcatcccagcacccctcacctccaccatgccatgctcattgctgggctgcccaggcctggccttcccatcactttacacaacgaagccctagctggccctgtgctccttctctaagtcaaccaagcagatttttcctaaggtcaaccaagctccagaaagcaactttagaactaactactagatgtgcttctctaagtcaaccaagcagatttttccaaaggtcaaccaagctccagaaagcaactttagaactaactactagatgtgcaagaatttagaaactacttttttaaaaacgttttataagcaattaacatacagtatcagctggaaaatggttgttgaagagttgtcattgtaattccttatttttgtacattaagaaaatatacttctgctttatttgcagaatttacataaagcatattaccttgctgtctcacttccaagttttaccatatgataccctgttacacagaattgtgcttttttaagaaactaagccctcgataattgggtgccagactttttgaaatctttgtagcaaaaaaaatggtttgaatatttttatgcatatataaacaaaatctttcatttgaaatgttgaatgaggacttaaaaatatctttcttacagtagcaatctcttaataagctaacaagaatatctgagacttttaaatttaaactttctagaaaatgttctaaacaattaatatccagtagtacaatagatctcaggactgagtttactttttgccaacttgtcccttgtatatccatatatttgttaaaaaaaaaattcactacaaacagattaggaagaggtttttaaaatgcaatgtactctggtatcacaaaacagagccttaggctgggagtggtggctcacgcctgtaatttcaacactttaggaggtcaaggtgggaggatagagtgagcccaagaggttgaggctgctgtgagctgtgattgtaccactgcactccagcctgacagagacaaagaaaagaaaagagagagaaagaaaagaaagaaagaaagaaagagaaagaaaggaaaagactgagcgataggagaaaaagagagagagagaaaagactgagcgataggagaaaagaaaaagaaagaaagagggagggagagagggaggaaggaaggaaggaaaaagacagcaataggagaaaagaagaaagaaagaaagagaaagaaagaaaagaaagaaaggaaagaaagaaaagaaaggaaaagactgagtgataggagaaaaagaaagaaagagagagagacagaaaagactgagcgataggagaaaagaaagaaagagggagggaggaaggaaggaaggaggggaaaagagcgataagagaaaagaagaaaaagaaagaaagaaaagacggaaagagaaaagaaagaaagaaagaaaaaagggggaaggagggaaggaaggaaggaaagaaggaaggaaggaacggagggagggagggagagaaaagacagagtgataggataaaaagaatttgtagtgggttgatttgtgtccccacaaaacgcatgttcaggtcctaacctccagtacctgtgaatgtgacattatgcagaagtaaagtgttttagatgtaatcaagtcaagatgagtttataccagtttagtgtcagccctaaatacaaggactgatatctttgagacaaaagagagaaagatttggatacagaaacacagaggagacatggaaagaagagagccacgtggagatgcaaagaggcagctacaaccaaggaatgtgaagccttgccaacaaccactatgagctaggagagaggcatgggaaagattctccctcagccctccagaagaagccaaccatgcacttagaaattccatcctagagaactgtgacagaatacatttctgctgctttaaaccacgcagtttgtgatcatttttacgtcagtcctaggaaactaatatagagctcttccgaatcaattgttccttgtggaggactaaatggcttccaacaggtaggtgcatggaaaaaaggcaaggtgtgtatgaaggcaaacaagaaatgatgaaattcctctgtgtttttaaagaagcagttttagaggcaggggcagaagagtggaaacagctaagaagggtttaagagttttgtattagtccgttttcacgctgctgataaagacatacctgagactgggtaaattataaagaaaaagaggtttaatggactcacggttccacgtggctggagaggcctcaaaatcatggcagacagcgaaaggcacattttacatggcagcagacgagagaatgagggccaagcgaaacgggtttccccttataaaaccatcaggtctcatgagagttattcactaccataagaagagtacaacagtatgggggaaactgccctcgtgattcaattatctcccaccagctccctcccacaacacatgggaattatgggagctacaattcaagatgagatgtgggtggggacacagctaaaccctatcaagttaggactttgttttgaacacaagtggtccaaatgaaaattatttctttttaaataaaaataacgatttttttttctgattgtcaaagtgatacagaacttctatctccaaaaataaggtcaacattatgtactaaaaaaacacacccacacaacacaaaatgcctaaaaacaagtcctaagtaaaatataacaaacatttaaatgcatagttccacttacaagaaagaaaagagatgccacaaaaaaactaaatgcagagaacattttcaagaggagtagactggagagaaagcaagtaaagccaaagaggagtaagttggacctgggagcctgggctcaccccagaagaacgtggaacgcaatactcatgcattttcacggctgtgactgtggaccaggagacagtgcctggggcttctatagcttgaggacacagaactgaaagctttcagtaagaactgattgaagaaaacaaatccaaatgccagcagagcaaaataaccagactgccatttccaagataggctctgtgaataggttaatcccacacctgccctggctgacatttttgtgccgtcataccaccttcatgatcgtgggtgtccagaaccatgttaaggaatttctctaaagtgacccaggattgttaattcaccttcggcactacatgcctcttggaattcccatgtgcagcttctaaaatgtggatctgccagaatgatgaccaaaatcgtgagtaaacaagcaccttgggtaaaagttagaaaacagacaaattcgtggcagcgctttacataaaacaggaaaatgaatgaactaattgtccaccagtttgttattggcgtaaaatacaaaataatttgcatcaattaaaactgatgatgtaaattgtatttcttggcttgagaagatgtacattgtaaattaagtgaaaaatgcagttggtagtgtgcaccataaacttatcgtggtgttgtgaacatgtgtgtaaacatacacacgcacacatatgtatacatatacacacaagtatatatgtttgtcataaaacacgaggtaccgaaaatttatattcatgattgtgtcttggtaagaaaatatcaagtaataataagtgatgtttcctttatatttttatattctaaaggttgttaaattagtatgttttgattttatgtattattaaaacatacataaacaaataataatattacaaacacttgtgaacttaccaaccaccttaatataatataatataaatatgtgacgtatgcttttaatacaattatatcaatccctaaaattatattataatgctttgcatactttctttagtagacacttgtgattactatactcacatagtaatatgtatttttaaattgctttgcattttctgaaatttatataaacaagtattatactccattatttgccaagttgtcattttcttcctccagattgtatttgtgaacatcttccactttgataaatatcacctacttcatttattttatatcatttcacaattacacaaggctatatttttgatagctaaaatatgtcaattcactcaaagcttgcatccatcagtataattacatggttcttttcctttaagcatttagtatgatgaattatatcaatatgaacacatttcctgatattgaaccatttgagaggacggatcaagggtaagagcataccctgcagccagactgagttctaattacccctctctacacctctgattccccttacgtgaatggggccatagcaatcccacctcatgggtttgaaaggaagatttaatatcaaaagtacaatgtctggcatttgataaacaatagttaataataaatatgattatatgtcaataatgaataatcgtaagcattattaacgtacttgtaaattcaaatttctgaaactcgtaggtttttcacaatcctattcataattgaggcacgcctgtaaaccttgtgtactttcctagtcaggtttcggcatcaggacgttgtgttttatgtacaagaaacttcaaaatgtttttaagcacaatagctgtttaaataacaagtgaaatattattttcatgttgctttgaaaccatcttagcctagtgcatttttgaggggtgttttttacaaagttcatggtcactcaggcattctacatctacttgaatgcattctggttatctatatctacttgaatgcattctggttatctacatctacttgaatgcattctggttgaatgcattctgatttttctggaacactgtttcatcctgaatttagggttcctttgtatagtgaactggacaagatcatacacctagcaccaactgcctaggtttaaatcctggctctccatgtcctagtgataaggttgggagaaagtgactatttccgtaaggctttgccttgatattttttaaagggtaattatagaatgtactaaaattgttactgactgagactcagtaagtgctctatcagtgtcagctattattactatataccttattattttaatttccttctattcatataccctttctcatctcattacttgtatcatgtatttccttctccttctcttttaaaattatataggatctgtaggaatgtatatattttgctgttttgttttgccaaatgtatatgaggaaacaagagggatgactgaggaagttgactttgcaaggaagtgattctaatggctgactaaggagtttaagctggataagctggggagtgaggccatggtggtgattgaattgaaaagatcatgggattcacaatggttggtgatcttgatggagttaaaagagtgctgaaacagacactcaatggagtaaactggaatgacaggaggcatttcaatgggactttatgaaaacagctttaatgagagatgtgaactttgattatttggatacctttcttttggaacatagttaattcctcaataataaaagacggtgccttacaaataaaagacacacatttattgttgctgatcacagtgttttgaaaaataaaaaatgatcttacagtgtttttaaaataatgtaattaaaagttcattctgatatatttattgtacttgcttcttgggagaacttaatttttggaaagaaatatagtaatctaattttgtgacttaaaaatactgtacatatagtaacagattttatgttaatttcccttttgaatttcagtttctacagattcaaatgccagaaatatgtaatacccaaagtatctgatgctgtgctaagaaagaccacataggaaatcctgtttaattttccaaagaaatcctttctgcttattgtgttttccaggcgcacatcttattagcttataagctcattgccttatctgtattactttctccagccccataaagagagaaaatagaaactagagaattatatgtaagttcacagtttgataacctttgtctcctgtgaattcaagcttcgtattgtggaaacacatcacattgacatctgcagtattcgtttgttttgataactattatttcttgggcagaatatgtcacaaagctgcctcttatgtcacaatgcagccaaaagcatttttctttagtgtgacactagaaattctgtgaaataagcaacaggattttttgtttaagtatactgttgccatttgcttcaagctatatttttctgtctttaaatgtactacttctaagaacatagctgtggtttgctaaattgtactgactttgtttataaatagtgaggcagatgtcagcagaaaattagatttaatgcaggtcaccatggcctccttagataaagaacttgaaggtattgaatggaaattgcagaatgacacaaagaaaattgagattcagagttctgaacaactggcaggtgcaacaatattattattgtctaaggcatataaatgtgaaactttaaaacaattattgatcctcttgaaaatttcagaaagataaggatttataggaatgtacctgactaggaagaaaaaaagaaaattgcttgtgtttaccaataccattcctgaatcacacggaagtgaaataaacccatttgagtcggaattgccatttcactatttccatgtgatatggtttggctctgggtccccacccaaatctcatgtagagttgtcatcctcagtgttggaggcctggtgggacgtgattgaattatggggggtggacttctcccttactgttctcatgacagagttctcaggagatctggtttgaaagtgtgtaggccttacccctttgctctgtctctttctcctgctggccatctgaatatatgccagcttccccttcactttctgtcattattgtaagtttcatgaggcctccccagaagcagaagcttgtgtagctcacagaaccatgagctgattaaacctcttttctttacagattacccagtctcaggtagttctttacagcattgcaagaacagactaatacaccacactttgtttttacactatgttaattgtttgtggatacttcatccattacattcaataacattttccagcataaaaaaaagataaaaatctacctaaaaattaacaaagaaggtaaaattcaacttcagtctaaataattattgaacatctatattgtctggatgaaactggctcataatgtgcataatcaccttttcaagaaaaattatttgtcttctatgaaagtaaggcaatgtagggcactggaaacagagggatctaacccagccaactgttagctctaagacgctgggcaaacttctaaattcctctaatgattattactaatatttattgaatgctactgtgcttctcttacagtgtcctacactttgaactcatttgaatctcataatcattctcacaacactcttataatgtcattattttcattttaggggagatgaaacaaagacacagaaaggttataatgacataattagtaagtgctagagtcaggatgtgaattgagggagtattacccagaacctctacttctagctggtatactgcatacatttcagctttcatgttttcctgtgcagaaaggagtaatttatagtgctggtaacaattagacatgatagacatagagcctttggcactgagtgaaaccttagtgaatggtaactgccagtattatggctctacacaacttcctcttctattgatttttgacatagagtagggaacaatgaacaatatttcattatttgaggagttctagtgtttaataaatctaaaagcaattcagaaatgatttatttaatttattggaccctataattatcttcttctttccaaaacccatccataaagagattagttttaaaacatttcatcatcaccatcatcatcgtcattatcaatcaaccttatcatctgattgtgccaaatagatttagtaaatcataatcattttcatcctatcggttaaaaatggcaaatatctgaagtatttttaagatatagcaaaattttgcagccacttctataaaacctgctagcagtatgtttatgtttcaaattgtgttcctctgtaatttaaaaccagctagtaatccattgtatttttctgtaatcaggtaaaggaaaaaataattgtagtctcactgctaaaaattgtttagtggcatttttcacaaatataaaatctgtcactttaatcacttggccatcccatttgatctctaaatgacatacaattagctgaacaaaagctaagccagagatgtatcatgagagtattacttactggttccttttaggagccagatttttgaattaattaatgaattcttacatgtgtggggttattttctaagttaacaatatcatttttatttactattcaatttataatgaatcctggctttgcaatcattttatcatacatattagaagccaattctttcctaattttaagtataggatagtgttttgtatattcttttactttacgctgcaggagttacacctaaacctattaaacatcgtcttttcttctttacatgttttcccaaacattttgaagattaacattattttaaagttcctgtacatcccactctactaaatatcacctaaaaatttttattaagtatcactatgaaagtatttatgaaaatatattgaaagttgaaacacattctagaacaacttgacttggcaactctagtgaagatctgaaaactagttctcttactgttttctggcatcttccgtgtccttaatacatatgtagtaagtgttcaaaatgccatttaaaaggctagaaagcaatgcagtaggtgacctaagaatgctgtaaactctttattagtgtcaagaccaaattaaaattcatttaaggtgataagttggagttgttttattacattttcatgagttaacaccctaagaggagcatgttttatggccagagagtaatttgttatagaatttgtcagggaagtaaatctatggtttgcttaggttctctggtgatgcaccttgggagggtaacttccctgaaatcaccttggttgagacttctgcttttaaagatatgttttactgtagcccatacacataataagggaccacctatacctagctagcattgcagtcagatacatcatgtctattattggtaataaatatttgtctttgctctgaaggtatataaggtcagatgctcacatcgtaaggttcatgtgtgtaagttcaaatcaagaagcgttcaagtcttatgaagtctgtttgtaaaagcaggtatcttaattgcttcagaaaatacacaaatcatttaagtatttcccatgtcagcagcagcaatgttcttactatttattgtatgaactctttgggccaggcccaggactcaatattcacataaaatattggaagactaagagaagatgttcgtaaactcaggcttgatcattctgaaaccagttttttgtttgtttgtttgtctcaacggtttaatgcataaatattatctcagtgaaaataaagttactaaaaggcagttgatgagtctgtgttttcatgagtagaaccaggggaattctgacatatggaatagatagaaaaaatatggtctgatccctatatttctggacaaagtaaagatgaactctgtattaaaattcacatccaagatgcatctgacaccctgacttttgacaatgactgatagcactgccaattcccaagcagagaaacttaacactgcctgtaatttaaaacaagctagtaatccattgtatttttctgtaatcaggtaaaggaaaaaataattatagtctcactgctaaaaattgtttagtgacatttttcacaaatataaaatctgtcactttaatcatttggccatcccatttgatctctaaatgacacaattcgctgaacaaaagctaagccagagttgtatttcatgagaatattcccacattcccctgaccacttcaaaccgcctctcggtccattcacatttgctcctgttaatgattaccagagaaaagaatatattcacctttcttcatttctttattcatcaagtcagaaaatacatactaaaagtcaaccttgtaaagttttcattcaagacattaggaatacagctgcaaacaagcaaagaaaaatccatgctggcaaaaagctataagctgaatgcctataacctaatgggaagaggctaaaatatacacaacaaatgagtaaaatgtttaataacttcctgataaatgcttccaagaaaatcgaggcaggaaaaactggtcttaaccaaaggaaaaataaactttctcatagcttcatgacaggagatcgaggtgctcatcaaagttagaccctcaccctctcacagagactgagaaatagtggcactgtcttcttggattactgtatttcaaaggaatggttcccaggtccttgagaaagacattcctggcatgcaaaactggcaagaggtttttaaaagatttctgtctcaaagaggcagttatagttaccagttttctaaagtaaatgctccaaggaaaggaagggatggggcctctgtggttagactgcctggatctgcaaggactggtgagaggggtcaggcctagaggtacctaggaagtttttctaaagtatagtcaagctgaggggaagttaagactcttgctggccttatagacctgggtaaatactctcacgcagtgagacgggcagtcattgaagggcatggagtcctgccgagtcatggcctgattcatatttgtagtaccctgtttaatccagcattcacaacattttagaaaaacagcagtgccaagaagcaaaagaaaacaaaaacaaacaaacaaacaaaaaagactcagagaagagaaatgccttcttcaggtgcagagagtcagagagtgctgattgagtggcagccaaggaaagacatttcagttggttgtttgcagatggatttaacccaaaagttgtagcagtgtccatggtgctttagggggatgtttctgctgctcagtatgatactggtgtaataatttataaataattcaccttcctaaactttcttatttttattttatttatttatttattttgtgacggagtctcgctttgtcccccaggctggagggcaatggagccatctcggctcactgcaacctctgcctcccgggttcacgccattctcctgcttcggcctcccaagtagctgggactgcaggcgcccgccaccacacccagctagtttttttgtatttttagtagagacggggtttcaccgtgttagccaggatggtctcgatctcctgaccttgtgatccgcccgcctcggcctcccaaagtgctgggatttacaggcgtgaccaccatgcctggcctcaccttcctaaacttttctatggtcttcaaagcactaatgtcctggatgtcaaaatcaatcaagtatgaggatgaagagactttgaaaaagtaggaatcttaataacttaatgaaatgaatcttttgggacagcactctttttcaatatcattatccacaacttacctttgtgtgtaaaatacagagatgtcacttcataaaactgcataaaatagaaaagataaaatcctcattttctcctttaaatgaattttatgcataatgtacaaaacaatgttccttaaaatgattcctatggagtcaatttttaccttttacttctttataaataaaatttgaataaatttgttttatcatacagtgtttccccaaattgtcttctgtaaaccattcattttttgcaaggtaaatagctggattgaagaaagggttgctgtgtcatcaaatgtttggggaggcttggtgtggtggctcacacctgtaatctcagcattttttgggaggctgaggcaggtggatcacttgaggccaggagtttgagaccagcctggcaaacttggtgaaaccccatgtttactaaaatataaaacttatccaggtttcatggcccatgcctgtaatcccagctacttggggggctgaagcacaagaatctcttgaaactgggaggcagaacttgcagtgagccaagatcacgccactgcacttcagcctgggtgacagagtaagactctgtctcaaaatatatatatatatatatttgggaaatgttagaataaacagagtaggacaattttatctactctagagctcctcagagcagttaatgttttgataagctatgttcctccaggagggatatggtatgaaacttttcctaaacttttcctaaacatattttgatttttgaattttatgaacatatttgcctaacatattttgatttatgaatacctttgtaaacatctctgagcgtatctctaaactggagttctgaagaggcatctagaaacaattgttacatttgttggcttgggaatgccttaaaactagatccaagtatgagagtaattcacaccttcatgtgggaaaggcttgttgatggattggagtaggatgcatgtacatttaagagttaactgaaggctgtgtaagctggagctggtgatggaacaatatgcaagccacaaatatcaaggcttaagtgctcagcaaaagagcccagcttatccaagttacagagagcacctagctcctggctggagagatgatcacatagtagcaaaaagtgtcaatttagtcacaaaggctgaaatgttctaaggtctcctagcccatcagagggaatgttgggggtttgccagtttgaggatcacggttgctgccaaattaacctggcagctgttctgagagagttcaggcagcttcatatctatgcagaggttcatttgtatggtgttgatagcctggcacccctggagcaatccagaagactgttgtgacctttagtgacacagcaagtggcaatgtttcaggaatttgctcagtatatgagagttcagttgccgaagttttgaataagatatcaaatattatagctgcttattttttttcaatcatactcaatggccatgaattatgcttatgactgacatgttgcacatcccacatatggtgtctaattaaaagagcggcattctgacaggctcttttgctccgacatcttcctctcttcctgcatctggcacttttattgaaagagaaatttgcaatataaatgttttctaatgttaatttctttagaagtggaataaaagcattattgagacttggcactgaggaactagttaatagaatgaaaataatgttatatctccaatcacaactcaaaggactgtttttatcttaacaggctgatcatttccaccctgaaggactgactcctcccccatttcaagagtggtgggcaagtcatcaggattctgcttcccaacacaaaccctccttcagccctatgggtttttgtttgtttgtttttgtttgtttgtttgtttgtttgttttgagatagagtctggctgtccaggctggagtgcagtgatgcgatctcagctcactgaaatttctgcctcccaggttcaagtgattctcctgcctcagcctcccatgtatctgggattacaggtgctaatttgtagtagagatggggtttcaccgcgttggccaggctgatgtcgaactcctggcctcgggtgatccacctgcctcagcctcccaatgtgcctatggtctttaacataccctcagcacttcagcacacttccagcagaaactgtaatatacagatgactctgcatttgatggtagttttttttaacaatgtgttaattcataatgaaaacctattaggttatataagcccaccctgtacacatagtcacctggcatgtgtctctacatgccaataacaagtaaccaagaaaggctagaaagacctaacacttgaccattttacatgtgatgtttcaaaagccaactggaaaattgattatgggttttctgattccattgttccttttattatactatgcttccttggaattaaaaaaaaggaatgtcccaccttgtcacattttagttcccttggattttttaacatttagtagcatttatgttaaaatgtgtttcactttaaaattttttgcatgagtgaggaaagctatatatttcttcactttcattcattcattattcatgaaatcagaacacaaatagactgtcagaatacagccaaagggctgagtgtagagtaagaaggttgctgttaccatataaagtgctataaaaagtcgaaacaataatggcggatagatatataattcttcttgagaaaaatgtgccaagtttcacaaagcattagtcattatattcatttctattttcaaagccccaggcattagtttggatttatttgttctttgttgaatggtcaaattatactgtgactgcatgtattgcactgtataatacaaatcattactgaattcccatgaaatgcttctgtaaaatacttctggtattgctgaacattttttgtcttactcagaaaagtataaatttataggcattttcttaagatagctacttcaggctataaaaagtagatgccccaagtaacttgccaagtttagaaatgcaagtaactgaaaagtagcttggcaaactaaaggagttcactcaaattattaaataatttgcattcaaggtgttatatttcttgttgaattaggagatacttatttgccaggatattattcctattcatagctaaagataaggtatttttagctatgtcttcttaaaaaaaaaagcggttctcatttttgcatttcagcatattttacagtattcctcccggatcaaacatcaaggaaatatatacaaaatgtagacaatatgagaagacatatttgctaattgtctcttcatatgggaaagttctcacaactccattagggatttggagatgatgtaattgataatatataagcccagtgtcttttgaggctgctggattccttagagtattgccagccaacaaaatccagacagtaatttgaaagtggaatttgaaataccatcagataacgtgtgaccagctggcccaggagaccttcagtgaatagcatggtaattcatggcacctaacatgaaactccaactttacccatctgtcactgttcaacctcagtttggtcagctgagtcatgtacagtacattatcctgcaaacagactaatcgatctaacctcccctctttcagggctctttcatcattactgggtgaaaaactcaccctgccaaaggaatgatcagtatgaacacgttactgtagctagaacatgtcacagactgttcagatgttctccacaatattagacgtttgataccgtgaatacatgcacaggaaaaagaaattgttcacgtataaaaccatctgacttgaaaactactgctaacaaatggacatgtgtacatccattagacaaagtgtccgaaaatccaagcgctatcctctagatttcacaaacctgtttcctgaaaatacatttgtttatgtaagcctgcttactttcatctccaattctttttatcataagtcacattgactctatctgaaaatctttatgttggttatgtgactaaattttgattcattgtatgccttaagcgttcaaatattcatatattttcttgactacatgactattgaataaatgccattgtcaaaaaccttaaatatttctccttaaaatttaagaaatatttaccactatttggtaatttaataaaatgcatttgtatttcccttgatgaccatgcaaaaacagtataaaaacttggtacatactttatcactaacaaaccagattttcttcatttgtcttaggagacatattggctcagcaaatagacggtagagcctttgacagtgggaaattgagtgtaacatatagtgtaatcaacacttaggttttcttgctgtgtggatctgaagaacagtttcatgcattttctagtttttaatatatgtagctctcccattttgttctgagttttccatttgaaacttattatttacaattttccaaaaggcttgaggtccagtatttttttccctctaaaatattagaacagacttctaaattctaggattaagggattctgttatcttgaagataacatcggtgtatcagaatactgtatataggaaggaacctgggtccacctccccacacgggtacaaattttaaatatttaagtcacctggtggcctttgacaaccaagatgattgtagcagaaggtactgtcctcttgactggtagcaagatgattaaaagtaaagtctcccgaggtatatttctatatttagaagtacacaatttcagtagccacttttcaatattttgttcaaaaacatatattgatttatatctgcatacatcctacaaatgcccatgcaataaatataaaaagaagcatcatttggagcaagacaaaataagcattagaatccagccaattcaggaagcaacagtaatctaatattttctttctgatggcactttgtgttgccatcacttgtaagacacaagtactcatagaaaccactgtgatcagacaccatcctctgtggcctcccctgagtcctcagtttgtatggggaacatcatggtttaagctcacagctgtgaatcatagattctccatgtctggtccatgcatggactttatggaacccgtgtattccctgacttcttttctcatttatgtatctatggctttcattgatttgtcaagaactattgttttaattaatggttttcttcccagagtacatgtaatgtccttgtaagaataacaatagctaataattattaagtatattctacttgtcagtatgcctgtaagacttgaattaatttatttttcttcacaataatcagatgcagcaaatagtattcacaccgattttacaaatgagaaaatcatggtaagatagtttaagaaattgtcgaagctcatacatctcattagtgacagagcaagaattcaaatgtcaaaacgcctatgcaaagtctatactgttaaccagaaagctaagctttctgaaaatgtagctggttttatcctgcagaacatattctgcctatgggtttccatgtatcttcttagtatacatatcttgcaaccaaggtctagcttataagttatttttgccgtagtttaaaattatttaccatatttttattgaagggggatttcaaatttagtaaaactaatcaaaaatttcctattttgttttcctttaaagcctattttacacaaagcagaacctatctaaatacattttaacttatgaaacagaagtttacttattgaatgagaggaaaacgtctaattactcagtgatggtcagggtgcccttttcactctcaaattctggcaaaatatatgcttagtggagacaataaggagtatatgttgaagaaatgattgtgagaccatttaacaaatatttcaactctaaacaaaaaagtcctgtactaagtaccgagtaagggaaacagaatttgaagtgacctttccctggctcaccaatggttttaggatttagaggaacaagagagtataaatatggaaaagtaatattgaaagtcttataagaaaacataaatgaaaagagactattaatttagcagtgactttgatctaatcataactagaggaatataagaaagttatctcccaaatcaaaaaaaaaaaagtacaaaatggtttcatatcctctcctctaaaaaattagtccaaacataaaatctctgaaaatgaaattaattgacttgagttcagcaccgtgtctagtacaatggtagtatggtcttgagtaagccagttagatacctaggattatctctcagtgtggaaataataatacctcttcacttacatatcatgaaggtcacatgaaattttctctttgcacagttctagaacactttaaaactttagtgtacttttgtacaccattttaaagtaaccctactccccagcaaagacatttaaaaactgatcatgctttttgccatgttaaaaaaataagagttgtcaagatacttgaattttagtcccggtaatttcacaatctaagttgtgacttcagcatgtcatttaagttttccagttcacaagccaaacaagtgaattagataagatgatctttaatactcatttcttttctgtgaattgaatactgtgtaaggagaggaggaaattttcattcaccagaaataatgtatttgatagtatttatttattcaataactatttattggctgctgactctttgcttggacttagagaaatgaacaagagaaataaagcccagaccctgagagaactttctagatggggagacagacaacagacaagtaaacaaataaataggtaatttcagaaaataataagcacaatgaacaaaaacaagacagggtaagagtttttttattagcagattcctttaccatattactggtaaaattaaacatccttggtattttgtaattttttcccctttcttaaaatgtctttccttctcagtaaactctttcgacctatgtgcttaatttcctccccaagtaatctccttcttaattttctccatgttcactgacttcttcctgccgcagacagccaggcacacctgtttcttatgctatttactgccacatctgccagccccaggtgggctccagttgacacaatccaggtgcaaacatgcagtgcacacactctgtggctcttagttctgctccatggctttcctgttgacaccggggcttagaattccatgtgaccctgatgggtacttatgcatggacaactagaaagtgtagggatgttaacgagccatagtataaacctttctctaatgcgaggtggaaaccagagattcgatatttttctctttttttctcctcatatggattggcttgaggcacagttttgtggcattttacaagacaactgtgcaggacgtagaaatgttttgctctgagatgtgtataagcgtaataattcatcattatattggctttccctttcttacctgtcccttagtgctccttccgtaattgtcctatctaataaagtagtaccacttatgcctttgcttcaggctttgcattttctaactatttgtgcttccatggaaccaggaatggctttagacaacacaccctcaggacagattttaggagttggattactcccctatgtgacagcaacgaggatctgatttctggttgtaaacacatggtgataactctaggcatgtggtagcatcacaattaccaacacttcctcttgtggttaactgagatgtggtgcaggtggaagaagatgtgttgggatcctcagtagccgcatacctagacttccctacccagacagaggactcagtgttacactcagcatctccaaccctaagaaagaggtgcaatgttgggggtttctttggattttggaaacaacatatatcataatatttcagaatattttttcaatgcatttattgctttacttagaaggttgcccgttttcagtggagtccagagcaagaaagggctcttcagcatgtgctggctctgctgcaagctttctgtccctggaagtctgtgacacagtagagatagtgctgctgatgtctgcggtatggaagaatggtgagtagaggtctccagcaagccccaataggaattctgtaatgcagacacctagagatttggaatgagttcatgccttttatggagaactgtcctccattgtaaaattgtctgtagcatgattctggcactagtggggactgattattggaccatggggtaccaagtacttatgtgacagaagccaccctttgtaagttgaaaaactgaccaaatcttaaaatgaggtggacatagcagcagtccactttataatggaatattcgggatcaagccctaactagtacagatgacacaagatattatgaggacaagtggcacagacccccttgtcacacgtccttaattaatgccctggcacctttcttctgtctatgtatatggcctcatagaggattccctgtgaactactgaagaaaaaggaagccatccaggcacatccaggcatggctcacaaatagttaacaaggtagtctatgctggcgaaaagttgatttttgctgcatttaactccactcatgaatgtcccaggaggacaatagcaaagaagagttgtcttagtgaccagagttgtttgccttgggctctgctttctggggcaacattggtttgctgtcttcaaagatctgcttatgttccctctcacttctgctagctgctcttcttgcagttactgtatcactccttgcaactgtcagtatttgccttaaacttatgatcagggctaccagaaatacaatgattataagccacattttcggttccagtactgtagagtacattcatttatgcaaaggaagtctggttcaatgaagttcaaagtcagctgaaaggccaaaaaaaaggatgcaaaggcaaaatgcagactgggaagtgagggtctaagtaaatgaggtgagttgactttggtggagtagatggtgtgtttataggatgattgtgtacatagatgccttaaaggaactttgttttagttctgaatggcagcaccatctccccaccgccatacccctctcctcactctgggaccctgggtcattacccagagcagtcagcagggagctccccaagcttggcctccgctctgtgcaccctgtgatctgtcttaaccaggttattcttgtcttccacttgtcataaacctacctaaatgacaacccactgatcgttattatttaaagcttatttaaagcagtgttttcattgacaaagagttcacaagagatgttcaggaaaataaattttcacggtcacgtgagtttaggaaatgcaatgtaacatgtctcccttttttgaaaatttgtcaggcacatttacatattaaaaggccttaaaaagagagtaaaaggaaataaaaagatacttttatccttatttaattcagtgattaccaaatgtataagcctacataattccattttatctttgttttaaataccatctccactccttcccccgcaaatgtttcatccctctctcatcattcagggagaaagaaaagtcatcataataactttgaagtattcctgtggtacattagtgttcaaagaattttggagttgaaaaggaccttagagaatatctaatctattgggtcacaaacattttatcaccaaaaaccattttacttaaatctctccacatatatacaagttttaaaagacaacttctaccacttagaaaattataatattctctctctttttttttaaaccagcaaaggggtagagagctgccttccaaagccttttattaacattgagttatatatttattctggcactttaataatactttgagcaaaaaaatcaaaggaccttgacatttcggttggcaaacttttaagtttttttttttaatgacttcttatttctatgatctcataaggataggagatctatattatgcccgtcctcaactatttattgataacataccttggtttcaaaaagttgagcgtcgtactctaggcccactgctgtttgatagaactcagagctcctaattccctgatcaatattcttcctattgcctttgatgtttctttagagcagaagttggcaaactttttctgtaagtcagatagtaaacattttagcatgtgtgtcataaagtctctgttgaaaccattcaacctcattgttgtagtgcggaagcagtgatagacaatatgtaacaaatgggtatgactgtgttctaataaaactttatttacagaaacaggccacaggctgtgagccacagtttgccaacccttcctgtagagcactttgccatacacttgcctgattataagaattatctggcctatgaagtaaaatatggattccactatctcttctgattctgattgaggataaggcctataaatctgtgtccttttcaaacacatcaggtgatttttatttttggaggaacaagtttgtcaaacattgatttgggtatacttattctttttttttttgtaatattagaaaaccacatgtatttatttccaggctgaagtatttagtattttccaatttgtaccagatcaagtttgagtcaaagaaactgaatatttggcttcagtttggtttaacagattaatttgaatcaaatcattggcttgtggtgcttgtagtttagtttatggtactgcttcttatatgaacccttaaatgatttattcctggttcatttgcggttcttcaatgggaatagcttgaagaaggatccagaatcattctctaaaggatttgatgcctgtttaagaaaatatgttaatgtacactgtatataatatacttgtttttatatatacatacagtataacctcacaagagaaattatggctagttagaagtggggatttataaaggaattaaaagtaatcaatattaacatgatgttgtacagttgaaaaagtacatttttctcatttgatatttataatcctgggaggtctttttgttttttctttttttatagctgaagaaattcaggctgaaatcacaaagctggtaaatggaattgggacagaaactgaagactttaaatctcaaattatgtgttctttctcctgcagtctagaagatgcaaataaaagaggcataatagcagaagttaggaaaaacagatgaaccaaggaaaagctttttatgagtgtccatcgctccagtgatccctgatccaaacagaatcctagactcttaagagctacttctacactgtcttaaaacaaagcttgaaaaaatatctctaagtgtcctcccatcctctgctctcttagagaaaaccttttacagcactgaaggaccttctgcagcttgaaaaatccaaatcaagagtccacacttgataaggccatggagggattctgtagagaggaggactcggccgatgaggaagggagggctcctgaggatttggcagagctgggtcctcacctgccttctctataaagtctttcccagttttccttttcatagctttctgaaaacctggtcaactcttctttgagtcctcgtgcagccttttcatggttcttttaatacttttcatacactgccctcttgtaaggtgttacaggatcctaatgaatgccttctgtattgttgtattccatactagttagggcctaacaaaagcatggcatcgaattgtgtagaggtgactgataaatacaagaaggaaagaagaaagagtggggaggaaataaggggaaaggaagacagaaagaaagagaaaggagagaaaaagtcaacagagcatgagacatagcattactaattggctgaggaatatcaaagttagtatctctaccctattattttcctatttctttcctgtcccaaagctaagcaagagtggaattatctccccaaagtcccttgtcctcctctgattgttacagctggatcagggtcctattaattgatgatgagggtcacttgcctgtttccccaggtaaccatgagcaccttgagctaagtcccctttcttagataccattttaaccagttcccctgactccagcctttctgctcattttattgcatacacaaatgtcaggttaacctgcagcacagttgtagtaaacagacaaaggcttgcgatgtctccacactgcccaggatggcctgcatacttgagctgatctactagccctttgcaattcacaatgatgtgcaaaatattgcctcaatctggtattcctcactctttgttaattctgtctttcaaaatacattctgaaaatacatctcaaagagaatctcacagtcctcaaaatctcttaaaatttcctgtttccctgatatgtggtattcctctcattcttatttcatgagaggtacaattgtataaaaaaagtgcttgcaagcctgaaagatgtaccctttgccacattcagttctatgcccttaggtaatttgcttagccattaggaatctgtgtttccaaatcttcagaaaagtgtcttagtccctttttgcatgctggcaacaagtgaaaaactaccctgcttgtagcagaagcttaaactcctgtgatgaatgacagaagcaacagcatctaaccctgggggcacagagagacagggactgagaagagtaagggacagggcagttggatccagatgggcttctgtttttgtacgatcatgatcccttctttacttgttagtatgaccagcaagacattaaaaaatatttcctttttccaagaccatataaggaaataaaactatttagcaatctgatctctcttcagaatgcttttcattaaatgatatgagtatttattgcttaatagtggactcttcaatgccagcatcccccagtaacaaattagtataacagtatgctcttccacttgcttcaaaacgtgctttctgattactgtcataaaaaataggccaggcatggtggctcacgcctgtaatcccagcactttgggaggctgaggtgggcgggatcacgagatcaggagatcgatcgagaccatcctggccaacatagtaaaaccacgtctctactaaaatacaaaaaattagctgagcgtggtgacacgtgcctgtagtcccagttactcgggaggctgaggcagggtatcgtttgaacctgggaggcggatgttgcagtgagccgagatcatgctactgcactccagcctggtgacagagcaagactccgtctcaaaaaaaaagaaaaaaaaaaagaactcaacctaatgataaaataaatatgaagtagtgctaatgctgttccacaaaaaacttccacttaatcattaactaaactgtttacaaaaatatttcatgggaaaatttaatcagatttattttttatatttgaacaatagcaataacaccttatgccagttgcttacaaaaccttagctaattaatgttattggaaaaattggataaaaatttagactctggagccacccacagatttttaattcattaaatctggaacagggcccaggaatttacatttttaaagaagcagatgcttaaactgtgacaataatttaagcttgttttcattgcggtttcttcctgcacctaacataatcattatttgacttataagctagatatcagctgcccatactaattgcattgcttgagaatctctgcaatgagaatgctgcctcaaaattactattattttagaatgtggtctcctgacttgaattttcaactagctccttagtgataacagtgtctagtgatataggatctacatttcccaaacatccaactgctaccacagccatcttgctgtgcacaagcagcagtgtggaaaacacacacacaaaaaaagattctgcagaataattatctgagatgtgaaactgcatgttctttccccctctctctccagccaccctcatttagactgtttaaagcaacgatgccagtgcatttttatttcattaggggcatttataaccactggatttgttttaattttgaagaattacaaatacagaaaactcgaagaaatagaagtagtaaaaacccatttacactctaactcagcagttaatatttatcttgtttacttatttctctttcctctccatgtctctgtctacctaactgtacttttttactgggtctttgaaagtgagtcgcagacatgatgatacctaccctatatatttcagcatctcttctaattaaaaaaccttcacttacataaatgcaataccatgatcacaaccaacatatttaatactgataaaagaatacaggtacatttgatgttttcttcttccacaactgacctatagcgatttttattttattttattttattttattttttgctccagatttcagtcaagaaccacttgtttgctaggcatggtagtggtacatgcctgtagtcccagctactttggaggctgaggccagaagttcagggccaacctaggcaacataatataatgagacttcatctcttaaaacaaaacaaacacttaaacacttattgcatttggttatcataatctctttagtctcctttgatttagattaatttatctacctgcctttttttcatttttattctttttttatttcaaaatattgacattctggaagagtttagaaacttgtctcttataataccctccaacctgaatttgttgtaatttttcctcaagttaaacatctttccaagaatgtctacatgtatctgtttctcacagcctgacacgagaaggtacacgatgccaatttgtccccttatgggcaatgatagttttagctacttggatatggtagatgttgccacatttccttattgtaaacataactttctttttgtaattaatattttgttcctcacaaacttaaaccctatagattaagtacctattaatgaaccttgcatagatcaaatagcacactgatgattgcaaaatagagactctatcattactttcctatttttagatggtcttagaaaaaagtacatacatgttgaggaaaagctctttacatactttgtttcccaatctttgtatcattatggccctatggattctttttatattcactgtaataaaccattactattcttcttttgttattgctggttttactgaagtagctgtacattcatatgaagttgtaggaaataacagagagcccaacggtaatgttttgcaaaactatagtataatatcctcctaaacagggtattgacattgatgcaatccactgatctgattcagattttcctagttttgcttttattcatttgtgtgtgtgtatgttctatacatttttatcacctggtccgtttgtgtataaacaacacagccaagatactgaacaattccaactccacagggagtccttttgttgccttttagaaccacattcaccttcatgccatcccaccccatccctaacctttggcttgtatcttccatttctcaaatttgtcattttaaatgttatgtaaattgactcaggtaggatgtaacttttggggattggcttttttctctcagcctgattcccttctgacagatccacacatgtatcagtaatttattccattttattgctaaacattccatgttgtggttacatcacaatgtatttaaccattcacctactgaaggacatctggggccatttgggagcctttagaaataaaactgctatagatattcatgtgcaggatttatgtggacatgttttcatttatccaagataaatgctcaaggggctaattgctgattcttaaggtaaaagctcatttagttttataagaaagtgtcgaaatgttttccaaaatgtatcatttgacattcccaccagatatctattagtagtccagttttcacaaccttgccagcatttagtgttgtcaccattgtattatttttaatttggccatccggataggtgcgtagtgacatttcatttttgacttagcttatctttccttggtgataagtgattttgagcatattttcaagtgcttatttgccatccatatatcctcttcattcaaatgtctgttcacgtattttgcccattttctaggtggatattggtttcatttttactattgatgttggagagttctttataaattctagatatttgttctttgtcagatatgtggtttgcaaatattttcccttagtctatagcctgtattttctgttttcatccttttcacataggtttttacagagcaaaagtttttaatttgtatgaggtccagtttattagtttttctttttatgagtcattcttttaatgccaaatctaagaactctttgcgtactcttaattcctaaaggttttttcttccacttttaaatacattttacagtttttcattttgctcttaagtttatgatccattttgagtttgttactgtagaagttgtgaggtttaagtcaagattatcctgcctatggatgtccaattgcaccagtgccatttaatgaaaaggttaccattcctccattgaactgctgtgacacatttgtcaaaaatcattaggacgtaattgtgtgggtctattctgggttctctattctaatcattaatctatgtatctgtgccctgccgagaccacaccattttgattactgcagctaaattgtgagtctttttataaggtagagtgattcctcccactttattactctttgtcaagagtgttttagctattcaagacctgctgatactgatgctaattgctgtgtcttgagtaataaagtttttctctgatccaggagtcttgtcagctgccaggatttatgaaagagtaacaggtggacttgttatcttctaagtaaagcaaatctcagatccttcccaattcttgctgcatatttccttttcttagaaaatattaaatgaatgctttggaaggaccaatattaaaatagatgttttaactttttatttagaaataattacagattcatagggaaatttcaaacatggtagagagagctcttgcatacctttgattctcaaagatacgcaatctttgtgttgtatatcaacccccagtggttgcctcttacataagtgtagaacaccgctaaaaccaggaatttaatatgatacaatgtgtgtgtataattccatgccatttatcacgtgtgtggatctgtgcaaccactgctgcagtctagatacagaactgccccatccccacagagatgggcttatgctaccctgtgagaggtgcatgcaccacactcctccaatcttcccaactgctgacaaccacgaacctgttttccatctctctaatttcattattaggaatattatataaatagaatcatgtgtcctttttagagtaggtttttcactcagcataatcttctgaatattcatctatgttcaatataatacacacagtgaataaaacataaataagatgacaaagttgggaccaattgtatcagatatagccatgattttaagggagtaagctcatctattaaaagaaaaagattttcacattggcttactgggcaaaatacatgctagtaggaatgtaaaattgtagacatagtgtgaaaaacagcttggcagtttcttcatattaaaaaaatgcattcttactatataacccaaaaatgacatgcctgagcctttatcccaggaaaaaaaaatgaatacttaggtctacaaaaaaaaccttgtacataattattcatagcagctttacttgtaatatcctaaaactgaaacaatcaagttgttcctcagaaggtgcgtaaacttctcaaggagataaacaaagacagcatttcctgagtttttcttttttaaatgtgtttctatgatgtttagagtttaaagacccttaataattcttttgtcgattcttctggaatgttccactactgtcttattttgtattttgtgatcgaggagtctgatttcaaccttttcttccattataagtgacttagtctttttacctgggatctaaaaggaatatgtatttgttctagtatttattatatgtatttattctctgcagttttactagagtatatctaggaatcaatgattcttttaaatttccccagcatgtaatagaccccttcaaaatgtagatttgagttccttgattttgagcaagttttcttgggttattgttttaaatattagtcttgttttacagttttgttttttcttcttcagggattccaattatgcatattttagttacttttcctatttggatatctgtatattttttccatatcttttctaagtttttgacattctgacagaaggtgtttgctttcattatgtctgcagttgcttgtttgagagtatttaatgcagacatgagtatgatgttacagtttgcctctgatttctggttattttagggaaaaaaattaccagttattatgtattctctttttaaaatttcttgttagtacattgatttttattcatttttaaatactgtgtttttcaaaatcttaaaggtaaattcagggatatagagtttgaggggctcgctgggtttaatccttgaggatttcttccatggtgcccatttggtggagaagggctggtagctaaacttctgctaattttaattctgtttacttgtttaggagcattacttttcaccacttgcttccttttcctttaccaccaaacgtctaaaggatgcatccctctgctctagagacagggtgttcacgaccaggcccctcctggtctatgcacttccaagactcttccttttgattccccagtcaaggaggatctgtccatcaagtctcaacagtattacctctatttctccatcagggtggggccccttgtgtctggtcaatatcttgattaattgtcccacattgctaagcatgctcctccactctctcctttcttcatatagtctatctatttatctatctagctatataatctatctagctatctaatctatctatctaatctatctactctatctcatctatccatctgtctatcctgtctatctgtctatcctatctgtctatcccatctgtctatcctatctgtctatcctatctgtctatctatcctatctgtctatcctgtctatctatctaccctatccatctatcctatccatctatcctatccatctatccatccatctacctatctatctcctgtcttcattatgtactccaaagctggtcttctagtttcatttttttttcttatgtacttgtaaagtgaagtttatatgtttgttatttcttggttatgctagaagtacaggttatggtggtttcactggctctcttggttgaagggtatgatgttggagggtatgtagagaaataaggcagtcatcattatcctacaggaccctggaagtcccacagcttgcaaattctaaactgctagttgaaagcacgtcacttccagtaggtgaccccttaagtccatgaagatgcaaacaaacagccaagagatctgaaagtaaatggatttcatcaggctaaacaaggtactcagtccttaaagagggatcaggccttgggttgtaagcgtgtgtgatgtactgtgcccttgtttcttgaacactctactccccactctgcccaagcactccccactccctggactccccataaactttagagcagaatgtgggagtaggagaaatgaaaggcactagagaatctgctggtgatctggaaacttatgtctcctacttaaagtcttttctgaaaatgaaatcccatagagcaactccatgtcatcaggatggggcagaggacagaagaagtggtgatgtagcaaattggatgagaagcagagaaatgcctttctctgcccgccggcagggatatgttaaacaggaccctgctagtgaaggctgcagttttagctgcccagggagagccagaatgaatttatctttattcatttgtttacatactgctttattttaggacaggattacagtgactagaagcctatcaaatacttgtttagctatcatataatcatcatgaagcctggcacatccttgtttctccttttctcgctgaaaaatactttcaaattttactttttgttttttacgttacacatccagaaaatgaaactacggccacattcaggtcttcattaatattttagctccctatagttatttactataattgttgaagaaaatattaaaaagaaatcaattcaaaatgttattgtgctgaatttcagaatattattggtaagttgggtacaaaccaaggttacagtgtatttgtgtctgaacaaaagcaaaacaaaaccaaagcccattttctaacctgtacaccaaacccctgagtcacgaatttacctgtataacaaatgtgcacattgtattttagctttaggtacctctgaacctaaaatatttttcaaagcccattttctttctcttttccattgaaaaggatgtattcaccatcctattaatgagagtttatgtaaatgacctttactgagaattttaaaatcataataaaatggcttattagtatctctagcataaggactaggaaatagaggacatggcgatgtgaaactaagtgtactaaatatcgtctgttaattgataggtagaacatcattgccctggactcagcagttctgagcactccagtttgctttggctacgtgccaatgcatgctctggttatgcctaggtggaatttgtagaaaataatcagaacagccccctgttcccatcagcaataaaatagctgttcatgcaactgggaacagtagtaaattcttttttatttcctagttcctatgcagaaggtcaaatccctggccattttcagatgtacattatgttaaacatctataaattaagagcaagaacatgagctgaatcttacactaaaagagagacatgttttctactacaaagcacttaatcccactagatacgatattattagagcatagcatccatatggcatattcttgcatcctgatcattttgtagcaaagaagtgttcttgacttctcttaccatccacacagcttcccactggagaagtctgtggatatgtccattcccaagaacacacgcaaacctgaggcaggaaagggacactagtattttttccaatacctatcactaatccaatttaaaaggctcatctagttacagaaaaagaggaaggctatattctattcattttttaaaatggttacaataaagcttttctcaaagtcatttattctacaatgaaagcttcctttctcaaagaaataatttatgtccatgtaaacgaaatctccttgtcagagatctaaaaaatgacacccttcattgcatggactagacttccacaaatccatgctaatgatgaaaataggggtattttagtttgggatggatcctagggttgcctcccactcactgccagggatttgcggcttcttttaggataaatgaacgtaatttatcagcctcaatagatgttcctagaattcatattactatgaagaactttttctgcatcccccttcttaaagatagtggagtcttaacagactttataattggaaaatgcaaaacaaaatcaactaaaaatggatttgaattaatgagattagtaaagggcctgatataaggtcaatgcatggaaatcaaggacaaagaaacattgcatatttagaaaaggcaatagaaacgttatttttaatgacaaaattctaagattttaatagtaaaatatttgagaaatgtgcaagacctaaataaaaacaagtatataaatctttatgaaatataagattgcataattattgagatggtaagatatgatgtctcttatgcaataatcttatgcaattgcaataatcatgattttttaaaaagtaaaacttgacccactgatcctaaaatacatctcttatgggatcccctcccttcctagagtcctctacataaggcttagacagccaaaaatcaccacagagcgactttcctttccaaggaaaggacaaggcaagacttttcttgccttgtcacccagtgagattaacactttgtgcctactgtctattgttcttaggccagtatgataggtggcatgtctaacaagaatttgtgaaaattttaggattttctatgaaattatcatctttaaaaaaaaacgtggttggttgattttatgtatttgtgaagaggatgcagggaatactactgctctgtgggttgaagactttataaagtaatcttaagtgggagtttcagtctctgagctggaagtcatccaaaggttctagatgcctcctgctttgagtcgggcataaggttctgttctagaggatctgctaccaagagtgagcaaagccctagacatcttccctatcacatatgagccatgtcagacccggggtcctaaaaaggaaggaatatgcaggaaatgcctagatattgcttggcatactttcataagaaataaaactgaaactttttcctcaagtttaattatgttaattttccaacttttcggagctattttggttaacatggattaaaaactatcatatccaatgaagggaggtgacccttgctgttcaacgggtgtaaagcttcagttatgccagaagaataaattctagagatcttctgcacaatattgtgcttaccttgaacagtactgcgtcatacactcaaactctgtgatctcatgttcagtgttcttaccaccattaaaaatatataaccaagacaagaaaaaatttgtcttccaactccatcatttttttcatgctgctattactgcttctaatttccaaatacccatacttttcctttgactgttttctttggtataatagcctgtccatattttattcattgcagcatctaaatgcccttcatcaaggcggtggttaaaatttaagaacaatcttgatatggaatatgctgcagccatacattcatacataaacattttaaaaagcagtcttagactgtatgtggagagatgtagaaggcatattgttggtaagcaaaaggactctctctcccacttcccagaggaaatagaagtcatcatcatagcatgcttcccagtacgaagcatacagacatctgtgcccgtcctccccacttgagcctcctgtaataacaggggaaccataataatgtcaatacctccacctatagttttgatcattaccacctccttgaagcacaaataatcttctctgccttttatcccatgcataatccaatggctccctcaagactagatccttcccatgatattttagatatagtccaatttatgcacttttttccaaaacttgtccctgctttcccttaagatattttaccttctcaccttcacagctggactttttggttcctccttagggaatccaatccttgccctgcattgcatcatcagccccccgctccttttttttttttttttttttttttaagacagagtcttgccttgtcacccaggctggagtgcagcagcgcgatcttggcttgctgcaacctctgcctcccgggttcaagcgaatctcctgccttagcctctggaatagctaggattacagacatgtgccaccacacccagctaatttttgtattttgagtaaagacggggtttcaccatgttggccaagctgatttcaaactcctgacctcaagtgatctgcctcctcagcctccaaagtgttgagattacaggtgtcagctaccgcgcccagccccatcagccccctttaatctcttttctgcactatctccttgcaaagcaggctgttaaacatctctctgacctccattggttaaataatactaatattttaagtcatttgattattcagaatcctttcgatacaaaatttaaaaaggaaactaatttaagttagccttaaaagtgaattgatttgataaccaaaagagcaatgggagaatggcctttggtcagctagtgtccttgtgcttctctctgctttaaccttgctgtgtgctggcttctcttatgacagcaatggctcccataggcatttacacacagcttgtggaaaaataagggtgtccttctttcattaccaaggagcaattgtgtgagtaattttgctttcaagccaatccatgaaacagagaggattaggatgacaagtgaattattaaataactttcagagaagttgttttttatacaatacactaaaaataatataaaaagtacctatttattgaaatctagaatcaactatttttaattttgttcacacttgttttaactcctggttttaaaagacgaatattccacataaatacgagatgttgactcacacaggctcccttccttttacaaagagtgtgatgggaaaatcccaggactgtacaggagaacatccctcaaaaactgggaaggagctgagagaccaaagaatgacttgggcaattccagcttgaggagtagatgagtttattaggattcacaaacaggacattttcgggcagcatcaggagaactctagagatccacccaccacacgcctctaagctgcttttaagctgattttgtggctctttggctgccgcatgtgatgagactcttttccttggtatgttcccagatacactctaggatgtttgggttctcagggacacctgctcctcagctgagcaccgtggccttggctcatttcccagcttttagggttcaagcagcgtacatacagccttaagtaaactggtaggagaaacatcaccctacaaaggaacatattatttttactacataggcaagcttgaaaaaagcatagagatgattctagctgcaagaaattgaaaatcagtttcgaatagtaaggacaaacgattatctgacagtctatgttattttcagacccatgtatattccctgaggggatgatgtctgtagtttgaaagattcacgatggaattctacttctggctatgggggacttacttttatcacaccaacactctcgttaaaaacatgggtaaatagtggatatttttcaaaatcatctatttgaaagtatctaagaaacatcaaagcaactggatttagagaagccaagattcaagatagaaagccaccatgtttgggtgagtctagcctttaagaccatctataccttgaagcgtttgccaattcgtaagtaacacaggctgcaagcccacccagaaagaagaggctatggcagatagctgagaagaattttaggcagtcttatgagactgagactgggacaaaaaaaaaaaaagaagaagattttggctaacttccgaggcagccaggacttggggagctgaggtcccggagaaaaggaaacacagagaactgagcctgatatttgactctgtgttgcttcccgaggtacttgccgtctggtaggtaatcactaaggggctgaagaagccaagctgaaggtggtggctaagagaacttccaatagactcatgatattgggagtcaaattcagatttcaggatccaccaaggaagagggacttctgtaaatatcccacatttctagtgggattctgaagggctataccccagaaatgaagacaaactgaacaaaaactagtccttacaaaaactgaaacttagatttgaatgagctgagtcccagactgcataaaattgatatatctctaaccacatgcagtgaagtgaactgataaagataacatcattcagacctttgtcatctgggcagagataaacatcattgagatcctcaaattatcgctataatgtttcaaacatacaaattatccctataatgtttcaaacataatgtttcaaacaagcattcaattaaataccaccaatcattccaggagaaaaaaaatggttaatagaaatggggccacagattatccaatatgagagtcaaaatagctgtgattaacatgctcaaaatatgaatgacaagatggaaaacttcagagaattgagacgtctaaaaaatgaatcaaacaaaaattctgaaatcctacaaatgaaagtaaaatgtaatgaagatttgatattgattaaaaacagttgaggagggtgttagtaaacagaaatgggtcactagaaatatacagactaaacacagaagaaaagagcaaaaaaatatataaatgatggataagatgcagtggaaaagtctaacatacttgtaattggagttgcagaagtttaagagaaaaagagattgtgtcaaggaaatatttgaatggaaattggcagagaatttttccaatatgacaaaagacatcaagaaacaaatccgggttgctgtgtacttgaacagggacacacacatgcagacacagacacacacacacaattgtaaacttctctggggcaggaaatttgacattgacattgagtcggcatgaagttagggctctggacttgaattttttgcataaaatctggctcttcccttctttataaaagaaatagcaaaatttcactcaccctcagaaagtaatgagaaaggctgacacatctctctcacaattaaaatggtgaattgtcatccaaatgaaggcttgcccctcttatgaatatcatatcccaatataaactacttgcataataaaagaattccaagctaatattaaactcaaagttgtttagaattgctgactgctgtagggctttgacagaggaaaagattaaaccgttttgttgaggccctttaaagaattctaggctcattggacacagtggtgcacgcctgtaatcccagtactttgggaggtggagatggtggatcacttgagtccaggagttcaagaacagtctgagcaacatggcaaagccccatctctacaaaagatacagaaaattagctgggtatggtggtgtgcacctgtagtctcagctactctggaggctgaggcaggaggataacccaagtctgggaggttgaggctacagtgagccatgactgcaccactgcaccccagcctggacaacagagtgagactctgtctcaaaacaagacaaaaagaattctaggtgtatgagttttctacagaagagaaaaaccttctgaagatgagcttactttaataaaatagcaccaaccacataaataaatcacaaagagggaaattcaccaggtacaagacaaaaaagcgaattagcatcttaagaactgcaagtaatgggaaaagttttacaagaatagaaaataattttatttaaaataaatataagaaaaaatagacattatattggaagggcataatataaaagacagaatatatgtaaaagaaacaaatagaactttaagatattttaaaatgccattgaaatggaaaggattaaataaaattagtctatctgagaggattctcagtgcttagaagatgaatctggagaaatcatcaagaatgcagcacaaaggttgggcgcggtggctcacgcctgtaatcccagcatgttgggaggtcgaggtgggtggattgcctgagctcaggagtttgagaccaccctgggcaacatggtgaaaccctgtctctactaaaaatacaaaaattagccaggtgtggaggcaggtgcctgtaattccagctactcaggagactgaggcaggagaattgcttgaacccgggaggtggaggtggcagtgagcaaagatcacaccactgcactccagcctgggtgacagagcgagactccttcccccacccctcaaaaaaaaaaaaaaaaaaaaaacaaaagaacaaagcataaaatatgaagatataaaaaccttaatctaaaatatgaaaaataaaatatgacatatgataaaaataagatatgaaagagtaagaatgtccaccatacatccaacatatgtctgacaggatttgcaatgaaagaaacaatggtgaataggaaagaggcagaagtcaaaatggtaattgctgaaaaaaaattccagaattgaagaaagacttgtattgttgagagttacatcaagtcaacaagtagacacataatggtttatatgtaaaattaaatataaaacaaaaagtcttaaaagcaaccccagagaaaaatcagactgctgttagaatggaatgacagaatgaatagatgactcaatgttagcaacaataagacaaaatactctaaaaaattttgtaatgctggagaaaagcaacagtcaagataaattaacactgaatagtaagggtagcaagaaagatattttcagaaacataaaagcaaaggaaattgattaacctagatctttacagaaaggagtaccaaaaacatattctttaggaagaggaaagtaaaaacagaaaggaggaagatgcaaatcacaatgatgagacgatatcacaaagtggtttagagtatagatgttctagtcagcgtgctgtgtgacaaagagtaaattactccacctctctgtgcctccatttccacatatgttcagtggaaatataaataatagtagcacttatatcataggtttgtcaccggcacatagtataagttcaataaatgttgattaaaaataagtcaaaaagttgctaaatttaaagtaatattgatgtaaaatgctaagataactattttaagaatttaaaaacaacagacttaaaacaaaatataagtgtaatgttggacactgatatggtaaaaaagaggaaatttgattaaagtattctaagatcattgtatttttttcttatacatgaaaaagggagaaaataaagacaatgcaattgataactgcagaagagtgagtgtgggctccagaccaccagcatcaatatacctgggagcttgttagaatgcaacttctcaggttgcactccagatcttctgaatcagaaattccagggttggagtccaagaatccactctaacaaccctccaggtatttctaatgcataataaagtctgaggtgctctgttagagaagataggaaaggaggacagaaaaaaagaaaattcatgacaagtggaaaacacaaactgaaatgatcgataataatccaagtaaatgcaaatacgtaggtttttctaagatatctccaattgaattgaaaacctagttatatactttttacaagataaatgcacataaaagacaggatccacagtgatagaaagtgaaaggatgggaaggatgactgcgatgtgttgggttggattattgttcctcatgcctgcctgcctttctctgttagaatattaaacctccctttccattaacttgcgtctgtcagtggaacctgcaacagtgacacgtgccacatatgaattttaactgcatgacatggctctgccttagcttttatcccctttgccctgagactgggatggaagctaccccttcagcctggtcccagaatgagagaagctgagcagagttgaagctgaccacaaggtcaggagtaggaaataagcattttgttataggaatcctctgagattgcagggctatttcttactacagcataatctaagtaaaagttgattgatacagaaaaatataacaggcgaaagctaccaaagaaagttgatgtaatgagatttttgatgttaaatcatgtattagaaacagaggctaataattcttcacccttatacacctaacaaaatagtctcaaaataaaaattaagtgctgataacttttacaaggggaaaactggcccaacacaagaaggaaatagtaaattcgtgaacttgataggagattttcacctgtttcataaattctggaattaggtctgcgttctaccagacctaagacacaaattaactggaacctttctgttggttggttggtgtgtaggtgagtgggtgggttttttgtttgtttgggtggttgtttggttttgggtgggtttttgttgttgttgctgttgttgtttttgtttgtttgtttgtttgcttttgagaggggtctccctctattgcccaggctggaatgcagtggcatgatcatggctcactgtagcctccatcttctgggctcaagcgatcctcccaccccagcctactgaggagctgggactagaggcaccaccacgcccagctgattttttaattcgtcatttgttgagatggggttttgctatattgaccaggctggttttacactcctggcctcaagagatcctcccacccctgactctcagagagctgggaatacaagcgttaagccaccacgcccagcctgggttaagagcatagactggggctggattgctgggtttgactcctgaatcttcacatgcactttaaattctttggtcttggtgacatcatctgcaaaattgtgaaatagtgtctatttcttgttgggagtcacacatgagttaatatatgtaatgtaaatttcttagactagtacctggcacacagtaaatatttttaaaataagtattgttgtaatatttagtatgttgacaataattactactactattactattgctattattattatacaagcttattccatttgaaagcagcatgggaaagacatgaaagccaagaacaggcttttattcactcattttcatgatcaaaaataaggggtctctctgcttccttagttctgctacttatatctgccagtagcagttcgctgtatttctctatttatttcataaacggaaatgagtctttttctgctgtctttttctcagtataagctaatatagagagctcaaaatgctttatttttgcatatataactctcttttttcaacaaggaaaaagattaattggtaactggttttccaataattcattcctctcaatattcctggctgcagcttagcacagctataaaagtaagcctgcacataataattaaacacaatcccttctcagcctgtagatggtaaagactagctcttaagaattacaacacaatatttttggtctagttcccttaagaaggctattttttctacttcgaatatttgaaaacacattaaaatcaaatgcaggcaaattgaaaatttccttaacaccctgaaatcaaatagtagaacaatataaacatttaatcattacatctgactttgctgccactgaatctttcaggtgacagtggcttctggcaccctgagctctgcatgttctctgctgctccagcatttaaccttcatggtcaaaggatgctgtcctagctctctggcctgttcagaagaaacaagcagcattctggcctttcatattacataaaatgatttcaaaagtcactgctgtgcacgtctacgtgtgcctccaaatggttcaaagtattgacacaatggtgtccattagaaaaagataaagtgacaaagcagcaacaagaaggctacatgctgtggttttgcaaaactaagaagatatccaaatatgataggttatgtgtttctgcacaatgtatttcattctgtttgtatttaggaattaatcccctgagaaactgaacattgctcacgtttgccagctgaatccggttaattacacaggctgagataaagtcaagggcactcgggacatgagcaaacaggtcgttaaatgcagtaactggagtggaggatcaggatggagagaagacacacagtgttttacagccctaatttgttttggaatgtcttggaaaggggctaaaaaggacgttaatctgactgtgcctgtaattatttgctgggacagtgtcactctgaacattgaataaatgccagattttaaatattattagatggccatctgaaatcctggtggtttttttttctgctttttttttgttatatatatatataacatatatgtatgttatatatatatatataaaacatatatgtatgttttatatatataacatatatgtatgttttatatatataacatatatgtatgttttatatatataacatatatgtatgttttatatatatatatgtatataaagaaaatcacaaacctagtcactctactgatgcaaatgatttgggggtgtcttcctagctttacaataagaggagggacctctgctgcaccctctgtctcagtttcagggcaacatctggtctctttggaagcagcttccatgcatgacataagcaaacagggccccgactttcttcctgaaggccacttttcacgcttttcaaactagtttctgtacgtctgaaacaaaccctctgcatggaggcctgcaatgtgcatagattgttcataactcagaacgttgactttaatcaattgctaaatgtgttaccttttgtttgaagaaaaataggatgcaagtgtctttgtatattcaaataaaagctaatgaatgaaaaatttccaataacataaatttcaactccacaatacaagtctcaatgaggctaaccactttctctcattgtttcttttatcgtggtatgcgctagtgcaggatactgacttttttttcagattggtcttagcacaattactaaaataatttcatttttctacttgaaatgacagatttagcaggattaacatctcataagggatacctccataaccaaaactggatagattttggagttttcacactgacctcaaggagcaatgcattccttttgctattacttttgaagacatgagacatctatatctgatttttttttttttttttttgagatggagtctcgctctgtcaccaggctggagtacagtggctcaatctcaactcactgcaacctccgcctcccaggttcaagcaattctcctgcctcagcctcccaagtggctgggactacaggcacccaccaccactcctggctaatttttgtatttttagtagagacggggtttcactatgttgaccaggttggtcttgaattccttacctcgtgatccacctgcctcggcctcccaaagtgctgggattacaggcgtgagccaccacacctggcctatacctgatatttcttatgctttgattacaaattcaactgaggagacagcagatgctgaaagtctgaagaagtagaagggacatgtcaaaactcagcaaattatatcctgtttttgttcattcaggctgctataacaaaaataccataccctggatgcttataaacaacagaaatgtatgtctcccagtccccgaagctaggatgtccaagatcaagtcaccagcacatgcagcatctgttgacaacctactacttcttgtttcataggtgtctctcttttctctgtgtcctcacatgctgcaaagggcaagggatctctctgggtcttttataaggacgctaaattccattcctgctggcagagccctcatgacctaatgacatcaacaacggcctcacatcttaatagcatcaccttgggagttaggtttccacatatgaattgtaggaggacacaaacattcagtttatagcatatgcataagcaactaaagagcaaaaagaagagactatgggcatctcctagataggaaattgaaattcagaaagcataagtaactcagtcaggtgtgagaaatggtggagcctccttcctattatactctgtaggaacaatttaaggttcctgtatgtgtaattgtcgggatagcagctctaaatgttagatcattcttaccagataatataaaaatgcaacatgattcaatctggtcaattttgttctttccacctaaaataattcttcattaaaatatagttttaatttactgaattaattctttaagctgaatataaacacagttgcaatgtgaaggaaaagtagaaagcttacataatatatgtaatgtggactgtcaccaatcacccctaactgtaaatacatgctacagatgttttcttacttgtctgagttggagccctgaactgtacccaggtgtgtccactctgaaaagctgtacttctgggctagcacagaaacaaacagtaatcagaaggggttactaacctatttctcaccttggttcttctgaataaactcagaatttaatctcaccatcaatatattgatgcagatctcggctcactgcaacctccccctgccaggttcaagtgattctcccgccttagcctcctgagtagctgggattacaggtgcctgccaccatgcccagataatttttgtatttttagtagagatggggtttcgccatgttagccaggctggtctcaaactcctaatctcagctgatccacctgccctggtctcccgcagtgctgggattacaggcatgagccaccacaccccgcctccaggagctactctttatagtcttctctcttctgtcttgtttctcctgtggttctgttttgaggctttcacactttactcaggatgtgtacttatcacagctacttttggaaggattgctgctgatgtaatttattactctctttacctcgatttttaataaagaaagcactttgaaaatgtttttcttttactctaactatattctcaggagtttattactacttgctccaaatctgggttgtttcccttttgttcactttggacttttgtctaaagacctctgttagtagatgaatattgcctttgaacaaataaaaatatttgaacacagttttacattgatctattttaatgaaccaaagcaagttttgcatgagtgtgcagtaatagatttccaatgagacttttaaagtcagttttaaaatctgcacttttgaagattaatttcttgtgccatgccaatgaaacactgtcccattgccaactccacaatgatgtttagctttactgaacttcctcctgtgaaactgatcttcaagccaagttaaacttgtttccttcatagaaatagttatagggacaaatgactttaagcaataggatggatccagccttcaaggtgacatgtattcaccttagctccaaagccaattaagtaaaccaaaggatcctttttttgaactatcctaagccattccaaaattatttgttttatctcatggaaaatgttttgaatctcaagtcccttaaaacatactgcagttattaacaaagtcaaggagttaaaaggcagtctgcctgcagaatctgctgaacaatgtgtcaaccttagggatatagttaaaaactggaatggatctggccagtccctttggtctcacagaaattcctaaaccacactgtactttgaagcaattttccaggcacccctctttgcaagttctgcattgcttcagggtcctgacttctaaggtttattttaagatcttctaaaaagggattagaaatcagaggatgaagggtgggaggacggagagaatactaggcttaatagctggatggtgaaataatctgtacgacaaacccccatgacacctgtgtaataaacctgcacatgtacccatgaacttcaaataaaagtagaaaaaaaaaaaagaaatcacaagtcagttgaccacagaaaatcccttcagcctaaactccacctggaatatgaaaatgggccccaatgacagataataattaaatggtccatggttgattatgataataaacacattggagaacactgttaattgggaaaatgttaactaagaaattgtggagatgcatggttctgagaagaatcggggaattttgttatcctttccccacaccctaggcacagtattgtgtttggcattaactacagtggagcttttaataaaattgaacaatattttggaaccaactgaaggcaaccagtgaaggcaacaagcctatcctcaaatctctaattttagatactgtgtgactctggtggctgtctttagaatgtttgtggaatgtgcggctatttagtgcctattgttctcaagtggtagctttagagggctccaaacacaagaggacaaatcccattcaacaatattataaagtttactttaataaaatttctgatttataataaaaatacactcctaatttatctcatttcataagccgttaattttttttaaagggtgactaggcaacaaatacattttaaaataaaatgctgtgtgatgtttggattggggtacaaagctaatagaaaacaaaggttgaaattttaaatgtactaatgcattaaatgtttgtgttaattaatttcagaatcgaatatttgaaattcttgtagttttaaaaagtaaccagctggtttattttcatacttctgtatgttgttttcatacgaatttcatcattactcagaaatcatttttcagacctgttagtgcttttctgcaaatatatatgatctttctttccaatgaatggaaaattaatctgaatatttattataggttctcatttgatactggcttttaaaaagccatctttatgagctgtacaatacttcatataaatggaacatgtaaatcttaatgatcatctttatgcaaattatcagaataattatactttttatgctcctcaataattatttgtatttcaacatcagtggtccttgtgctttcttcttttatggaggtaagactagaaggaaaaaaataattcctagtggtgtaatggtcaaaaccactagcggccctcttcttggaaataaacaaagatactcatcacattcctcccacgtactaactgcaagcaatatcaccctgtaggcactcagggcttctcagactgtgtgcatttaaagggaaacatatggaaaatatttcgcttacttttcattcactctctgactacccacaatgtgccaggcacctgcatccaaagaggagaaaatgccatcttgccatgtgcccaaaagcagcagctctaaatccagctgaacaagaaactgtgcaaaggatcccaccaagcatgcttctgctcactgaacatcattttcttcctaaaagcaaaatgtggccaggtgcgatggctcacgcctgtaatcccagcactttggggggccaaggtgggtgggtcacgaggtcaggagtttgagaccagcctggtcaatatggtgaaacctccgtctctactataaatacaaaaaaaattagccaggcatggtggcacatgcctgtagtcccagctactccagaggctgagacagaagaatcgcttgaacacgggagatggaggttgcagtgagccgagattgtgccactgtactccagcctgggtgacagagcaagactccgtctcaaaaaaaagaaaaaaaaaatgcattaactcctccccaaaagacactaactcaatgtctcatccagtcatgactccaggattctgggcaatgcaaggttgtccctacagccagtccagatgtgactctttatgagctagaaacctatgacccaatgcacacttgtgaaatgagatgggatagacagtttcagagcctccttgctatgtggaatgaggtatttgattatttgtacctaattataggtacctaattatttgtacctaattataggcacctaattatttgattaggtagtaattttgcactctgggagggggccaccagtccattgttatctgaagtgatgtcattttctgggagttttccaattttctatcgtctgccttaactcgacctctgaagcgagcatgggagcatacactttctttaggagctaagaaacttcttcagatgctttctgccctagaagctcaaggatgatttataagctccaaaagcgattgacttttttagagaagttttggatttctttggcagtttaactctttaaaactttgcagttttgtgatctatttgattttacttggttccatgggccagtagttacacccacagttttgattttttttttttctagaagtacttctcttcaatcctaagcctcctgctgtttctctctcagaccttatgccctcaggttttggtgggagaaccacccctttgctctcttttccctgaaccatttctctattaagcaagcatattgggcttcacctttgagcagaccttgactctgagatgctttcaaccattcacaggctttaagaaagggcatgtagctcaaaggcttatcatttttattttattggtattgacttggagttgcgaagcagttgcctttttcaacctcgaaaagctccaagttttaaatacactctatctccttttgatcctgtgtgcaaactgagcaattctttttcttaataccctgccaaatacagcctatggcaactaacatatgctgataagtttgttaatattctatcttccaactccttttcctagggtggatattttctaatccattcaccaagttactacaggtgacgttttaaccaaatatttccctgctgcataacatggatcagcctctatccaacgcccagttcatttcctttcccttgctgactgagcaccaagacagtgacacatagcatcacccttctcagctgacttctattctttatttcttttatttttttttaaattagacaggaaatgttaggcacgcacctgtaacaaacaatcccaaaatttcagtgtcttaacccaaccaattttttttttctcaattacacagtgagtctgcagaatggctctgttaatcatcgacatcacatattcagactgatgcaggcaccatgttgccatttgctattatattggcctatttatggtgttttccacatagtgggactcaaaaacatgttcattgaatggaatggatgatgtgagatgaaggaatggaatgagttagatgacagatgtcaaaaatgaccccaaggtttgttacatggattgaataagaaataactatctgctgacaaccctgggtcacctttggcaaaagttgcctgcaggctgccatcagcagggattcacaagctgtgtactcagcatgagaccaactcaagggagctttcctctgcagcaatgaggaaatagcttcgttttaaggaaataagtctgcctatctgcaggctccacctctgtcagtaggagccaccagggacactgtgctcccagaaggaccccccctccccgccatcccaacctccctttagttctcataattttccatagagcatcagcatggggctgtcagaattaatctcaacgtgccctttatctctgtccatgtcagctacatgctctttctcctgcctctttcatctctagaatctcatatcttgggctttatgatggtctttccaactccttctcatgcccctgcacacatcctgatattctttttatgctactagaagtcatcatcaaccaaaattcttgatgtcacttccctcagcagctattgtgccagatatttctcttcttgacctaaaaaaaattacaaaataaataacttctagattgagttgtctattatttaactgtctgcactgactccaacttctgtttctcttctctcctgctttctcttgcacctattcaagctgtcttttgtcttccaacaaagacaataagggaagcctaacaaaaactttccttattaagggagctaatgctaccttaagaaaaaggtaacaaaaactttctaacaaaactttccttattaaggtagctatgctctccaggttggaaaaatcttacaatcaatttttggacttcatttgacttgagctttgctagcatgaaaaagtcagctactctctcctccttgaaatattttttgttcttggctttcagcatattgcacatttttctggtttcttcttccttaaatgtctgttatgtcttagttgccttccctgtttgtttcccaaatatcgaactgtgggagtatctcaggtcttagcccttaaatgtcttctttttttctacctactcagacttcttggtgatctcatttagttccgtgactttaaaaggaatcaatatactgttgactcccacatttataagtccgatctgaatttctctcctgaataccaagctcatatagtgaactgcctattcatccatccacttcaataactaataagaatctgagaattatttctaaaactgaactcttgttattttcctctaaatctgcttttctcatagtcttcatcatctcactacatgataaatccatttttccagttgtaaaggctcaaacttttgtattcatctttaatttctctttccctcatactctgcttgcaaatcttgtaggctttcctgaatatatcctaaatgtgaatgattctcatcgccaccattccccactccactgctatattgatcctagttaccattcctcttctcctgttatccatttccactgcttctcctcaaccctttttactgcttttttagtggcaactttatttttgtattttactcaatgcctcttaatacgtgttcatttgatgctattctaccttacataccttgtactttaaaaaaacctaggaatgtcttttgtcacttctttcatgctattcttttcatttttcctatagtttttgttcatttccattcttagtttatgaatttttgattcaagtttatattttacaccctcaatgattgagcacattcaactatttttggagtgtactcatagttttcttctgcttcatgttacttttggggattgaggtgtggtaggagtttattttccttaatttatttgaatttgtgtgaattttcttgtcttgaatttctgcagtagttctctatggacttttgttttctttgctgatttttgtgatatcgggatgatgtataagagtcctagtttgttgtttggctggatttgatcattccgcaatgtatgtgactcaaagcatcatgttgtacatgataaatatataaaatttatatctcaatctttacaaaattacatatttgaacaaaaaaggttaaaacacagcatctgactactcaatagttaacagagtttgtaattaaaagtactttgtcaatgaaaaagtcctagtttaatattgccctttttctgtcattttaataaggcccaggaagtatggtagggttttgtttgcttgccttttgtgatagggatggtcagttccctgatactgtggcaacatgttacttacaggaccctaatcttctactttttcttcttttccctctaccacccaattgctaaagggtgtttcttcctctctctttgcttttattcttttcccttcaacttttattttaggttcaggggagtgcatgtgcagggttgttacatgggtaaattgcagattattttgtcacccagaaaatgagcaaagtacccgacaggtaattttttgatcctctccctcctcccactctccaccctcaagtaggccctggcgtctcttgttccctcttcagtgtccatgtgtacttcgtgtttagctcccacctaaaagtgagaacatgcaatatttggttctctgtttctgcattaattctagtaggatactagcctccagctgcatccatgctgctacaaaggacatcattttgttcttttttatggctgcgcagtatttcatgatgtaagctatacaactggaagacttgctcctctaaacccaatgtgttttttaaatcacatgcttggccttttatatgacacctgtcctttataccagatgtccttcgaaatctcttccttcgaacattttcagtactttcaggttactggtggatctaatctttctggtggttgctccaactctccctcggaccccttcccgcacccccccgccgaccctcctggctcttgttcttggttggcttttggcagatcagcattctctgccttgagattttcttttccacttcatgttaataatccggaaattcctatttaatttattaagcttcaagtagatttaatcacaccatattccttatatatatttctcattgctttcatacatcacatcccattaattagcgtgcttggaagctttcctattagaaaggaataaaatatttggcctttatatttgttttggtgttttattactgacataacaaattgccacacacagtagcagaaagcaccacaaatttattatcttatagttccgaaggacaaaagtccaacactggtcctcctcggaagaaaatcaagctgttatcaatttgatttttttgaacatatttatttatttatttatttattgttatcaatttgattttccttcctttcaggaggctctggaataaatacactttcagatttgttggtgtcgtttggccaaattcagttccatgttcaatggggactaacgtcaaaatgtttttgtaacagatttggtacagagaaacagttttagagctctgtatgatttcagacttccagtttagatacccatatcgttggctatgttttcatattcctgcacacagctcttcctgtctctttctctctcaactgccaaccacctcagaagagttgcacagaaagcaattgcttttggggtcttaggaaagtatgactaagataaagggtcttgatagcacctcttcctcaaaaagttgtctgcttgattattgtattcttgagaaacctaaaaaacttgtgcatcaattttttttttttttttttgagtcagagtctcactctgtcaccaggctggagtacagtggcatgatcttggctcactgcaacctctgcctcccaggttcaagtgattctcctgcctcagcctcccaagtagctgggattacaggcacaagccaccatgcccagctaatttttgtgtttttagtagagacagggtttcaccctgttggctaggatggtctcaatctcttgacctcgtgatcctcccaccccggcctcccaaagtgctgtgattgtgggcatgagccaccgtgcctggcctgtgcatcacattttctattggcatctattaagaattctcccccaatgctggctttccatcacagaaatgcattcattctcaaggtgagcttccaagttgtcggaaaggatcctttttaagcttgtaatttttaaaaaatatccaattcccatctttgcctccctcccccaacacacacacacacgcacacacgcgcacacatacacacacactacaccattcttttcagatcatttactggtgtccatttctgttctttcttgttttctctggattgttttaagctcttgtgtcattcactaacctccgtattaaagaattttacaatgaattattgtcaggcaaaaaagcagcacatttgattgttctatcaattgcagctatttgtcatttgttactttggaaaataggtaggggcaattttctctttggccatgtttgaaagcctaatctcactccttcaattcataaaagaagtagcagaataaggttttctctattgagtccagaaagttgatgtatcaacctgctgttaaatcaaggaaaacaagtcatgattatctgcatcaaagatgcatttaggtggtaacacatttccttggctctaagttgactttttctaagattccactgtcatatctatatagaaaataaaaatttaatcaagtgctgatcacaaataaaattagaagagtttatgcaaaaccttcaggttgcataaatattcctaatgaggttgaaagaaaaaatagccaataaaataagaaaccttttttgaatagatgatattttatcattacctaagttcagtagggaaccatgtcaggtagtgctctgtttctttttctaaagatctattttatctagctaagcaagacttataaactctacttaaattgagacaatagagacctcaaaatatcctccaagagactactcaccaaattatttgcatttggctttagaatttgttttgaatttctgggaataaactgcaaatgatatagacctaattgttccatatttatgtattcatttccatatccaggtgcagttctagggtaaagggtgactagatcaagtaagtttcctgcactccaatttcttaaagttgactgggaaaggcagaacaatcgctcattgatacttaggggcgtctacggccataccaccctgaatgaaccaatctcatctgatatttaggggctatgataaaattctctacactgttatggaaatgtagaggaaaggtgtcacatctaaacatgggtctgaagagctaaactaagaaggccatatttgaaccacattttaaaggactattaggtatcagtgaactttgtggaagggaggaaatgaggggaactccacagaaaggaaataaatgcacttcctacttagaaaactaatcgtacccccatctctacactggtcaactctacaaatctgacttcaacagaaaaagcttgttcctgtaggctaaccagagatccatgcttttgatctttgctgaaacaagcatttaggtggttttgtttgttagtttgtttgtttgttttgttttgttttgatggagttttgctcttgttgcccaggctggagtgcaatggcgcgatctcagctcaccgcaagctccgcctcctgtgttcaagggattctcctgtctcagactcccgagtagctgggattacaggcgcgcagcaccgcgcccggctaattttgtatttttagtagattcggggtttcgccatgttggccgggctggtctcaaactcctgatctcaagtgatccgcccacctcagcctgccaaagtgctgggattacaggcgtgagccactgcgcccggcagtgtttgtgttttaactggtttcttgtcttcccactattaaaaaaaaaaaggggggggtgggggcggtggggaaacaaaagtccatgaaacatcagcaaggccagttaagtagaaagtcacgccagttttcaagaatgaaagcatcatcaaaatgtcttatattttaatagttctataaattttaaatgacaataagggagagttttatattctctaagcaatagcctgtaagggaaacatttttcttcacttcacagcaaagcatgtatttaagacgttaataaatatgaaaacaacctttatcatcaaatcatagcaaatctgcacagaacataagaattagatagaattaagaatttctgcttatgctgaagacaaaacaggattattttgtctacattttccaaagattattaataaaagctaactccagtgggaactagatacaatgatttattattttcacacaaaaaagtcttacttgcatcttctaataaaataacatgaaactgatgcagtgctgtttttaattctgctacataattttgggctgatagcatattttctgtgtgtatatatatatatatgatgaaaactttttcactctgttttcaaatgtagctcattttggatcatttaactttaatgtcattatcttaagggctaaatttagtaaaagcaataaagcttgaatctaattacttagtcaataggcatttattaaaggtcttctatttaaatacctcttctctgatccccttcaaatcagaattaaaaatagcactgcatcagtcccatgtcactgtattgtaagacaccatactttccccagaattctgtggagaaatggaaagacactgaaacaacacagggaggagccaccatctttgactgaattggctttggactcccatcattttctctgcagtcagtcaacccatttgtcacataattcaccatttaatttaatctctagtctccatttgtcttattattcccaaatgactttcaattttccttttggaaattaccaaatttcttcatttaactaatcctctatataatgaaaacattatttgtgtttctagtccagagaaaaagttatttactcaattaaaaatttgaacatagctgcaagctatctgaaaaaggcatcttcatgaaaaagcacttcatcatgaagagaaaaataaaaaactttatagaaccctttaatgtctttattctcccataatgaaatttaattatttacacattatgtgtagactaaaaagtttgaaagataaagcaaattacaaaggcactcggtctatgggaaaataaacattttaaaatgcagtgggtgggttcagattattgcatttgtattgaatctctgttctgtaaaaaaatataaaaatgaaaggtgaaagataatttagagaaaaacaccaattaaatagtgatagaaaaaaattaacatgcaatgaaagattaaaagacttcaatacatagagcttgcctaagaaagaagaattaaaaagcatagttgtaatatttgaaaggtggtgactgtcaaaaacagatttataaaaccaaagctttgtctaaaagtcaaagaaattcagcttatgtgcagcaaaactgttagctccaagtatacagactacaaaggttaatacttttgaggtgaagttttaggactgatcttattgagccaaatactagaaaatcatgaaaagaatgaactgatactgtttctcacatttttctacatgaactcagagctatctccagctgttacaggatgtcactcttgctaccctgcaaatgtctttccctctccaccccaggcatctccctcactcctcccagactcctccaacacacactcatacactcacaaaatatgactacaaatgcacactcacacacactcatcaaaactgctgtgtgcacacacacccacacattacacatacagtgctatgcacactcacacccacatactcacacacactgatatacacgcacgctcactaacacacacatcatcattttctctctgcttgccctgatactttcactctgctgagcctttggcatagctcctcagtttctgcctagctaggctaacagccttccagagcaccatatactaaacccacctgcccatcccactagactctatgattattgagagcagaaatggtgtgtttttcatataacctcctagcacagtgcctggcatatggagagttcacaataaatatttgttaaaggaatgagtcctgaattgtaagaatctctcttcctctctctctctctttgaaatagtttacagttcagtctttagtgtgacaatatgtactctacttttattattcttgctattcctattcttatatgctactacactactaaaatgctgaagcactgtctgcaagagacatctttatctgctggtaggagcccatgaatacctctcattgctgtgatgggagacttctttgttccagcacttacagaaattctgcatttagttctgcttgaaagagtccactccagtttcatagaagccttttactgtatgattgctttcttcgtctcattaaaccctgggacaaaagacttaacacaaagaaggagtgaattatatatttcttaaatgtctgggcatgcaccgacttactgcttaaagagaatattggcaccaaggtgctttgacatatttaacgttctgatttttactcccaaatagcacattagatattttcatccttatctgtagagaactggaaatactattacaaagaataatgcaaaaaagattttaattgcgtgtgactttacattatttttacatcgtggagtcttctgaaaattttaaaacattaaaaatttaaaagaaaaacatacctaatgttaaatgacgaattaatgggtgcagcacaccaatatggcacatgtatacatatgtaacaaacctgcacgttgtgcacatgtaccctaaaacttaaagtataataataaaaaaaagaaaaaaagaaaaacaataatcatagtgtctcccttgacagaaatttcaaacatttcttgatacatagcatgtaaattggtttaacctataatattttggttgactgttagaaaatattttaaatcttgtatacattttataaatacttatatatctaataaaagtacgttcaatatatgcttttgttgctcctataaattttttctatgaagtctggcatttacttcctaaaagaaaaaagttttgttttttgttttttgttttttgtttttgttatttttagtagcctccacaaatggtgcatttattatattggtagccttgtggttggaaaggattattttctgggttcctaaggaaatgcctgagcagctaatcccaggcctctgactccactcaagtgagggaaccaggccctcttgaaaatcttcctgatccttgacatagtttgatagtatgccttacatcagtgaggggatggtccctgacacatgcaaactgtactttcgtaaataaaagtgcttctcatgataggaacattggaactattatttttattagaacaggatcccatggggaactgcatgttctttcttttgttatttttaaaagtatgtcatggtcttgagaaaagtaaaaataaatgataaatttgtcttcacatctcattgatgaaacttatttttgctgcagcatgactaagctcagaaagaaaacattacccaaatttgatggtgttgaccatcaaggagagcccagtgttggtatttagatcccaaaagtcaagaaaacctgtcacagataacttttcatggggcatttaaaatgccaagacaaagggtgaggtgtcatccacagagagcaacaagagatttacagagaatccatattacactattctagtacagatttatgctgtatggaaaagtcagaaacttctctgggcagacgtcaatggaaagttcttatccaatttctgtacagtgatattggagcttggcctaaaatattaaacctgagaccccttttcaaatttctgcatagtaaaatagctggaagacttggttgatttccaattctgttttgatgctgaccaatgatttgaggcacagatatgatcctaacccttggctacctcactcgcacagggcttacaccaaagtcaaattcacttatgtttatgaaagcctgtgaaaactttagatatgacaggattttgtgttgatgtaacacattctaatgttttaagcaagaggaaaatgtgattataaagaaattgggaggtaatcatagaaaaaaaaagcaatgatctaatcaacgtcttaggtaattggaattttccaaagagaagagatacttttaaattctaccccaatttttttaaaaaataagaatagcctaatttgtattgtttacaaagaaaaatgatcacattctagagctgatttatgatccattacaattcagaatgacttggggatcaggtcttcaactcatacaaatctaagtcactttcaggaaaacattcatttgtttaatctaacctgacattttttcaactattacacttatatatttattttctattttatatttacttaatttacattgacataaaattaaatgtatttattatgcaaagcatgttttgaagtatatatatgtgtctatatatatattatatatgtgtgtgtatatatatatatatgtatataaaatgtaaagcatgatggctaatttattattttaagtaaattttcctccccaagtaaaatcaatctaaactatgctatataagaaacaaatattctcagactattatttgtaaataaggtaaagtactacaaataagataaaccacttaaaaatataatgtcaaagagtaggaaataatttttgggacttattttcacttcctaaatacagttttttgttgtttttttaaaggcaggttcttaactcttgccagttacctgggaaaacagttaaggaaatattcttcttccatcattcctagggagcattgcttgactggtgatgttgtggttactttcagagctggaggccgaggagtggtgcaagcacctctgcatggagtgtctggggaccaggctcaatgatatcagccttggggagcccgaccttctggccgcaggagtgcagcgggaacagaatggtaggtgtgagattgccttccatcacttcagaatacccttgtaattgtagaactttgaaactggaaaggatctcagaaatgtttcagaccaatcatattttttaaatcaaaaaggccgagtgcagtggcgcaaacctgtaatccctgcattttgggagcccgagggtgacccatcccttgaggctaggagttcgagaccagcctgggcaacatggtaaaacctcatctctactaaaaatacaaaaattagctgggtgtggtggcccgcacctgtagtcccagcttcttgggaggctggagcatgagaattgcttgaacctgggaggcagaggttgcaatgagccaagatcacgccactgcactccagcctggacaacagagtaagaccctgtctcagaaacatatatataaaataaactgaacagttcaagttattaagggactttcccacaatggtgtaacaactggagaaaatgctaaggtacaacccgggtctcctggcttcttgtctgtggcattgccttttatcctaataactaataggttaacttgttcttcagaaggcttttgaatggctagcatccctccagtttcttcttggagacttattatagatttagagtctatattaacagatttggcttatcaggttatcggtagcttttaggacatttggctaatattacaaggaagaaagtaatgagtaaaatctcagggtttcacaaaactgaggtttttgtttctaatggtgttgacttactacactgttctctagtttaacaagcatttctaatgtctcataacaatttatgctgcatgttcttgactagcaactctaaataacagaattggagtaatattattcagcctgtcaatattcattgattgtgagctcatttataaaaatatgatcaccaccaccagatgattgaatagtgtgaaaatagaaactttttagtgttgctaagttttgatgatcggtgttttgaaaggttgaaggatattgaggaaacttgacattatttattaagaagaaattctgggccaggcgtggtggctcacacctgtaatcccagcactttaggaggcagtggtgggtggattgcttgagctcagaagttcaagaccagcttgcacaacatagtgaaaccctgtctctacaaattacaaaaattagcaggctgtggtggcatgtgcctatagttccagctactcgggaggctgaggtgggaggctcgcttgagcctgggaggcagaggttacagtgagccaatattgggccactgtagtccagcctgggtgacagagtgaggccatatctcaaaaaaagaaaaaagaaagcaattcttgaattatctgtgggtcataaactaaatagcataggtaaaagagcacatgatagcacatgatgattatattctcattattactaataacaatactgtcaacagccattgctagctcatggcccattgtagcactattttttatttgttgctaaaatgaaaaaagtttttttctgctcgtggatcatgaacatatataataagttccaaatattgcttccatttgagtttttagaaagtcacaaaagtatttctgtagctctttatctagcttctggtttatattccagttcctctcccacactctctcaaatttcatctctgatttgttttctgagagcagtgctaagcagagtccataatcatgctgtttaaaatgtatgctctccattcacagtttaagaaaaggaaacacctcttactgataaaaatttgtcaagtactacataaagcaaatatgaaaaagtgaataaattaagcttgtaaatagaaatactgtgcctcttgtagcatggactgtatgctttttactttgaagatttggagatatatatggtttccatccaaatgtataatgtacttctttggtttatcataattttatttctaatttgataataaggtcaaagtaatttgtctagaatataaagagaaatttttaatataggtttattttagaataggacaaacagaataaagtgccaaagctacataaaaagcagaaggtgactttaaaacacatacacacacacacacaacacacatacacacacaagtcaaaataaagaaagaaaaaataattcctgtgtatactttacagtggacctaaaattatatcaccagtgctataaatgcttttcttagattaattatgtttaataatcctaacttcaaacaaaaggatatatgtgctttaaaaatatagttaacaaatctatgagtaatttagctggaaaaggtaatactgggtttatttaaatggcccacaaagatacatgatatcctataaggaaatttgcaactttagtacacatgctgggagacagacacgtactcactaagactcttcaatgtttagcattaaaagaaaattcctggatggggaggatttcctgtccctgggaatctccctccccttaaaggaagttccttatttgactgccaaggccacggatacagccattgctcagggttcgtcaagtctgcacccccctctttaaagaacttccataacttttgatgatatcccttttctgtgttcctcttggcccattcagagccagctagaactttttaaaatttgcatcaacacgttaggagaataataaaaggaataaacattgaggcaatatcaagatttcagactctattcttgctagctcaataatctagtgtgtatacacagagacaactatacacacacagagattggcacaatttcttaggtgtataccccagtgttctcactttctattcaacaggcttcccccatacttatgataattccaatttagaatgctctctcaaacaattaccagtaggctataaaacctcatggtaaagactaagatatctcatccgtcaacttggaccctcccacccagtccttggagtaggtagctatttcttagacaatatactcacttattttacttaaatgtgtagggaaagcattttagctaactgaagtctttaaaaataaaattgacttttaaagctgtcatttcactgactctcaatcactcttccagactcttcaagcataacaccttttaaaataaaatcattaacttactaatacatggttgaagtcactaatatatatagattgaataatcttttatcaaagaattagcacgatagattgtttattaagacattttagtattaaattatatagctgaatcttcatcaggaacatgattttattattttgccaataatgtgcttggatagtttgaactttttctactaagagatatgtgtgcagaattactgtaattaactacattaacatggtttgtggtgatcttgtagtattctatcagtatcaagtcacaccgcttagtctttaccacagcaattttttgacattcaaaaatgctacttctcttcttgtgttttcctgcctcttcagacagcctgagactagctaagaagagacatttatacaaataatttttaaaggtgaaagataatgtgtgttgctgagataaaagtggttattgattaaatcctttgctgtaatcatctttatctactgctgtcagcttgttttcatatcgacccagaatcccacatggtatggggaaagttacatgaacacaagttcacatgcacatgtgcataaacagacacacacacacacacagaggaaaatgtgttctgatttcagatgacactgccacaggaaagtgcatacttggtagacatttcaaagtttaaattcttaaaatttccaggatctccaggtctttcagtagtatttaagatagcctatactgaccataaaaaatattaatatatggcattacagttatttataaaggattcacaacacataatagcaattgtggaaaacaaatgttgcttattcatcatgaatagcaaaagtgaacgtcgtaaccaagaagcaattcacttgtaggaaattcctgcaaatgcagttggaaatggacacaaaggataggtccaatttgctactgatgcaagagatctccatctggaacaaaaataatggaacctcagactgccatctggtttattcagagtcagactgaagggtttgcctttctctgggacccagtgtctctgctcatgagtgggctacatacatttcttcttttagcctaaagatctgtataacttgtctcagaaccaaagcaatatgctagtgttgtttctaaattattacctggttgctatggtaaacatgcttcctacattcaactcagacacccttgaatgtcattcattcattctggactcaaacattgtgaggacctatgatatgtaagaactaaacaagaaatgtaaaattgaacaaaatgcttagaagctcacaaagtagtaaaggagacaaacataaacaaagtgcatcaattcatgttttgtaaaataatgttgtgttaccagtcaacaaaaatctcagtagtacagacctataagcagatcttcgttgttcaggcacaggtaaaaaggctaaagttgggctgagttagactgggttgtgctgagactggctccaagctgcagacaatgccagtgtctatttcatctgtctctcaacctccttacacttgcaacttcccaaagcacacttctcaaacaaaagataacagtaatgcatgatagtatgcccagatttgcaacacaatttgagcctttgaatatttcatgtccactaacattccattggccaaggcaagtcctattgccaagcccaaagtccagaagcacagtacaccccatctatgaggccacaatagcagttagaatgtatgacatacggaaaggaagtgaaaagctgatataaaaaatgatacaatctaccatctcaggtataataaaaaatatgccaaaataaaaacaaaaggaaagtactgtggtagaggtgagattaattctaatcaaagtagcttacactttcctttttataattatttcttattcctctaaattagctttctcaatcaggcaagtctgaaactcttgatgtccatcaatgattaaagccaatattagcagcaccttactcatgtggaaaataaccagttaatgacaaaacaacggccacagtaacaataggcctctctctgttttgaggattttcccccaatatcttactaaggatctggggtaaaccatattcacttatatacatattctttataaccaaacaaaagagttttccagggcaataattttatctatgggatgaccctgaacaaaaccaacttttgcatcaggaaaaaaaaaaaaacaagcacactcacatctgagtttctaaaacgccattcatatgctctagtcttgcccaaagtgagttcctggaaatgctactctgacaataatgacgacctgctctctgcagtgagggaatcaatctgttgaacttaacactgtatcacaattgtgtcccttccaagaagatatgttgaaatccaaaccctccataacttagaatgtgaatttatttggaaatagtttctttgtaaaggcaatcaagttaaaatgaggtaattagggttggccataatccaatgacatctaatatgtcactgtaaagtgggaaggtttggactcagagatagatatggacaagtgaagatgatgtgaagatgcacaagaagatggccatgtggctggagtgatgacacgtccacaagccaaggaacatcaagcattgcccattaacaccagaagctagaaaaagcaagaaaggattcttccgttgagcagccagagaggggatggccctgccagtactctgattacaaacttctagcctccagaactatgagatgatatattactgttattttaagccaaccaattgttggtactttgttatgatagccctaggaaacaaataccagccctgtatgatagtcacaatatacattagtaaagctgttgagaagtcctataataatctgtttaactttgtataacccaacatttcccaaactcacgtgacctaggtgcctccttctgcacctaacatgtattcatatcctgtgggacttgtgttccacgaaacacatatttacaaatgctgatataatcagcaaaggttattatctacagggaaagctgaaaggcaatgattatggaagcagcccctctagaagaaataagatgacactaatggatgaaacacaaagtcttgaatggaccgtagcaattttgcctgccattgtgttgtaccattttacttttattatttgatttatatagacaccacctataaatttgaaaaatacaaattataaccaccacttttctcacttggtcttcaatacacactacaccagaaaaaggtcaaagctatatttatttctccctatactttgccacagatgcttcaggaaagcaaaagatgttttgtagtgcttctcttctcacaatgtcaaatctaaatgatccatttgttcatgtctaactgtactgttataaaggagatgtatatgtgaagaaataccttgaagcaccaaaggaccgatcctggttcttttgccctgggaacatgccctctgtacagtaagaataaagatgcagattttgaaagtattcacagctatgtaaggagaaaagcttatgggggagaatactgaatccagaattactgctcccaggtatgtgcaacaagatgaaaagagtggcttgaaaagaagagttttatggaaaataagaaatagatcccttccttgcctttcctcttttcatgggaggtcaagtgggtagtgacacgtgcttatatcatcctgtataaattggaggtttcttcaaaagaagactagaatgtgattttccctgttgggtttaacgaaaggcataggacaagtagcagacaatgttattggaagccagagagatttaagaaagtaaagagcctcaattttctcaaaactgagtgtggcatggagagggtgctcaacttttccttagttacaggctggaccccagatattatctggaagcagaaactgacatggcacaggaaagcagggacaaggaactttattggcatacaggcgcatacaaatgagataagatgaccccttttcctctgccagctcctgtgactaaatcacttctgccagctttcaattcagcctagaggaaaaggcaagggtgctcagggattgaactttgaataacaacaacaaaaaaatgggttaagtgagtcctcatttgacagaaaattaacgcaatttaacacaaaaagaaacaatataatctttctaaattcaatatataatattgggatttcattttttggtatacgtaagtttcgattatccatttttttttcctgctgtactaaaacaaaatattgtatgaagctggaaagtcaaatacgtagcctgtcagaaaaaagttgacaaagttagtatgtcatcaagttctattctagtttttacatgctatggggccttggtcagattagtgaaattctcttaatctctgcttcctactctgcacattgaggataatgatagtccttatttcagaggattgttgtgaggactaaataagatatgacttggaaaacaggcagtacaatgcctggcaggaaagtcagtttctctgggatgtgcgtgaacatctccatcacattcacattgggtgcacattaaacaagggaattctgggctcacccacacctacaaagtaaatatctggaggtggagcctagacatttctattttaacaattctagtgatgctcatatatacattaaagcttgaaatttgggggtaatgtactgtcaattataattggcttaaaaaaaatctaccattgattttaggaatttgcccattgcttgaaaagtttcaaaattactggcaaaaatttcatcagagtatctttgcgttataattttaacatctttttgtagtacggtggcaacctttgcattcattccttttggtcatgtgtggcttcttttcttagtcggcatcactagacacgtgcctatgtgttaaacctcttttctgtattttgtgggctgaattttgtttcacgcaaaatgtatatgttgaagtcctaacccctggtacctcagaatgtgatagtacttgtaggtagtacctttaaagaggtaactgaggcagaggtgagccctaatccaatatgactggtgtccttgtaagaagaggaaatttgaacacaggcagagacagagggaaaaccatataaagatataggaagaaaatggcccagtacaagctgaagagagaggcctcagaaaaaaatcaaccctgctggcacgctgatcttggacttccagcctccagaacagggagaaaataattatctttctttaagccacccagtctgtggtactttgttataacagccctggcaaactttgtatatatattttttaattttattaatatttgctctcattcactattactaataattcagttgctctacagttttgggcttaattgctggttatttttcaaatttcttgagatagatatttcaataactaatttgtaacttttcactttaatatattctataaagctccacatttttctttgagcatggattaagaccttaatagcaacaatattattcccaaatcccagatgctactacaataaatattaaatctgaggggggatctaggggaggaagaaatgccctaaatttcccatctgctgtaatggaaacatcaaaatagtatcttatagctctggaaaataaagcaatatatcatttatacctcaaagttcactggatgaagataattaaaatataaaaaaggaaacaggaaccacatataataaaacaagataatataagacactagctttaataacaaatctgaataaattatttttatttaaacatagtttttcttagattgagttaaaataatctaatttcatatcattcagtggtttcaaattacacagtcatactcaaggagaaacagaaaatccaaaaagccctataatcatttaaaaaaataatatgttattatgcaacttccaatacataaactttagttccaaatagttgttaagttatatcagacacttaaataagaaataatactaatgctatgcaaaactattcagaaaaaacagaggaggaaatatcatttcacaactcattttatgaggtcactataacccagatacttgaaaccagaccaagtttatacaagtaaaggaaatttcagacaaatatctttcatgaatctaagcctaaaattacttttaaaatattaagaaattgaatccaatattatacaaaaaagataatacaccctgaccaatgttggcgtagcccaataatgcaaagaatcccagaaatccatcaaaatatttccttatgttaatccatgaagggtgaaaaattatgtgattattataattcatctgtaaaaagcatttgataaaattcaaaattcatttatgaaatcaactctcaaaaacctaggaatagaggccaggcatgacggtggctcacacctgtgatctcagcattttgggaggctgaggcaggtgcataattttaagtcaggagttcgagaccagcctggccaatatggtgaaaccccatctttactaacaacacaaaaattagccaggtgtggtggcgggcgcctgaagtcccagctactcaggaggctgaggcaggagaattgcttgagcccaagaggcagaggttgcagcgagccacaatcacgccactgcactgcagcctgggtgaaagctagattctttctcaaacacacacccacaaaacctaggactaaaatgagacactaacagactgaagaacatcattggaaagccctcagtaaacatcattcttgagagtaaagtactcaatgtttttctcctaaggttgggaaaaaggcaaagatatctttctcattacttctaatcaaactttttactgaaagtctttatgtaatatgacaagaaaataaactaaaattataaaaaatgataaagaagtataatctagattgtgtactcggaaaaccctaaaattctaccagaaagtaactatagctaacaagtgaattcaatgatgttgcaggataacaagttggtattcaaatttttaaatatatacttctatttcatataatgcaattaatattataaaattaaatattaaaataccttttataaacccatgaaaaaccatcacatactgagggataaactagcaaaggatacaccaagcccccacactggaaactaaatgtttctgagagaagttttaaaagatctaggtaaatgaaatgataaaccacttttatgattggaacactcaatatcattaagatatcagtcttcagagattgatctgtaaatccaacataatcccagtaaaccagacatgtttctttctagaacttgacaagtcaattttagatgaatttagaaggcaaaagaccaacacgagccaaataatcttgaaaaggaaaagccaagttgaaaccggtgtctttcctaattatagcacttattataagtgataacaattaggacaaaggctacagagatccagggaacagaacagacagaagaaatagacacacacatatgtagacaaataggttgttgctgctgtttgagtcagagtctcgctctattgcccaggctggagtgcagtggtgcaatctcggctcactgcaacctccgcctcctgggttcaagtgattctcttgcctcagtctcccgagcagctgggattgcaggcaccccccatcacacccggctatttttgtatttttagtagagatggggtttcgccatgttggccaggctggtctcgaactcttgacctcaaatgatccacccacctcaacctcccaaagcaaggacaatactccttttcataagcttattagccattttaatgagaatagtaaaacatctgaaaataagttattctagaatgactggatatctgtgtgaaatgatgaacctgaacccctatgcacaccacagttaaacatcaatttaagatggatgcaacttagagatatataaagatttcttatataaaacgctggaaacacaaactataaaaagaaatgttgaacttcatcaaaactcaaactattgctcatcaagaaagtgccatcaaaaaattaaaaataaaaagggaagtgacagatggaatcaagtcatgatgtgcgggtatcagtccacaagaaccttgtagagaataagcaaaactaacctaagagtgttagaaatcagatcagtggtggttctgagggcctggacaactgaaaagtggtgtaagataactctctgtggggacagaagcattacatgtcttgctgtgcctttgtcaaaactaacagaacattatacgtaagatatgaacattccattatatttcacaatatagttcactctttcaagaatgaaggacttattacaaaagttaaagaaaattgttttctaaataatgtaaacaaaaccaatgaaaatctgagatgaagtatttgtcataaacatctaaagaaaagtttccaatatacagaattctcacaatcaggaaaacaaacagtagatgtaatttttgataaatctggcaaaagacacttataatgactcgctctatatgtattttgaatatttattggtaagggatttctggaaagcaatttggcaatgtgtgattcttataagagtttatagtatttgctccagtgattcagattttagtactcaatgtaagtttataatcaaagatattaaaaattatctaaaatttatataggagaatatagtacagtaaactctatgaaccaatataaaaggactgaattattcagcaaattgagctaaaaattggttattttattgcatcttaatttacattagattaaaattggcttacttttaatattcgttaaacagataatttaaataaattatagcacagctatatagtgtaatattatgcatttcttaaaaattgtagcaccttaaaatatttaatagtgtctgaaaatgcttgtaagtggaatatataggttaaatactttcagtataataattgtgtgtgaatatttttgtatattatgatacagtataacagaaatctctaaggtttaacagttaaatttttaatttttaaaaataattttccatatttgctgccatgaacatgctttacttggaaatgcagataaaatccatgcaatagtcaatttttgtaaagcaaaaaagaaatttctggggaattttaaaaagatactgtggaattttttttttttaagtactgctgattgttcaagaaatgtaagcattccaattcacagtgatcttcgacactgagcagatggcacctagcaactaaatctattgctatttacacataataataaaataaattttgatgagttttagttctgtggtggagatggagtcacaatttctgaagagttctacaaattttgacaagcataaatcatgttttgtttattcgtggtttaattgtattatacagatctaaggatgggtctaaatgtgtaaacatccgctttttcagtgtggtttcagcttctaaagctgctagaattgaagagtgaccactgcaataatcgtctattatagaaattttggagataagattataaagaacagaatgatcttgaaatgtctcatcttctgtgtaatatctggctctatttagttcctttagcatttcaagtaactattaagaaaaaaacaaagcagactgtttaaacaatgggatgaatctagattccaaattcatatgaaactcaataataaatcccaagcattagtccagtttttctaataccagattcttgaggacttactcatcaacacttaatattagactaatgtctctggtcttttgcctaaataccatttagtagttttggattcttactaaaatttcatgttttaattggtatgtaaaaagtgttaaagaatatagaattgggctgggcatggtggctcacacctgtaatcccagcactttgggaggccgagacaggaagatcatctgaggccaggagttcaagaccagcctgtccaacatggagaaactcaccctgtctctactaaaaattcaaacattagctgggcatagtgacaggtgactgtaatcccagctactctggagtctgagggaggagaatcactgcctcaggaggcggaggttgcagtgagccaagatcgtaccattgcactccagcccgggcgacaagagcgaaactctgtctcaaaataaataaataaataaataaataaataaataaataaataaataaaaatatagaattggactttcttgttgtctctgtattgtggccacagagctgtggatagtgggtgaaaagaaccaagaagtgttaagagagacataaagataattcattgaaagtcttttataggagaagggcagaaaggagagaatattcacccctctcaagccccatgaaagaggaagggcaagagaactacttgtagaatttgggttgtttgtcaggaggacagactggcttctcacctcacccatgctggtagaactgtagaatcaagtagtgctacccaagctggtacctgggcagtgttcaagagagtttggggaagaacctgagtttggggaagtagtggtttcagttttcaccatggtgaacctgaggttaggatgcaagatgggtctgaagctgtttgtgatagccaaacaaggagaatggatcagcaactggacaagatacactgccacattcagtgggacaagtgcacactttatagttagctgagcttgattcatcttgaaaacacccacaccaggacaactcttgcctgtgagaaggagctccagctgaaagatgataaaggtggaatgcagaaaatagaagctaagggtaataggctccatgtctaatcaaggcacctccccttcagggagcaggggagatatctgaggtgttgggatggtttttctgaggtgttgggatggttcttaggaacataccatatgcctcaaagagagcggtagcatttgaatacatcttgtcattaagaattcaaaagtaaagaagaattttcaatagtaactatttagaaggaatttacccccttttcttttcattattcttaccctggaaaagtcaaaagcaaaagaaagtggggcggtggggagtcaccgtggaaagacggtgatggaacaagcaggaaagagcatattctatctttctcattctcattgctggactctcagtaatggacttgacctgaaagaagaggagaaacttccatttatttgagactttaaaattatcaattacaccagtcatctcatctgagacataaagttgacaatatccttatgggcaatagtgaattaaacactaatctctgcctgagataccgccaggggcaagaagtggaaatttcatagttgtgtgagagcagggttggaagaaaaaccattttcctaaattacatcctactaaatctgggtcttttaatgaattagctacagtaacagatttaacctaaacaatgtcttccataaatactggggtttttatcacgtgatattttgaaacaaatttgaagcctcctgccatcagagaatctcagttaaatctttaaagttattttgaccagttgattgtatatagaagtgagtcttaactttatggaatcactcgttaataaaaacaatgaagtgaaattctcctatttagagttgacatttgccatttatgctcagataggcccaggccatccaagttttgcctgtgactctagttatgtacatttatgggaaaaacaatagatggatataaactacagcagaatgaaaaaatatgtaaacaaattatccaatacttacagctattttaaatcattatataaccagtttacagctactgtatacatttatgtaagtattaattttatttatgttaacttaataatgcctagatattttaattaataaattttaacaaatatttaagcctcatgagggataaaggttcaattttacacaaggaattgtttacagcctaaatcattatgtcaccaatgatctaaatcaagaatgcctttccttttgtacagtttcttcttttgagccatttttggcttttaagaggaagacaagctaaaagtataaggagttcacatgtacttacttagctgaagatattgttagatttaactcctatctgtggaaaacctaatgagttaatatttatacatctcttggtttctgaatatttaggtataatactttgttccatgttccattgttttcttttgacccaaccttcaaacccatgacttctgaagcagaggaagaaatagaatacagtggaaaaaagtcttctttgaagaaaaaaaaaaaaaaaaaaagaatctattggcttccagtagacatttttcaaatttcttctaactaacatacaaaaatgcattttatgtgtatgcagtcacaatgcactgaatgttcaccatgtgctagatgcacacttatttaatacataaattccaaaagcctctttttatatatatatttctacttagtataagggaaatttagctgaacagacgtctgttttcctgtacggttctccattaaacatagttttccatctgtattcttacaaaagggaaattatcaaggggttgtttgaaggacttctcacccgtttgttttctgtgtgttacttcttgtcagaaatccccatctctgatcctttgcttctccaggcaactgcgagatccacttacctccacctgccagtctcagactcacagctatacttggatttgttcctgcataaaatagatctatttaggccgggcgcggtggttcacgcctgtaatcccagcaatttaggaggcagaggcgggcggatcatgaggtcaggagatcgagaccatcctggctaacacagtgaaaccccgcctctactaaaaatacaaaaaaattagccgggcgtggtggcgggcgcctgtagtcccagctactcgggaggctgaggcaggagaatggcgtgaacccgggaggcggagcttgcagcgagccgagatcccgccaccgcactccagcctgggcgacagagcgagactccgtgtcaaaaaaaaaaaaaaaaaaaaaaaaaaaaaaaattgatctatttaaaaactcactggctgacagggaagatttcagttcttctcggcactgatgacccattcagtcccctctcgttccacctggagccttgctgccccttttccctgagtacagtcaccctgtcttgccagaccttgatctattcaattcgtctaagccttgttttgtagccctgtctagactctcgtagttgcagccttacccctgtatctcaggccttccctgggcatggtctattcctttggacctcatcattcagccctagtgaaaaagatgcccttgtaaacataattgcagattcaatactagcatctttgttggatgcaatatttatattataataaaattatacactttattatagcataattatatatttataatatttaataaatattccacccttggtttttgtttcaaccatttaaaataaaattatattttctcacatattagctaatatgggactctaaattttaccaacatacaaattcacaggcaatgtgtttgggactttttaactctgtagttttaaatcttatatgaatgaatacattttgatttggtatttgtttctacataaccttttcaaaaatttgtttttccatacgttcagcagccttcacagattagcagaatatttatgttttaggatattattatcattatttaaacaattagtttccttttcagtacttttgggtatttgggaatgggtttagttttctttaataatgttttcttgttgttgtcaatcatctgataaggaaaatagttggaatacacatatcttgataaattgtaaaccatcttccatgtatctttctttctatgctcctgtctcttgttttgttccaattagcctaagaactctttcttacaaaatcagacatgaatcagttgagatgggattaatttatttgggcagatattagataacacttttgaaaaaagcaagtgttcttttgttctgctggtacatggcatcattttccaaagtcattcctcatgatttctctaatactgctacttccctggcaatattttaaagtgagtttcacaaatcaacagttctcaaagtgtggtccgcagagaagcagtgtcaacatctcttaggaataaacagaaaatgtaaattatctggctccagcccagccctattgtaccagaaatgataagattggagggggcccagcattctgtgtttcaacaaagcctccaggtaattttagcacactgaagtctgaaaaaccagtggtataggaaataaaaaccgaacatgggttcttaaatttaaaaagcagcataattagagagtgatttaaaacgcctgcttgatagaattgtttcacaaagataaacattttttaaaaatcattttaatggagccaattttaaccactccattttgaaatggtctttctagcaaagccttaacaaatttttcagtaaaacaaagtgtattatgctactaagagaatacactgatacagtcactgaaaaggcagaaagcttccttcgtcattataacggaattcggttaagtatagttaggtaacataatgtgctgccttcatctttttgtgcctagttttctgctggattaaatttgttcactttttaattgaatctgaaattcttagaaattagctgttaggagagaatagattttgaatatttgaaaattgaaaatataaatataatcttagcataatgtctttctaaagttgcaagaaatagcatccaaaggaagactggagagttctaaaccacaacaagaagggttgacttgagttgctgggtaaaaaagtatgtgaggacagggaaaacagaagacaggcaagagggtagaggcaccacgggtaaatttcacctgctggtattgactagagatggccctggaaaaactcccttagggcaagttgtccagttgcttttttttaaatgggccttgatgatatacatagcgatagagacagagacggagacagagatagagatacatagagccctatatcatgtgaatcttattaaatttacttacttgatttttttcagctttctccagtgtccagtgtgatgcttgtactctctccttgcttatttttcctaagctctatctgctaacatttgagcacacaaacatttcagtgaaaatgtgatggtccttctgggtccactgttacaggtcatgtttcatgtaccatccactggaaggacactcaatgtcaagatctttttttaaacattctatgtttttaactatcaaactatgggcatgaacatcaagggtcaatacagccataagcaacaataatactggttaatgatgtttacttcaatattttggaagaaatgttatttagtggcattttggcaattattttttcggttgctaattctgactctgaaattgatggaaaggaaaaaatgtaaagaaatgttttactttccgtttctataacaatattttctctatgcacaacaggtaccactgacatatgattaattccaaatataggagctgaaatttatcaaaagcttcttggccaaagaagagaagattgatgttcgggccttgtgtatattcctgtgtaaaacctttgggtccaagtttcatttattgttttatatgagatcatgccccctttaatttactactaatcccattggagtgtgaattatgatgggaatgtgactgatgtgtttaatactaaatgttaatacttcagttggttgcacataagaattttaagctattgggaatatgtatatatttgggcttttcactgcagataattaatgaggcaatgttctttcttcagcttttagccatagaattgattgcaatttgtcgtttcttaggaaatgaatgtgaaatccatacacatattagtttcatgggtcaataatctaaaagactgaattattagataagctattgtccaaaatatcaagacacatgagtataaatattgtttttatggctagttaatgttaagctatcatggttatgttaatttgtaattcaaatattttttttggcatcagagaatccttactaagtaaaatatctgccagagagaagaatctttctattatacaatttcagctcagtaccagcaaacatgtagcatttaagattatgctgttatgatgtataatagtacattcctaaacatatcaatcattttccatctgcagctgcactatttcatctctcaaactaattaattcaacagcactgactttaaagcactattcacaattaaatcctaacccacagaggtatatctgccagtaattcttaaagtttttcttatgactttttttgtaattcttcaattcttgcatctcataattcatcatggcatagatgtattttattcatacagttatcaaatatttattggacacaatgtaaatcaaagatatggtgctaggaactagggatactttatagagtatgttgtaaggcataccaagttctttttacttcctggaacttgcaaactaatcttatttttcaaaaaaaaaaatctatttaatgcatctaaatgggaatcaaaggcagcataactttgcaatagcctttaagaaacacagacagacagttacaaagtaaggtttggaatcattgcctaataatattttcagccataggatatccaggaatgaaaaaagttaagtatttttattttgcttaccaaagcaatgtcttaagttctgcggaaggctgtaatgaatatctgcaattatcatatgctaaatttgaccatgactacaatttgttttgagatacaaactaaatgatttttccagtgcttaagtagttagtgagtcagtctgagggtgcattaaatacttcacatcaacaaaggtaaaaatcaaataagatcttgcctaaggagagcaaataagacatccctcgctggaatcgtatctgtgatatccacttagattgtgtgaaggaacagaccataagcacaatttgggcagagactcccttaacttttgcccttatttttccattgtacaatttaactacttaatcctcaccatagacaatacatgcaatgaaaagtcgttgagtgaatgaatgaattaatgattcagaacactttaatgaactccttttctcatacaaattttgaaatatgtcatgttctacaatgtttatccatatcacctagggaggatgtggtcatgtttcctgcagtctgtagataaacaaattaatatcgtatggccatagacactcacacctcttttcacttaaccttctccattcttcgtctcttcacagagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaaggtaagatctagtgcagcagccaagtgcaggagttgtctgtataacagagtctgtataacagagtcctgaaagagagtgctgtccatcattgcccccagtgagcactgttttcattcagggtaaaagttaccaaatacataatttcttcagattcttaataacatgaatacaattctgttagttttttggcaggctaattaccccattcaaaataatttcagtttcttacactaccatcaaactcaaactggttttgtaattattttaataatgtaatatgttttgcaagattattacaatactatattttcggtgtgcctgtatgcaaaaggacctccataaaattaaaggcagcatgtccttgcttgcattgtttttgtgagtgttttttaataagcaaacaatctttttttaaagttttaaataaatttaaatattgcttttaggcaaatatactgctttcttgatcacagcatatggttggaatccataagggtctgaaatgaatccttgattcacaatcattattaataaacacggatttagacataaactacaaccaaccaaatcattgtctttatgctatgaccccattgtagtattgtcacacatccaagataagacttaggtttggggattttatatgaggagatgtttaatgcttccatcttcacccagggtacatgatttatcacattcttaaaatgaattcatggccttataaggcaattatagtgaagttttattgcatttgatataatatttttaagtttataactttcttcttaaaaactgctaaatatttactcaatgtcacattctaataatatctatctagccagctagggtaggtcccatgtctcttaaaattttaaggagggaaaaaacaaacaaaaaacctgagctggagtaattttaccagtctggggcccttttgcactacagtaatattaaagtctctaccacactgatttctctgaaaagcattagatcctgtgtttacttagtagttatgagcttgttcaactatttctgtctacctagatattgagagtgcaatagtgtaatcacattccgatagccattgggaaatacaaattctaataagaaaatgaatatttttaagatatgtttactattttaaaaattatgactatgaaaatgagttgacatgttttagagattcactgacctaaaatctatgatgcaccttatttttttactggctttaaaaaggtagtatattaatccattttcacacgctgataaagacatacccaagactgggcaattcaccaaaggaagaggtttaatggactcacagtcccacgtggctaaggaggcctcacagtcatggcagaaggagaaagacacatctcacatggcagcagacgagagaagagaatgaagccaagtgaaaggggtttccccttatcaaaacatcagatctcgtgagacttattaactaccatcagaacagcatgggaggaactgcccccatgattcagttatctcccactgggtcactccaacaacacgtgggaattttgggagctacaattcaagatgagatttgggtggggacagagtcaaaccatatcagttagttttacatatatatacatatatatatatatatatgaattgaatgttgttgttaaggttttgtcggggttggggttttgttttcgtttttgcatcatttaccagcactacctccaggatcccttcccttggatccttctagatatacctatcttcctctttctatggaaaacaatttaactattttgtctgttacaacgtttcaatagacttccactcaaaattttaaataacaagtcattttctttcatgaagaatggttattcagaattttcactccatttatacctgtccacattagttttttaagatctttctatttcatagaggaatttggtatctatttttttccctctgtttatttccttgtctttgagattagagatctgtcctttggacacagttcatttgtgtgtttctccttctctgaattttgggtgtcatttgctctttagtgactgagaaattgtccataattttgtgcatctgttttgtaaattccagatgacttcactgttgttaaaatgagccagtgggggaaggtcttgtccatacttgatctagagaaataaaagtgggacattgtgttccctgggtctggactgatggggtcactggtgatgagactggggacaatttagagggcagattggcaggtaaggcatggccagtcatgctagcaaaccaaagccaaaggccaacactttctaggttttattagctcattgcccaaggcatatcacttggtataaattttagctatttatttatactactatatgcactaatagtagtattagtacaaataatacatatgaaaataatacaattggatatgtcaaaatacttttttcattgacacactttttcaaatgcattgttaaattctgctgtaaaactgacatgtagacatgaacagtaggaatggatatacatcgtttattctggagaagcatccttcagtcacccttgtaattataattatatgccataagtctcaaggagcactcacctagtgtggggcagaaggagaacaaggaccaggaaactctccatggtaatcatcctcagcgcagcatggcgcccaggagatgtattcatagtctcacatcagctcggagcaattgctcttttaccataaggatcataactttgcattttaaaggtagaaacaaccaatttgccatgcaagcatattttctcaagataatcacaaaaaaataccagaccttcagaggaagtgataagattcatgattatgtacaattttatcctgtgaaagacaaaactcctttatttaactgctgacttgacatttttacttcatgttacctcataaatattgtaagcaaaaatcaagatgagtgaaaatgcctgcatggccaaaattcaggcgaacccctgatcttttgtatgaattatttttcaaaaactaagcacccatattcagcatgatgcttactagtagaaaattggtgcttaaaatatgtgtctcactaactttgataatattgcttccatttagaaacctgggaaaaacccagttactaatttttaacaattagaaatgcaaaataatacttaaatattgcaatatagttattatgaaaaggtggttagtggtagcaaatgttatatgtcatacaattaaggattctgtgatgtcataggtaggcttaatttattcctaaaccttcgttggtcagggatgcaaagagaaagaatcttttctctaatgcataaccaagtggttaagaggaaagataaaacagaaagttcttaaatatgatacaaaagcataaaaatataattaatacataataaatatgaattatgttatatacactataaggtctaagttagttaaggaatttctcacatatggactccaacatttctgtactaacccagagttatcaatgcccttctgggttggttttttttttttttttttttaaatatcatttgatttgccatcaagagtgttagtggtacacatatcttcataaaagagtgtactgctgggactctaagattttcttctgaactactgatatctgtcctgcaagttttttatgcttgttggtgcaaagtttatctaccagaaggtgtacacagtaggtttttagacaacaaggtctcgtgtttctctttcaaatggtcctaaaacatttcttgactgaaacattgaagagttgcaattaactaaaatatagtcaaacacaagacatgaagtgccaacattgcacagagcttcaattgaagtgaggaaatcctgagcctgtacacacaggcaacagcagccacatcactaccaccacttggcagccatcatttggaggctgctgttccatagacgatgtcataacaaaatataccccaatttcagaaatactaaaatgtaaaaacatgtgcttctgttgaatgaaggaattaatcaatgaatggcttcattgtttgaataaagccagctgggggtggtatatcctgggatacagaaacctatgagtgaatgtggtgacgtttcacaaatcatgggaggagatcaaaccagaacttcacagctctcttgactttatcttcttgattccagaaatcattcttgatttaatgactatgaatgaagtttaggaactttctgaatgagaataaaagaagcctaaaaggcgaccaaaactgtcattgtgattactacagaccaattagtaaaaagcaattcacgttaaagtatgtgtgggttcaataaaaatgtattgaactttaaacttaattgagcaataactaagatcagagtctccatttctcaataaaaacagtttcctaagtcatttaattaatgctctctccgagggggaaaaaaaaaaagcagacctggtattatcatagcaagagatttaccagattagatacacagaaggaaaaggcactaggttcctaaacactttgtcttggcattatctctttggaattaaagcaagggtttatatagacctatgattttaaaacattgaaaacatccctgatgcaaatttttttcatggaggcctttgctactctatactttgtaattaaaacccaattagatattatgatttaaatctttttgtggcaccagaaacctcatttattctctgggctactttatttcatttatcgaacactatggtaagaactaaagaaacaaaaataggtaacacatagtcccttcccttaatgagcacatagtgtacttggtaagatagatcaactaatgatttcaatataatataggaattgtaataaaatacatcccaggagggttgtgtattaggaacataggttaagttgtatcattttaaaaacattaatgatgtcaacccccattctcaatagctcaatacaacaaagatttatttcccactcaagctatgcctgatgcaggcttggacagatcaccagggcacctggattcagaaacctaggatgctgcaatcttgtgactcagacatcttcatgctaacctacctcattgccatgcatagcaggggaagaaggtgggaacattctccaacaagcatactatggactcaattgtttctccccaaaattcatatgttgaaaccctaaaccccaaacttcttatatctttatgacaagagccagagatgataggtcctttatagatggaattaaagttaaatgaagtaataagggtggggtcctaatctgattgataggatcggtggctttataagaaggagaaagaaacctctcagtccctcttctctgccatgcggaggaaagacctcaagaaggtgaccatttccaaaccaggaagaaagccctcaccagaacccaaccatgctggcaccctgatctcagactccagcctccagagtgagaaaattaatttccgttgtttaagtcacccactctgtgtcatgtttttcttatggcagcctgcgctaatacaaaacatttaaatactttagtacagtggtaatgcatgttatttctattaatagcccaccacccagaaggtggcctccacagcccccccaccccacatctgcgaggggacaagtagggagtatgtggaatatttggaaagtatattgtctctgccacagtcatatcttctgatgagcgaagatcccttttctctcttcttcctacacactcaattgttccttaagggaaacaatccaaaaagcaatccagcaagccactgattatagctcaaagtccagagtctgcaggcgatttgtagcagtgtgtacatcaggtccagatatgacttttttttttttttttttttggagacggagccttgctctgtcgcccaggctggagtgcagtggcgcaatctcggctcactgcaagctccgcctcctgggttcactccattctcctgcctcagactcctgagtagctgggactacaggcgcccgccaccatgcccagctaatttttttgtatttttactagagacggggtttcaccgtgttagccaagatggtctccatctcctgacttcgtgatccacttgcctcggcctcccaaagtgctgggattacaggcgtgagccaccatgctaggccgatatgacttcttatagttccaaaagaatgatccagaaaaagatgctttttttcccccctctacccaccctggcccaaggaacagtggcttaagagaggtgggatgcctgcccctgcaaacactcccattcaagggaaagtttgggaggcaagcaggcaacagtcactggtcctggtaattctgaattgctgcttgccagatatcttcagggtctttatccagaattaacaaggatatgtggctgggccctcattctgctctttgggaagaacgtgccaatcctctattccacttggttctgccctcggccctccaggaggattttcctttatcattatcctccttgtccatattcgaactggacgttgggaaaatgttctctttgaagcgttgcacgtttctcagtccacattctaccctgagaagttgtagtagagatctgaaggttactgaatcttaacaagttataaatattttttatttacagcctgttttccctgtaaaactttgtcaaaatattacaagatttcttgtgtatttagtgccaatcacttgtaccaaggaagtgttttcttggtttgtttttgttttgttttgttttgttttttgagctctatttctcagatatgctctgattgtttatttcttccctcaaaactgtcttttgatttgaaaggtgccttgactttgtcaggtttttgtaggagcagcactcacttaattagataaaaatgacccagggcaaagaattaacagattataatgggtatcctacccttgagctgctttttaccttgacataccttaattgaaaggttttagcaataattgtggagattacacttaatctgctcttttccttgagactgctttagcttggttttgtcacttaaaaacattaagtgtctgtctcagagttctcttttccaattttacaaggttttgaatttttcaaatgcctttcatttttgcttgaaaattctcaatttctttctaagagcctctttctttttagtaccatatcagtcaacaaacactgttaacgttttgttatctaaccgctttccctagatgttgttggaggaataaaattaaaaacaaaatctcccaatgcagaaatcttctccataaatgtgattaaaaaaaaaaaaaacactccattatttctgctaagaaactgcagacagagggagaataccaccctttgatatagccatccaggtacaactcaatacatgcaggttctcaaggtaaacaattactggtctcaagcgagagaacttgacagcactgtttgtcacacatgcctcatccttgtaactggggtaaccatttgtgttggctaattggctttatgcagaggaaaaacaaacttcttgtatctttatgacaagagacagttttgcaagttggagagaagtagcacctgaagttaggcaccctctctgttacagaaactaggagatgggggtgcatctcccttcagatttacatgtcaaaggcacggttcatgagtccttgagaaaggcattttagggtcttaaagctgacaaaagacctatctggttttcagaagaattatttacatttcaaagagaggaggaagtgcttacaaccgaaagttttctaaagttatatgccctaaaaaacaggaaggacaattgcccattttcaacagggagaatagagcctcttatttttaaatttcacatttgtccatacaatcaagaaactctttttttttttaattttattattattatactttaagttttagggtacatgtgcacaatgtgcaggttagttacatatgtatacatgtgccatgctgctatgctgcacccattaactcatcatttagcattaggtatatctcctaatgctatccctccccccctcccccctccccccaccccacaacagtccccagagtgtgatgttccccttcctgtgtccatgtgttctcattgttcaattcccacctatgagtgagaacatgcggtgtttggtttttttgtccttgtgatactttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttatagtcctttgggtatatacccagtaatgggatggcatgagtgaactcccattcacaattgcttcaaacagaataaaatacctaggaatccaacttacaagggacgtgaaggacctcttcaaggacaactacaaaccactgctcaatgaaataaaagaggatacaaagaaatggaagaacattccatgctcatgggtaggaagaatcaatatcttgaaaatggccacactgcccaaggtaatttatagattcaatgccatccccatcaagctaccaatgactttcttcacagaattggaaaaaactactttaaagttcttatagaaactcttaagacatgaaatcggcctaccaagttatcacaagttctactaagaggcaagagctttaccgaatatctcactgctaaatatcattctcccagcttgcttactagtttccttcatccctggcccagccactatttcagtgccctgtatcttagggctatttattcatttatcactgtaccactattaggatcaagtattaggatcatcacttatccttaagtgatgaacaaagtctccgtggtttatgcaactggaactgatctctcactcatgctagtccactctgattctgggcaactatcctaggcaattaggacaacactcacatcaaaaaatagatgctttggcttcagcaggtgtcccttctgttcatagccctttcttgggaactagtgataaggtttccagattgtgctgggtgcaggaaatgaaggggagcatgagacatttggagaacagtcctatctaggcaaacgggcaccaagtttaattgtagggactcaggaaaagcttcctgaagaagatgatttgcacggcgaatcataaaatatgagttggacttctttaaggtagagtgtgaggttggcatgaggatagaggggtcaggttactctccacgacgcacagcacaggcagagcacggatggttccttcttagcggattttagctgctggagattagagtaagaataaagtgggcagagagtttgttaaaagtcagataaagctcaaaaccaggagtgttttctatgtcatgtcaaaaaataaattggactttatcttacaggcagcaaggagttgttttttaatgtagcaagtaaacagatttaaattttagatatgtctatctggtgactctgtggaggatattttaataataatcctttaggttaataatttataatacgcaatgtgcctagggcaatattgtctgagcaatcgtggtttgaaatgacatgggagaatgaatcagaccgctccgactccgcttctgcatgagccagcactttccctgtgccttcagttatattctgttaacctttccaaggcttgatttcctcatctgtgagaacctgataaaaatatactctgctatgtccaccttcagtgctgatatgaggatcaaatgaaataatgtgctttgaggccgggtgtggtggctcacgcccgtaatcccagctctttgggaggccgaggcagggggatcatgatgtcaggagttcgagaccagcctgaccaacatggtgaaatgctgtctttactaaaaatacaaaaaacagctgggcatggtggcggacgccagtgtcccacctactcgggaggctgaggcagaagaatcatttgaacccagaaggcagatgttgcagtgagccgagatcacgccattgcactctagcctgggtgacagggcaaaaatccgtctcaaaaaaaaaaaaaaaaaaaaaagtgctttgaaacaagggctttgaaagctgtaacacaggtataagagatgattaaattcggcaaacacctatttttacctgcacagcactggacagggcaatatagggaatcaaaaacgagcctttcctttgaagaaatcaacattctttcacgaaaaatgctaaaacaccagagcatgattttgtagcttgagctgcaggagagtgattgcaaacagtgaaccgagtgtgaactcacagtggggctctctctgtgggagagcgatgccaatatcactgctttgtccttatttagaacatttcgtgaaatcttctttaaggggacttttcaaagcaagttcatgtgcccttcaagaacatccatcgtatgactctggtgtcacttactttaatggtggtaataaccacatgcattagcctcacaacttgtgaggcttgaaatctaatgagtgctaggaatggagtcctgaaactattatttttaaattaaatagccaaagtcttgtcaaaattccttataaatgaaaatatgtttcattcttagtcaaatagattaacttatccttgacacaaatgttaatttttttcccattttttattgcaatattttttaaaaaaatatgttgatagatgtggattcaagtcatctacttttgttgggaaaatgttaaaactctcacaacaaaagtctaggaggagggtcaaaattatagttgcccttgtatttacaagatttttttcttggtgttaaataaattctagacaaagattataaattcattattatctttatcttttacatacacatatcatattatatgtacttgatcatggtaattaactcacaatgtcttatgttttactaaaattaaagaatttaaaattatctgggttatttagcattagcaaaagggtaaagaaaaaagatatttttcttgttataaataaaattcaaattgtgataaaatctgttctttcaaaactattttttggtcttttatttcttctaatatctttacttgcttagatttttcaccatctgattataacttcttggccacttgattttttaaaaaattataaacttactggctaggcaccactgctcaagcctacattcccagcactttcagaggccaaggctgccagatcgcttgagctctaggagttcaagagcagacttggcaacatagtgagactgcttctctactaaaaatacaaaaaattggctgggtgtggtggtgtgcacctttagtcccagctactggggaggctgaggtgagagaatcacctgaacccgggagtttgaaactgcactgagccatgttcatgccactgcactctagcctggtcaacagagtgagaccctgtctcagaaaaaagaaaattataaacttactatttttaataattttcattactgtaaatgaagcagatcagaagaggtttaacaaaacttaaaggggaaaaaactgactttttggacactgaatatattctaaacatttttctaattttcacatacattatagcacaaaagtcctacaaaataggtattctcatgcttctcacaaatgaaaggaatacaactcaagaatcaaaatcaatttgcacacacatagtaaaaccaatccaaacctcacagtgctgcaaaaacacatgttcttctcatgataacatagctttgctaatacgtctcaggttttgtgtttggaggtcaaagaacttaatttgtgtggtagaggttccaacagcaattactaatagatgggaaaacatattatcttttgacccgaggagatattagattacaaaaagcaaaattagtgctaatgtagagcaaaattagtgttaagtgtagaacttccagacactagatttcttttgttaatatttctaagtagatcatggattcataattgtcttaaaagataatgtagtccatcataagatattctgccatgagaacaaaaaccgattaaactacaaataaaattgggtattttttgtttgcttattttaccatgaagagttgacttagatgaaataggtagcttggtttattcaaaacaagttctactttcacctgacccaagcaaggctgtgtcttaatagaagatacagagacactagaggtgatgggagcataaggctcaacatttgctgctgatcttagatctgccctctagctttggtttgtctgctgttactcttcaggctaggtctacagttccagagaaatattttagagttaatcaacccttcaaatagaggtgagaaaaagctttcaaatttgttttccatatatggcacctggaacaccggctttataagacacctccaattcatatcattagaggagcaaagaaaacaaatgcacagagatcctgagtccatgatatgctttccctcagacctatttccaaataaatattttcatttacaagtaaaattagtaggcaattagcacctatggaattcattacctttggaaatacaatcccgatgatagtggaatcttttaatgacgaacgaggtaacatattcaaataaaatcatccttaatgaagctgtgattaaaaaccactgcaattttcataccgttgttaaaaattatgttacttgtagaacttttactaaattttacttttcatgttgattaaaaacaaagcaattagttggtatattctctgaatcatttctttggaaaatcagcatctacttggattacaattagtatacatgaaaaaataatgctactctattctttaatatgaaaatatatttgctccttgaaattctgaacaatccattttcctttgacatttgtttgtccaaatactcctcagggcatcacatatttatttgctcatctattgcctgatgtgtttcaattatttaattgtataatacatgaaaagtgccaaatagttaattttatcctactttgtagggctgatgtcaagtcagttaggaaaataaacaataccactttgtatcagaagaaaaaatctttcctgacttttaatactttgtgaattctgtaggcgaaaccattcgtggcaggccccatacttgttttctgttagttttaggtacttgtctttttccttatagtcaccctaaaaaactcaaaataaccagacaattgatgattaatcattctctatactggcataaaaaatgaaccttttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcagagcttgcagtgagccgagatcccgccactgcactccagcctgggcgacagagcgagactccgtctcaaaaaaaaaaaaaaaaaaaaaaaaaaaaaaaaaaaaaaaaaaaaaatttaaccttttccgaatcacatttgtgtagaaaatcaattctgtgaaggaacacttttatgaaagaggcaatggatattattgtgtttattttgaagggtgcaatttacaactcagaataaaataggaaaatactaattttcaggtgaaagaacacctagacagatagtgtataaatgtatataatccaccaaactctctgggcatgccaattatctttctataaatgtacattgggacctggcaaggtggctcatgcctgtaatcccagcactttgggaggctgaggcaggcagatcacttgaggccaggaatttgagaccagcctggccaacatggcgaaaccccccatctctactaaaaatacataagttagccaggagtgggggtgtgcacctgtagtcccagctactcaggaggctgcggcaggagaatctcttgaagccgggaggctgaggttgcagtgagccgagatcacgctactgcattccagcctgggcgacagagtgagactctgtttcaacaacaacaaaaatgtgcattggaagctcacgtctccaaaatccccagtaaatgaagtgctaaatataaaattatatctttcctgatttgattacataggtggaaaagatgcttgaaaatattgctttcaagatacacgagactgaccttgaaattacagctacaatttagaaactcggagattttttgcatgccagattatctaaagggtatccgttactctctcacaaatgatcactgagtttctattatttcagagatattcaggacgcccagatcacaatctatccctagccagttgaatgagaaagctattatttatcgttttaaaatcatgattaatccagttgtgggaaaagcacaaagaaatgaaaggtagaacttgtgacaattattcaacgagatctcaaattcatgaagatttttgctgaattggggaagaaaagatttagaagtatgcaggtagctaaaaagtcagatatgtttatttctgtcatcattataccaaaatagcattaaagaactaatactgtgggaggtagcatggattgtggaataagcttcctgcataccaaatctcttttatttatgtgtattccagaggttcctaacaactgaatgcaactctcttaacacaaatatacttatgtacaggcagaatttgctgagatactaatgagctatggcttcaggacccctctgttaaaggtgaccttgcaccctgttcacatgtgatcatatattttttgtcattttgcacatgacaattatttttctgttctttatatttaagtaaaacggcctctaaaattgtataagttttcagcctcacaaaacttgcatctgtaccttcttactcttatatctgtttaattatcttactcaaaggggtgctggatttctagaactatatcataccttttttacacctcctccttttcaagtggaacccgtgaaactcccaggatggtagatctgcattggtgttgtggtatatcaccatgaaacgtgatgctactgaatcacataggattaagctcccagtcttggctctaagctcatcagtactcccagcaaagtggtgaaaataaattatagattcaaggatgtgtcccactatggtggaggaaggtacacacctaatctatgatcatttctgtctcgagtaccactaaagggacctccagcgggacaggaggtgatgcagtctcatctccttgtaaacgtgctggtgagaaaactcctggtaaatagactactgatctttaccaaaaagagactccctatatacagactgctcttagcagcattgcttctagtttaggattacctatggtaaacagacgtacagcttctggatttaggaggcagagctttctggagaataacaaactacagttgggatattaaatagatttcctaactcacacactccttgctgggggcactagtgcagacctggtgtagtctgagccagacaatgcacacccgaaggcagaagcggggccctgggagctgcctggacagactagacctctcctgctttgtcctgggcctcctgattctttctgtcggtgtttctatacttagattgtttctaaatatcagtaacttgatgtttagtaaattctcttgataatttcatcctttttattggctcatgcaccaatatgctcaaaaatagtttatgtggaataagtaaaataaacttagaacagaaattatgctctgttaatgttcttttataaatgagtaagccataaaaataaatattttttagcaatatatctgcctcagaagaaaaaaactaataaacgttgcaaagagattgttttaaataccaatataccaattggtataaaaagaatttagaaggaaattttgcaaggcaattcaccttgatcattaaatatttagcaatattttcataaaagtatttttcatctatgcagtgcaaaatgtgatgagtgtatttatataaatttaggtaagttggattatactttcattgactcagaattactccaataatacacgaatcaagaaagacttggtatgaacaatatgtatatgcagaaatcaaatcataccgtagaaaattactttgtatatttatttaatgtgtttttttgtaataaatacaatatgagacactcattacctagggaaaagctctagaatgaaaaatcctttatatatgactaaatgtggcactattacgttatacatgtctcccattaaggccatgtaaggaagtgctttgaacaagaatataaaatctacaagacaaatcggtctagattctgcaagatacttctctcctttggggattagtttcctaatctaaaaactggagattaattttgcccaggccacgcagttgtttttagaattaagtgagatgacacttaatttagaattaagtgatgatgacgtcctggcaaaatgtaagcacaccataaatggaagccacatttattattaattggacccattgatgtcttctttaaaactttaagacagtagcagaacttaaagggcaccaaggttttatatttttaaagataaagtagaaatcaggtcccagggcaggatgcacacaggctaaactaagtagcatatggtctggcaacttttcagactgtagaggcagaggcatcaatcagctctcgcgatctcacgcaccctgttgcatgacagagctgtcagtcgagtgcattgttaaccacaggcctgatgaggagtgggaagcacaacttttgacatttgactttgcagatgaatgaattcttccaactttacagtctttgaaataaaggactctctctaaagttctgtgtggcagactcatgctccattactctggaaagagattgtattagaaaccagtcagatcaggatctgaattggtcttgttggcgttgaaagtcccccttgactttctatttgctttcctattactgctccaaaaccattctactggttcacttagcgatttttgaggctgatgaaggaagtgattggggtatggactgtgaattggttggtttgcatttgaggttgcattcattatatcactactctatgaagataattggcaaaactgttcattcagcagagaactagaaaacaaaaccattcgttattctgctagaattaatttttttgtaaacatgaagtctaatcaaaagaaaaaggaatgctttagcaacatcattttagcagctgcgtcccagatctattcaaatcaagtcattgatattttctccaatcgtgctaagcaggctaagatactgatacatatctcctatggaggtcagagagcagcatcaaaccctcccagataaagcagggccacagtgagacagtattcttttctacctactggatttattgagggaatttgtaatttgaggctcatttaatccatgttattctgtaaagccatactttgaggggtcaacaggaaatatttagttgaaaatgtcaccatgcaatgcgaactatgaggcaatttaatatgcaattattttaagcataattaaaagtggcaaactataaatatgttgcaatgatgttctaatacgagtgtttcaatttcctcttcactttggaaatgatgaaaaccttaacccctgaaatagctcgggttttattttgtcttgtgtcttcatttgtacaggttctcttaattctataccgtgtacacactgcttttcctgtgctaatctgcctcaaaatgtccctttgtttcagaacccttattgccatttaaagaaaattctcagactgtgtctgcagttgctcatagttgttttggataacagattctctgcagaattgacaaaaaaaaaaaaaaaaaaaaagtcttctggttacctataaccaggaactggctttttaaaaaaattgttcttgcgccctaaagtggtgtttcaaattctgctccttttcctaggagtaatttcttaattatttctgatttccaaatgggtacccaagtgatcaaagccatcgactccacccagcacctgagtaacactgacttcatttctatccctatagtcttgctttgtactagaatgtcatttaaatgcatgtctggctactttcacccagtgtaatgctttttagattcttccatggtatttcacatataggagtttattcttttttattgtcatatgaatatactataattcctttacccactcaccagttgagaattttaaacatattttagtcgattgctttatataaacttgtgaattctggtctaaagaataattctgtcacacccttcctgcagcacaggtggagagattgactcgttttattccataaactcctaaaacccaatgtagatatatttctgggttttaatatctatacatgttatttttatgacaaaagtttttgtaatataaacattaatgtgtaaaagtattcattaagcctatttatatttctcagtgggtaaaacacaagctttgaaaaacttaaaaatatgaaaatgatagaatatatgaggaaatatatttcatatggtacttaataagtgcttataaacaaaaagttgcttagagcgcatgggtgattgttttaatgggttttattattatttaagcatgatgaggtcaatagataaggacatcattttctttgaaaatatagtttgtgactctgttcccaagaggagggagcatgccatggctccagggggccacaaagagaagtactgggtttagtcacaggcagagagagagggaaactggctaagagccttcattgtgtaactggcaagccaaagtaagcaggttaggattccttagtttgaaaatttcagcatgctctggagcatagaagctgtgcctcctgatctgatccttggccctggggtgatcagggcagagagatagtatcttagagttaaagagtctgatgaaggaggtggttgtgagtgtgggctgtatattggttggtttgcatttgaaaagccccttcagggaagttatttactatctctaggacttgactaaccatggtaggggcagtccttccagtggcatcgaggccttagatgtcaaagaatcggaatatagaaaataaaaaaatattaatagagtaatgtgttttctaagtatgttcctttaaggagcttaactcttaaattgggttaatgcccttttaatataagttagaaagttgccttgtttaatcttctgtggcaggattccatatccaacagctgatgaggacagcaacagagaatctgtggaatccacattgagtcttagagacaattaaggggtggattcgcctattcttgcatttgaaattccctaagcaaccaaagtaattttgaatgggtagaaggggagagttgggaagacccattcaggaacctccctctctcacaggagagagagctattctcctttctctttctgttgcctattaaactcggatcctaagtccccaaccccccaaaagaagctgagagttggggtgagagcacacagcagttgactgaaagatgagggaaacatacagtttccatgcaacaagaagtaacattgagaaatttaattcttgattcagaaaacagtaaactcttatgtgagttgaaaataaaaatagggcacattttatcatgaaaggaattatgaggcagggattggaaataacaagttaataaaacagagaaattgtttctctaccattatgaggcccctatttagcttaaaaaagaaaggatattatgccattctcaaagagtgagtaatcactttctattatgttcatagctttacctctcatgaatagaggacaacttgcttcatgtttcatactagtcatgaattctactactaaaataagcctaacaacattcactgtgagcacctacttcatcccaatatgttggatctctatttgcccctagtttttttaatggaacccacaaaaccattgacctggataaatactggaaaagagaatcaagatgaccatgcaaattaatatatgagtatactagattctaacaaaaggaaaactggaatctctgctctaaatctaaataaaagctaagaatttggtagtataatatcacagtttaatatattctagatctcaataagtctatgatcttagaagaagaatagagctgaaattgttggaaaaaaatgtaattattatagcccaatgggttcttgctcttggcacagaaatgccaatacactgagacagtggtgttgcaacagagaaagtttaattattgcaaatcagccaaatggaaggacaggagatgtttctcaaacctgcctctccaagagttccgaagctagggtttttaaagaaaatttggagggcagggggctagggaataggtgctgctgattggttggggataaaaatcataggagtattgaaactgtcttcatgcactgagtcagtttctgggtgaggggtcaacaggactggttgagcaagttccttggtatgagtcacaggtcaagtggaatcagttggtctgtcctaatgcaaagtctgaaaaatacatcaaagacttaggttttacaatagtgatattatctgttggagcaactggggaagttacagatcttgtgacctttggctacatgactcctgagcagtaagcaattatagaaaggcaaactaaggaacaatggctggttatcacttaactatgcctgcatcttagcagatttcaggcccctaccataattctaaccttgggcctttcattcattttgaaaaggtacttttagtcctcaaacaaagaaggggtcagtttggggaagggactgttatcatccttgctttaaagttaaactataaactaaattgctcccatagttattttggcctattctcaggcatgagcaaggacagttatcttatgaggttagaagcaaatatggtgtcagctatgttagatttttctgactcaattttgcaaaggcagtttcataatcagtacctgaaagtcccaggccccatgtggttgaggattcacttatattaccattaattctcaccaacacaacaggcattgaaatcaccgaatcatgcactttgggaagccaaggcaggcagatcacctgaggtcaagagttcgagaccaccctgggctacatggtgaaacccatctctactaaaaatacaaaaattagccaggtgtggtggcacacccttgtagtcccagccactcaggaggctgaggcatgagaatcgcttgaacctgggaggcagaggttgcagtgagcccagattgtgccactgcactccagcctgggcaacagagggagactgactcaaaaaaaaaattttttttttaaagcatgaaaccatgatctaaccaacacaagacttgcgttgatgtttaggccaactttcaactcattacctttacctcccaatgtctaaaaggaaaatttgctaggcaataaaattatagcaagtgatcaccatcagggaatgtatgttttcatttatgtttgcattccccttttgatcctatatgctaattccatatttaaatatgcttaagacaatgaagaaattttcaaaaaattgctcaggtgatgaatagaatcttaatccaaaatgcagatcatttaagtttaagttgttattggcacaaagcttcaaagtcgaccaatttcctaaagggctactcagatatgaattcatatagttgaaagtcttcatcaaattttttgccacgatttacatggatataatgctgactcaatccttttatctaatcaaatagtcacaaaagttcggttattttattttggttttgcaatatgcttagcatagtgattgtataattttgtccccttaaaatacttatttcttttagtaagtcagcttcccagggcacagtgccagatagacaagttttatttttatcaaaataaaacgaaaaaattctctgtaaggcagttcaaaagtgatcattttcatcaaatgtagctactttaaaatctaaagagatgaaatatatggattcctacatagaagactaaatacaaccagaacggagggaattttttactttcctactaaaatgccttatatacagcccacccaaaaaggatatttgtaggttaaatcttgactttatcatttttattattaatgttgtttgtgttcactaacataaagcttacataaaaattccaagtcttgccttcttcagttcataaaaaagaagtagctatcctcacatacccatgattatatacaaatgttagatgaaaggttcccttttgtattattgtcaggagctccctgcgataaaatgttatagaatatatacctaatgtccttctctgaaagttcttttctcctactaacatatgtgttcctggcacataataggccccaagaaatatatgcttaattatttgaagacatgcatagcctaagctaactatttacctgaagagcgagaattttattctggcttattccctcttcaaacagcaggtgcttgatgaagtactcagcagagattccaaggcaactggctatagatctttaacaaaaaataaacatcaaaatttccataaaaatatgcttatgacaatataaattataaaaataggaacaatcatgttttggttgtcaaaaacaaaattataagtttaatttattttcttcaatcacattgtgctattgtttgcagtacacattcaggtgcattctttaactgcaataagcattttcctctctgtgtcttgacactagtcatccatcagaaaatgctaattatattagttctttcataagctgtctcccttggaaggaatttttaaaatgcagtagaagcactattatgaatttacttaaaagtataatatttcatacattaatgagaataaaaattatagaaacttactgaagaattatttttcttccagttacaaaagacaacctaaaaaaataaataatttaaacagtgctgtctttttaaatagaatgaagctaaaggatcattgaaagtttattctccgtaaggcaaactgtgaatataccatataaaacctgtttgctctgtctttaacgaaaagccttaattaataagagaaaatttagactgcaaagtgtcacttccagagtttgtatggatttggaatattatgataactcgtgggaaaccgaaacctccctcaaaaaagacgtggtgttatttccaacctcttttcaatggaaatcttaattccatattataaaatgaaatcatatgtttgggtctatgtgtcacttttgatcactgtttgaagagctttgatattcttaatacattcttcagggaggaaaaggatgctaatactattcgcatttacacctttgaacttttagttcatatttataagagagggtattatcccagtaagttattattcttatctccaaatgagtgctttcgaacagcctagcaactcctcattagtgtgggggacatcctcattaagtgtaagcctactgtttcagcctggacatgtttttcctttgatctagaactagaaggacattaatgaccaagttttagagacagctactatatcctctccccaaaatgcccatcgctttggtgcctgtctcagagaggcttgtagaagtcagcttcccagggcaaagcaccagatagacaagacaaggaaggacagagagtagatatcagggcacagtcaaggtcagtcaaggtcacgtaagtcattattcacgcaaccctgaatataaacctctatctgtggaaactgaatccagtatgcttttgttcaactctgaaatttaaattgtaaattagattttctttgtcatgtgtttgcattaacagcaaaatacttcatatctctaaagttaaattcagtcacatttatgttaatttaaaatattaacaaataatcagcaccaaaatcaaaaataacagcccaggatcctgagggaatagatagcattcctttagctactagtaagactggtttaaaatgaaccctgcaataactcaaaaatactaaagaaattagaaatattctctaaaagaaattatgttttcttactctttgtgctaaggaaaattcatgttttaaaaagagccccagagaaaaatccataaagtcagccaaatgcaaaatcagaaactaagtcttttttatttattccaatcctaatcaactataagtatttttatattgcatttatattaaatatgccgaaagctgacaataggtataggaatgggttattttgcctgcaatgctaactacatcatctgcatgctctgctgcactaaatgtaatgaaacttggtctaggtggaagatagcacagcccctgagaacaagaatgaattcaagaaggcaacattactggagctatataatcaacaccttccactgcacaagaaacaggttgagaaatgacctttacatgagctagtgaaatagcaaagtgttttttgttcccttctccattgttgtctgtgttggtgaaagcacaggcagatttcctccatggaaagctgccactttaccaggggaagcagtttttcacaggcaaactctctgatggggacaattgctagtttgatagaacacacgctcgggtgtgattgggcctgtcaggggtattgtgggtcacagtctaagaacaggaaacaccatctctaaacatagaaaatgcaacaccattggggaaggtggcagaggccaatgatattctaaagcacagcaggaaaatatttgcaaaggagcatgttttagctctctaggcagtgtagtgctcctgtgaaaccattgctcataatcacactgatagtatcttttatttcacagtgcctgacgatgttcaaaatgtgttcatattttgatcctcatagcaaccctctaaggtgtgaaaggcaagcagttttagagatgggcagccacagacttggaggtcaggtgacttttccaaggcatccaagctgagcccagggccttcgattccactcagtgtgtttccccaggatgtcacctgccttcagaaggcagtgtttgaactttgcagggtatcctgtccactgctctgtgcatcctagtgcaccgcaaccttgtaatctggtctcaaaacctttacttctttcttggcataatattaattgaaaagaaacacaggagatttgctttttaattctctcattttctaccttgctaattccatctccccttcaatttgtaggaatgcttaatgaaagcagcaagagagattatcattgggaactgaaatgtgtaatcaatccctgaatagaaaaaaatagtgggaattatataaataagataattttatagctcaagtacttaaaatcagacaacagagcaatacaaaactttttatgatggagtttctataattcatccttacatacaataagaaatgaaaccctatagatattactttagatattgcttaggagcagacaatcttttgttcatagagaagatagcattgaaaatgaacatttcatggagctttaacaactagcaaagctgaaagaaatatttttcactaagattgctttgatccatgataggtatttacaatatgcagccaagggctttgaccattaacaaaaataaaataaaatatatagtgcttgaattcccattaggtctcaagggtaaaagagtaaatttctctcaacaactttccttatgacatttttatcccattctttataatagttggtgctgggttgagaaaagtagaagagattccagtaagctcctaccttctttactcttccatagagtttcatctcaagctgggacaggagctagagagggagtgagacagccagctcattctgtcttctcccccatcttacgtcactgctcaagaagcgggtgtgtggagtccagagaggatccagttgttaaaacacttacctgaggcacttagaccagctctctccaagattatatggaatgctaagttgctcttgtctgctactgacgagtgctgtctccttttctcctgacccaccaggactctgatgttgctataaagcccagtggcttgtaaaaccaacattgtaatggctcttacttctaaatatctgaaattaccctttccagaaaaccaaaactctttctgtataaatacttctcagttatgtacatgattcattcatttctaccatgagcccctgaattctcctgaaggtgttaataactgaaactatttttggaaatatgaaataacttcatttgggtccagtcatggagatgtggtgatctggaggtggtagacagaggataaactactccaaacaagcgtcagaatcttactcattcgggcagctttcccgatcaccacccgtcagcctgcagtcacatacttggctgggcagagcgccttgcatgcaacgagggatggataagcgtttgttgaatgagaacaagctaatgagactcgggttctgtaaggaggctttctgtagcccttggttctttcttcatgttcaaaagaacaggaaactctcctgggcttgctctaaaagtagtttgaaacttaaatatgcagaagtcacctaaaaagtgtgttcatttttatttttattaatttttaaatatgtatttattgagacagtgtctcactctgtcaccctggctggagtgcagtggcacgatctcggctcactgcagcctccgcctcctgggttcaagcaattctcctgcctcagcctcccgaggaggtgggactacaggtgtgagccaccacatccagccaatttttgtatttttagtagagacagagtttcaccatgttggccaagctggtctcgaactcctgacctcaggtaatcgcccaccttggcctcccaaagtgccgggattacacgcatgagccaccccgcccacccctgaagtgtatttaaaatactcagtccccattatcagaaaactatggaatctaaatatatggaacaaagtgtgccttgcatcaggcaaaacggaatggagagctaacaatggaggaaggggctgtgcaccctcgctaaggacccagcatcttcctttgcttccctttcacaactgaacttctctcgctggtggttactcctgtgtcttgtagatgaagtcactcagtggggagaatttgattgtctcaccagccagcagcttaagttatcaggaaaatgcagtcggtacacccagccagaagtgtgggcagcatggagagagggttgtcaagaatattccatgaggatgagactttgaaaatcatttttataaatttaacttcgcttcctctgctagttcagatcttcactcccctctttctcgcttctttggcctttttctgtcttcagattataactagctagttcactgaataacgctcttgtttgagtcatcactctggactcaatccttgttgatttttatcaccatttgactactgacttttcccattcatctttttgttctttaatcttttgtttatttgctactctctcaactcataccgttcctccagtttccggctaagcattaatctcaccggggagaatattgttagcctccaaattcaaactatcttaatgtcgcgtgtgaatgaccacagcagaaaggagcccagtgcctaagtatgccttgccctggtgacctcactttgttgttggactcttagtccatttggactgctataataaaataccataaacggggtggcctataaacaacaaattgtatatatatataaacacacacacatatatgtacatgtatgtatatgtgtgtgtgtgtatatatacatatattttttttctcacagttctcgtggctgagaggcctaagagcaagatgccaccagatttggtgtctgatgggagcccactcctcttaggtggtggtttcatgctgtgtcctcacatggtagatgggcaaacaagctcctttgggcctttttgttttgtgatcctttttaaaaaaaaaaaaaaaaaattgagacagagcctcactctgtcacccaggctggagtgcagtggcaccatcatagctcactgcagccttgacctcttggcctcaagcgatcctcccacttcagcctcccaagtagctggggctacaggtggatgctgccatgcctggctaagtttttttatttctttatagcaacagggtcctacactacattgtccagactgatctcgaactactgggctcaagcaatcctccttctttggcctcccagagtgcttggttaacaggcatgagccactgcaccaggcctaggtctcttttataagggcactaatcccattcatgagagctctgccctcatgacctacttacctcccaaaggccacacctctcactaccatcacaccaagaatagggtttcaacacgtgagtttgggggaacacaaacattcagaccatagcagactgttttgtgaagtggctgaaatctaagtcattggagcctgttctagcacgtatcattctacatgctcaacatttaagaatacatttttaattttggctttttgtgtgtggctttctgacaatgaaaagagcctctttagtgataatgtgaatcaaaataaaatatattcagttcactccatacccccaagtgattgtagaaggcaggaatgaagtagtggaagaattagaaagatgtgtgggcagaaacttagaaaaaatatttttccccaaatttagggagagactgtagatctggcctgatgactatataaatgtgagaccacggtaaaagaaaacctttgccaattaattttcacagacaagggagtaaaagttttgctatttgaaattgcagatgctttacaactgtagcagattcaagaatttaacacaacctgattcagttaagaaactgtaaattctttgtttcttattgaatatttctcaggaaccccttctcactgggaaggggataattatagcttgccatttcaaatcacccctttcaaatgactcaccttggtgtgatactattttctgccccttcttcccagttttatgtagtttgatgtttaaacacacaaaaatcttacatgaccttatggaataaaaggaaccccagattcaagcctcgtctggtctggtctgttccaggctggcatctgctgtagtaaatataactgaactgatttgggctttgcagggatgcgctgtcacgctccactgaaacccctgatcctgaccagtttcctcgatcctagatttctcacaccctgctctttgactccagtcctccacattggaatttttggatggcctgcagccagatgtaggcactggggagtcaggagtgtaacctttagctcacctatctagagaccaatttatttcacattcctgcattctccagaattttcactcagctaagagacatcgggatatacaagtctcacccaatgctttctaatttttttccccacagtcacccaggtccagatggaacaaggttgcctcttaaatcatgttctaatctccctctagctctgatttatagcaaagctgacttaatcatctagatttggcttttacaaattcatcaaagtctgcctggctagtgactcaaatcttactccaaatctcagaagtgaaatgttgacttcctatttcttttgctgtaataatactttccatagcaaatcaaagtccttggtagattaggggaaaatgtccacaataatttctcagtggagaaaattccttagtatactgaaaaaaaaaaaagtaaagccattgcactacagtaacttcctgcccccctttacccgagttctgctgtgtctgcagctgtttgtggaagagaaaaggtctccttggatctgctgggcagcatttttcttaccttctcaactacaagctggttcagagagtgaaagtctacctggatctcaggagaaagacaacttgaagagtaatgtctatagtgatgcaaacacaaaaacagaagaaacttcttcatttaaaatacaatttttatttaatctttgatctctcaagaaccaccatgatttttgtgacatcaaggacagcccctgcagtgcatcccactcatcctactcacccctcacctgaccagggccaggatcagatttccatggggtcagcagagggctgagaagtcagaagacaaagatctacaagctctgttaattaggaagcctctagagaagcagaccaaaataatatgcatatcatatgttatacatatacacacataaacacatatatataatatatacatgcacatatatacatgtacacattcatatatatacagacatacatacacatacatacaacatacaaatactaaatacaggtcaattcccttcaaccaaagattctgtattctgtgagttaaacctcgctttgttatttcatttttttctttattctattagaggactcaagttttgtattgtttctgctttttcatcattacctgaattagcatcaattaagaaattatttttccttcattatatctttcccaattgttctttcctaccaacatgtttgtctttttagcaagaagtgaaggttttattttcaaaatattaactgaaatcagcttgaccagactttagtatttttttttcttttacagttagaatcatgaagtctaacaacaggaggtgggaaactatctcaattccattcccaaaatgaggtagatgggcaccagtaagaaatgaggattcggagcaactctgtgcatgttggttgagactccaaccaaccaaagaataggaattggctgtcaccgaagtgaaaaatacacccgccaagggaaattcccacacacaatctgttcaaataccaaatctggatatatgcccccaaatgtgagggcagataaaaatgtaaaaatgggatctaggaagcaaacaaatcagataggtaaaaaagacatcattctcaaatttaagaaaatggagtggctctaaaagttttattgtaaaatctaataaaggctttcaaaaagaagaatctttaaaggtcaaagaaggaagccataggaagaaataagaacaaaagaaacatatgttaagatgatgggaaggacaaatatgacaaggtttttcagaaagcttagagaaaggataaatcaatacggaaggaaaagaggaagataatgaatagggaagatacactacataagagatacagccaagtaaaaagctaaaacaactggagtcaaaacaacaattaggaatgctcctgtttttccagccacaaagcagcctgctctgacatctgcaggatcctgggtggaaacccaccaccctgtctcaaacaccaacatcccctttcatggactgagttgccagcctctataggttttattctaagttttattttcctccctatctacttgtattttcaggggataagtctagttgggaaaacatcatgtaaaaataaagataatgagatattagaagtactataatacagatttatacttaattcagcaggagaaacagaagtggttggtccattcctaaactagaatttgttagtatgaactataatgagactaatactgtatatagctaagaagatcaaagatatcaaggaacaatacaaactgattgatacttttatttttgatagggagatatttactccacttcttagcttctacattgaaggtgattcaagctatctattcactaacattttcgatgaagattgttttaagaaatacaatctaatgtgttaaaatgaagttaaaattttaaggttgaaaatccactaagctgaaatgaacatttgacatttgaaattatagaacatctaggtgattgcatttgaaattctttaatgtttaaaacttagattcattttgttcatgatttcagtaaattttaatttctgtttcaaaatgaattaaaaattggtagtttaggcaggatgtgatggctaacacctgtaatctcagcactttgggaggtgagagaatctcctgagcccaggagtttgaggccagcctgagcaagagaaaccctagctctacaataaataaatatatgaaaataaaatgttaaaaattaaaaaaaattcagtagatcaaacatattcctacatcttttataataccagtcagtatttgccccgagtatcttagaatgatttgtattttgttgttttactgggtagcttgttttgataatcccaactaaaaaaaatgtggtactttatcagtgatctgtcaactgaaaatctctagagaaaactaacacaataaggtaataaattcaaaagttcttaatctccatatacatttatgtaatcatctactcactgagtttttaaataaaaagttaaatgcatatatatgagaacaaatataattcataagataatggtaactatttatgtttttaaaaatatgattttaaaaaatattacatcttccattgaaaaaagtaatatggttatctctgaaaatctaaaatctaatacagtgcctgacaggtagacaagtgggtagtgcccaaaaatatgttgacaaatgaataattgtaacctgagaataaaagtcaatccttagtcaaatcaaatccagtcttatatttattttctatttggctatgatacttcgtcttttttctatggtcagttgaaatgctgaaaggatctttcacataattaaaaaattatcttaactacatttaaagcaaaagaggaatacgaatataattgtaaaccctgattacacatgattacacatgttctttttgctctgaagaaatataattcttattgttaggttctcctcaaaatgttgaaaaaaagcataactcttctctaatgcagagactaaatactattaaaatttgggacaaactaaaaactgtcccaatcgtaacatggcagttaaattcacgttaaaaggaaagtatacttcataaatgacagaattcaagtttctgcttgtcttcttttgttattagctcttcaccacaaaaataggtgtgagtatagatcagtagctgttccatgtgatacacacagatgccctcaaacaagtttaaagtagaacaagtcttccacccaggataagaacgtatcacttctctgtatttaactgttttatctaccccatttggaagagcacactagcaccaaggcaccattcttcaaaacaatgtttcttttataatttgttttgcttttttttcctatcagaaactagaaaatcaatactttttatttagccattatattgataattttcatttgcttgggtcaacatttaaggagtacacgaggtgctttttgtgattaacattgggagttaaaaatgttaaaattcctgattgtcagggaatatctgatatgtttacaataaagcctccaggagctatgtatatagggcgaatataaaatcatctgtcaatcttttaaaatttttttcccattaaaccctcattaacatgtaaccatataataaggataatggtaatttgtgatcatatattgaggtaatgcaagtcttatgacttacatcacatctttacatggtgggtttttttgattctgaatttttgaggcataaagataaatagaagagcatcttatatgtatatattttcaaagatttactaaagccaaactccagagtgttcagggagactcaactagtcgtcttattgagttaaagtaaaagaaagaaaagaaaaaataaacagaatagggtaaaatgaaaactttggaaagatgtgaaaagatagattttaactaatgtgattgtaattgtgccatcactgagtacacaggtggaagaattgtagagtttgagtacaaatgtgtaccttagatatggtttatgttcactctttcatttaaaagctgaattttagagagggttaaatggcatttcacaaagctagttggcagcagagcccagactaaaaccaagatttccttgtaggcatgtgtattagtccattctcacaccgctaagaagaattatccgagaccgggtaatttatgaaaacaggtttacttgacccacaatttttaacaggcttaacaggaaacatagctgggaggcctctggaaacttacaatcatggcagaaggggaagtaagcatgtcttaccatggtggagcaggagagagggagagaggcatggcagtgtacgcctgtacaaacagctactcaggaggctgaggtgggcagattacttgagcgcaggagttcaaggctgcattgagctatgcctctgcgctccagcctgggtgatagagtgagaccttgtctctatgaaaaaaaaaaaattcatttaatttacattaaataaatctataactttccttattatttatgtaaagatttattagtgaaaatgttccttctatacttaaaccccatctgcttcacttcacgcccaataaataacagttagtaggttttgtacattcttccagagtttaatgtacatacatgcaaagatgcatataaattcttcccatgcacattttttacagtgacataaaattgtatttattgtgtacaacctgatattttgaagtatacaaacatgtggaatgattaaatctagctagttaacatatgcatcacctcacatagtcatcattttccatgctgagaacacttatccacccactttacatttttaagtatacaatatatttttattaactatagtcaccatgttggacaatagatctcttgaacttattcctcctatttaactgaaattttgtcccacacatcttttttacacaaacattagcatgctctacatattactttcacctgaaaaatacttttcataattttttcatagagttctttgagcattaaaaaattaatgtgtgtaaaccctaaaaccctgtaacttatcattcttcactgtatactactattattattacgactattactgaaaaggagtagtcttcagtagttgaatttctaaaatatgttgctagatgaaacaagaggaattagtgttttgagtttcaatctttttgtttttgtcttatgttactttttaaaaataatagatatcaaaagatattttcaccggcaaattcatctatcttttcttctgtgactttatttgaatcctcgcttgaaatcccttctcctttctgagtttatgtagaaattcttcgatattttcttgtagtgcttttttttccccatttgctttctctgaaatttatatcaatggaggaagatacatggattcaaatttttttttttccaaatgactaccattcaacagtttattgaagaggtcagctttccctaactgacttgagactctacttggaccatatgtttaactattatatgaactgggtctatttcttgactttctgtactgttgctttactgacttttctgtactgttgttttttacaagctgtctgtccattttgcctagagtttcttagattaaagtctgactcagagtaaccaatcttttcatagcagcaaaaaaaaaaaaaaaaaaaaaaaggaaaattctagcatcgttaaatgacaataaagattaaactgttaacagaataagtgttaattggttttaactgctctgtggaaaagctgtgctttgaagaatttcattatgttctataattaaacgttaaattttaaatactgaatagaaataccactgggtttttaggaacatgctcctactctaccccattactgagagtttaaaatttctgtgttcacagagactaaatatttggttattaaatatgtacacaatattgcaaaacttacagtgacaatgaaattatacagctgtgaagatggacaaaattgccagatgtcaactaattcatctgtagcaaagttttatctatagacccacaaaaaattatcttaaagtatctacacttactttaagtaaaatgtctccataatttttgacttggtaaatttctttcacacatcatgtgggaagaaagagtggcatttcaaagtcacgccttcatagagagccaagtttgagagttacagacaagaaaaagagggcgtggtctagtagttcaatgctagtaatattttctccagaaaattcctccacgcaccatgttagggctgattctgcccttgaaggcaactaagagaaccatgaatagtggagcacctcctctggagttcggtttccttcaaatatatacatccacatgatccctggttattttttatttgttagaacataacagataagtctgacagtactgttatctcaagtgattctggatgcaagtggtgaggctggataaagaggatattctcttagattccatagaggaatgtaatttgacaaacagacatttagggaaaagactaggaattttacactcttactgcattattgactccttagcacatgctgtcagtgtcagatggaagggttcccaaggccaccctccagctcaatactcctctagaagactcacaagactcagaaaaacacattatgctcacagtttgtatcaccacagtgagaaataagattaaaatcagcaaagggaaaagtcacaagggataaaggccaggagagaccaggcaaaaccttccaaggcccctcccagtggggttgcatggggacacccttaattctcccagcaatgacgtgtgacaacacatgcagtgccataaaccagagaagctcccctgagccttgatgtccaaggtttttattgggggtcagtcatgtaggcatgcagcacccccaggactgactcagctattcaggctccaggctgcatcagagtaaaaacaggcatccccgctaggctgtcccttgttgggattaatgtatctggtcaaatgggtatagcatggcccaaggtctcagacttacagaaacaggcagaatattccaaaggccccagaaatcaaatcccagaagccagccataggcctatcctaaaaataggaatggagaatgtgcagggtttgaataaccaactggtgcctgctaagttaaccccttcctgcccactatcacatatattacttcatttaattaaaaacaaactgataaattcttgttgccaattttataggtgagaagttaataggtaaaataactggctcagattgatccccagttgtcctcctcatggccctgtacttctccctggtagcacatatcacagtaagtttgtgattcttgctggcctttcctgactactcaaaagcctcagaagcaataggccatatatatttttccctcctattcagttcccaggcccaaaacagtgcctaggttatagtagctacttgaaaattatatgatacatttatatgacaggctagagcattgtggttgaaatcggtgccctagtcttttgaatcctatattgttataatttccctatatcacaatgttgaaaacaaacaaaaacaaagaaaattctggaaacaagtgtcccagttctgtttacctcttagaatttttatgaggccctagaatattcctcagagctgaaagaaaccttagagattatattatccaacatcctattttagataagaaaaaaaacattcattttgtacaaagacattgttagatataaagagattacaattgcaattgtctacaaacatcaatagaattctagtttgaagtcaggacaaacacacgtcatccatattttccctgtttcacaaaataaatgcaattgaggaatatgcatcttgttggcaagggaattgggggttcaactgtaacacctatgttttagcttttcccaagttaaggaaataattctttgggttcatttgccctttttgacatatttatttataatattagttttatatatcacagtcttaaaaagttgtgcaaatacgtcttctaatatgtcctcctgtgggtctcatgtgtcatctcccactcatcttcaatgaaatggtgacctgtggagaaggttctggagtctagtcatcaacaaacataatgtgcatgtgagtcaccttggggtgtgttaaatgcagatttagatctgatggtctggacaagctcccagggaggcagatgctactgatccgtggaccatgctttgaggagcaagtcaaatgccatctaaattatttcctctttctcctaattacattctctagtattggcttgttaccacaagactgtttagacagatatgaaacagtctatctgttccctaacagccccaaaagaacacattttaaataataagggaaacctagagtattagtgcattttcacactcctacaaagaaatacccaagactggataatttacaaaggaaagaggtttaattgacttagttgcacatggctgtggaggcctcaggaaacttaccatcatggcagaaggtgaaacggaagcagggaccttcttcacatggtggcaggagagagaagagcaaaggaagaacttccaaacacttaaaaaccatcagatctcgcgagaactcgttcaatatcaggagagcagcatgggagaaactgccccctgatccattcacctccctccctccacatgtggggattacaggtccctccctggacacatggggattacaatttgggatgagatttggatggggacacagagccaaaccctatcacctagcccatttattccaacatggctgacaaaaaatcataaatatgaccttcatctaggcttaggtacaaacactgaagaaagaacatcttctacctaaagtttctttgctttttatgctgttttagatgccttatttcatgatcaaaggatgaagtttacagtagtttttacttcagagacaaaaatccctcctgtaagcatgcaagctcttgcgcggggcagagtcaaatcccaggaagtggacaagcactcgacctttacatctcaatgaccgagtgtgacataacaatttgtgtcttcattatctcatttccaaaggctaataagtactgtttttcagatgactatgaacaaagctcaacctcaaacaagatgcactcgctacttatcaatggttttgttgctgctgctccttactcctctgaatcaacaaagaaagctcatttgtttcactttgtgaaaactcttcatttttcccccagactttccatttcacgctgtgtgaattttattaagatctctttcagagaagctaagtgctggctctatagggccctaagggatcacagttgcagcctctgtaatgtcggaagcctcttgagacatttcttttctattgaaaactctttggagaatcatagagaagaatctaaaatctttttggtgcttaaagaaatagttatcctcatgaatatttttatgttataacttgaaaatcgcttgatgttgtaatctgaaaaatcagcaacacagaaatccaattaatatccaatatccaaaatattaacatattgatattgggtgggtctttctgaagactttcttaaaagctagcttaaaatattaaaatgttttccattttagagttagcctttgttaataaaacttacctataatcctattgaataacaacttgtcagtggagttttcctaattaaaaaaaatgtttttaaaaagtaattctaattagatagttgaaaaaagaatttgcattctgatttttccctgaattgacataagaattttaatgctctcagaaatgacatggtgataactgcataacagtttgcccatattgtatcatgatagtctatgtcataatggcagataaaaacactaattcatttaaatattggaaagcatccactgtcattgcctaaatcaccttttttttctgttcctttacactgttgtgaatgcttcctttttaaacatccaaatatacatggatttttatttttatttccattttcatgtaccatataaagatgcactttttggttggtttggttacggctgaatcagcctcactaactcctgtggaggtcaggaggaggaggcacaagggcaagggctttgtctacgtggaaaactgttatgcacttgaacacatggagacccatctctttccctatctctattctcacagaatgtgtgacacaggagaaggactattcacttttcaaacaagggaaggagaaatgatctatcagaaggttcattctgcgacactggccatagctgagcaacatgaaagattaatgctagaaatggaacagaaggcccgggtaaggccccttccttggtaacctatcagcttggaaatgaatgtcactgggatctgatgtacactgtgtatgtgtggggccattcatgtcagcgcctgggtgtccaccctgccctgatcctgagggcttaccctaccctctcatctctctaatatcctattcaatatgtcaaaaaagaagttattgtggccaccaactgtgagccctgcacttctggcatctacctatgtaagacctgttgccttggatgtcagagagtagattgcatgaaataagaagcaatgctgtctgcatgtccccacatacagttggacaatcagatttaaatatgggctcaaaataactaggaaaattaagttctcaccaggaagggttccactttattttttaacctttatgtttatcctaggtgctctaaaagttctagctcttcctgtatgtataataaaatgtttacagaaggaggttatgctggttgacaatagaataatttgtctatcatcttgtcctggaactgtagtccagttttaggatcaagctaaaaaataatctagtaaagaatctaaagtagtaaattttattaatatgacaagctgaaaaataattataagctttattactaatttgcttgaaaaagcaaacaatgaaatgactattgattatgatcttaagagatgagtattgttttttctctaggatttataaagatgcatcagagttcatctatagaaggacaggtagtgtttgggaagcatctataattctctttgtgaaacatcagtaagtctattgtagtttaagaaagtttcatattactattattttagtttttatctctaaaattctatgaaacattttgaagtataaaataaatatttttaaaagaaagagaacagaagtagcttaaatgatcatattttactcttaatgcacttttaactttctcaatactatatttctctctccatctggggtacggttaaaaaagagccttcctaacacctcaggagggaaagggcaacacagggcattggactccccatggaaatgaaagagtagcttcagcatttgtaggatgattaggatgagactgtggggttgactgaagaatcatcaattagagagggctggtaaaacaaacttctagaaagatttgggttaactttaaaccattgtaacaattatctaatcaacgtgatgtttttctagcgattaaaatcaagtggaaaaatataactatcaaatttcaaattatttcagagtcatgcatattgatcatcagcccatattttcaatctgctggtgcttgttttcaaccaagatttaccatggggctaaccatgatgtcacttgctattagttaacctctgtacttctttacttatagttgttttaaacaagcaaaagctcatagagtgatttaaattatattttaatgatggaaattccaagagctctttcacatactgtaattatctgccataaagaagagtaccccgttggtgctctgggcttgcatcccaacaccaccacttactggctgtataatcttgggcaaattatttaactctggttttcctttatctgtaacaagggcatgtaatagttctactcatttggttgttatgaggtttctgcgcattcatctacataaagtgctgagaatcagaccaagcacatagaagtaccatgaaagtgttcattatggatgacggtgatgtcggagtgacattgtatagttataagagttgctattatggctacataatatccttcacaatctttcaagtatttctaacaatgttgtgccaaaatatttgctaaacaaaacttaattcacttttgttgttgatgttgttgtatgtttctcgtgtcctgtgccactgagaagcaagtcaaaggaatggagccaagtaattgcttttaatggctcagagatgagataatggatccagtcaatgtaaccacaggcagtctaaagccagggtgtacaccacaggcgtgggtgccaatatcagtgctgagacagagatagaagggagagcgcaacaaatgtttaaacagcaggctcagcaaggctcaacagagaaacaaaatgtttctagaaattacaaaatcagagactccatcacttggcccatacatgtcaatagagtgtttgatttaattcagaaataatttccaactatgcttttctctgcaggttaatgctagtaagaactactccatggctaatttgttcttcagagtaaactgaactaatcctttccaagtgcaagctgcctcaagttgataaatgcctaaatttccaaaatactacaaccaaaagcaaagttttccagttctccagatacaatttttttatagatacctcaacatgcacaaaacttttctttgttgctgttgttttttgagacagggtctcgctctgtcacccgggccagagtgtaatgatgtgaacacagctcactgcagcctcaacctcctgggctcaagcagtcctccagcctcagcccccaactagctggtactacaggcctgcaccactattcctagccaatttttgtattttttatagagacggggtcttactgtgttgcccaggctggtgttgaactcctgggttcaagcagtccaacttccttggtctcccaaagtgctaggaatacaggcatgaccaccatgcctggccacagaaaactcttatacaaaaatttccaacaagtatgaaagagtgtttaaatactctctaactcttcatttactatttaaaataacaaaattgtaacttgaaagttggataaaaaaactcaaatgagaaataatgtctcaacaaccatttcttactatgaaagaaaattcaatatgatcttttcacaccatataagaccttattttgcccttgtttataacccactttctttggggggccacatgaataaacatatttgacatatatccatagtctgaattaggacatttctattcttgcttgaagaatttgatgtttagaaaaatttctcagcactggccaggcacggtggctcatgcctgtaatcccagcactttaggaggccgaggcaggcagatcagctgaggtcaggagtttgagaccagcccaaccaacatggagaaaccctgtctctactaaaaatacaaaattagccaggcatggtggcacatgcctgtaatcccagctactcaggaggctgaggcaggagaatcgcttgaacccaggaggcagaggttgcagtgagccgagttcgtgccattgcactctagcttgggcaacaagagtgaaactccatctcaaaaaaaaaaaaaagaaaaagaaaaagaaaaatttatcaacattgtgagaaaacattgcatttgccactcaaaagtaactggacaaaagaaccactaaattggtaagataattagaagtgaatgtcttgatttccttcactgagaagaataaaaaattaatattaactgacaacatattaaggagaggttattggtttattaaccattcacaagattataaagtgcttgcactatgctgagtaccctgcacagtggtacagggaaatacaagaggagagcaagaaagttccttctcaagtagcccagaattgtgtgggatcaaataatttgtactgctcagaacaagattattgcatgtcctttgactccttgaaatatcaaaagttttccatacctcaatgtatgtatgggtaagacatcaccatcattgaattttgctacatgataataaatacaccatttgagcttgttcatattgtcatggcaagagcctgacagattattgggataatcaacttattggagtcggccctccatagaatgatctctgtattagaagatgacatgcttgccattttgcattcagaggtacagcaacagcttctcattcctgcctccaagtgagaatcagaaactggtcttggcagaaaaggagacagcaatcttaaggagtctctataccttcttcattttcaaactacaaaccagtctaattttaaaagagtttgaagatacatgggagaattaagctagggtaatacatattaaactggaactatttttgaggaatatgtttcaaatatttgagaaaatgattaaagctagatatttgaacacgatatgttcatctctagaaatgtttccatttcacagagatcattcttgttctcagagctagcagagttctttggattccattgccaaaagtatctgtagatggtttgacatgcatgtgcaacattatcaaaaaaagttttgacactgtgatagaagccactcatcagaaactgtatcacaaatgctcccatgtgacttagcctgttaaggttgagtacaggctgaaatcatcatggacacggcctcaactggattgaaataatttaattttagattttcatggatctgctttacatgcacacacatgcacattaaatgaaaggtgctttcttttaaaatgtgccttttatgttctaaagcaatttattataaaatgctcacatgtaaagagcagttgagaagacaagaatgagaaaaaaaaagattttttttttctgctatatccaaaataagtaagcaaaaagaagtgtgggggggattgtcagtaatttccaatcttctaacattgcaagtaatttaaaaacatttgtatacaaacaccctcacaaaatgagaatttcagtgtattaaaaaaaaaaaaaaaacagcatttaggatgctcctgttctgtaatccccatctcctgctcaccagaaaagctctgtatacagtgtaaggacaaatagcatgagtgctgttgaaacgccaggaagatatcaagactttgtctaatgccttaaaaacatcatcagtgggacttgtcaaatgggctgccctccagagctgtcaatcctgtgattttcctaagctctggtggacagaaaaagaaagaacattgggaggccaaggcaggtggatcacctgaggtcaggagttcaagaccagcctggccaacatggttaaaccccgtctctactaaaaatacaaaaattagctggtgtggtggtgggtgcctgtaatcccagctactcaggaggctgaggtaggagaattgcttgaacccgggaggcggaggttgcagtgagccgagatcgcaccattgcattccagcctgggcaacagagcaggactccgtatcaaaaaaaaaaaaaaagaataactgcaaatacagttattattcagagttctattcatgattttatcactcaatattaccaatgttaatcataagattagagcttttgattgctgagagtgatcacatttgcatatttgtgattttttttctttttttactgatagtcatggattgcgatgaaacaacacaagctgaattagaacaaattattatggttgataatgaaaatgtgaaaatggatctgtgatcccaattaatcaattcacttactgttgttcagtttcagaacactaaagaaaatttagtctaaacaacaacaacaaaacctcacttggctgggcggggtggctcacgcctgtaacccctgcactttgggaggccgaggcggacagatcacttgaggtcaggagttcaagaccagcctggccaacatggtgaaaccctgtctctactaaaaatacaaaaagttagctgggcgtggtgacgggtgcctgtaatcccagctacttaggaggctgaggcaggagactcacttgaacctgggaggcagaggttgcggtgagcagagatcacatcattgtactccagcctgggtaacagtagcaacactccatctaaaaaaaaaaaaaaaaaaaaaacacccacacatacacatgcccaaggagaaacatgtatctctgcgtaaggacacgaaggaggtagagatagtgagaaagcaatgtgtaatttatctaaccagtggtgttcttgcatgatgtgagtaaaaattagactatcatgttcttttttcttaaaacttgtttccttaaaattgatattttagatgtcacttcagaaaatgcatttcatgtatgtatgtatgtacatgtatgtacttctcaaatgtaaatcaaatagatcagagttggttctgtgtaagaaaaatcattgcctaacacaaaatattgcaatttctgtgtttaaaaaaatacagttttgattctttgctttgctggaactgaacaatataaagaaagctgcacaaggatagttttcttaaatgaaaataacagatttcaaaaggttcatcaaaatgacccaacatacagacattatgacaacatacacacatataacccaatggctcagactatcttttctttggaacaatgctataaaacagaagtattttttaaatgtaggccacgaaaatctaaggagttgatataagcattgcctgggaggataatgaaggccacatccagtgaatgtgataggaagtgtcagttcctgggatgtgttcagtgaacacagatgcagattgtagaagaaacacagtaggatttcagagattgattccagggagactacaacagagctatgtgaccttgggcaagttacgttctctgtgcttcagttacctgtacttaaaaggtgttgagtgaagcacaatgatatcataatatgtacttcacagtgttagaacaccacctggtctttagtaaaagctcagtaattatgagctaattcataagatggctagcaagaaaatttagctttaagtgggaaaaactgttttaaccatcactaaaaattcatcccagctttcattacgtgcagatattggaaattaattttatgaacttaacgatagcctctagatatttacatttttttaatttagaaagagcccaaaatttgattttaaatcactaagaaatttaacgttttatgtgtatttatcatgttccttttattcaaagagcagctctgtaaatgtgtcttacttacaaatagataaacagaaatagagataatagagagattaagaatatacatgttgttaaatgcattactgattgcagacggaaatgatgttgaaagtgaatgacagtttctgctgttattctcaaactcagcttattttcagacttcctgaaagtattttggtccatacatgattttatttatttaattatttatttatttattcatttagagacagagtctcactgttgcccaggatggagtgcagtgacatgatcttggctctctacctcctagtttcaagcaattctcgtgcctcagcctccccagtagctagaattacaggcacatgccgtcacgcctggctaattttttgtattttagtagagagcattttgccatgtttcccaggctggtctcaaactcctgagctcaggcaatctgcccagtttggcctcccaaagtgctaggattacaggcatgagccaccgcacctggccaatacatgatttgaaatatacaataacactcatttcttcaggtttaatgaaaatatcctacaaagttcaattaaatgacatctagcaactttcattcaatgaccatgtaaatattaccttttatttgtcattctggtacagacctagcatggtatcttctaattcctttccatttatcttgaataaaatggaagattaagggtgaggtgtcccttattgaaaattaagccaagtctgtgataagccaattggtgttcttcttgaacatgagaaggtgttctgtcttgaacatgagaaacaggcactcgcattcctgctctggttttgtgaaatttacccaattggtgtaattctcatcttatctgtatcctggagaagagagatccagtaatgtattttacagtgagtcatggggaagagggaagaatatcaagactctgaaacctcagagccatctctcattagccgtgtcaccatgaacaaattatattatccctctgtacctcattgtccttgtctgtaaagttcagatggcatatttgttgacaatttatgtgaatattcagtagtataatatatgaaaccaatttgcacattgccaggcacatagagaatggctcataaatgtcaatttataaatgctgaatttcttctctctcagttgtatatagatttgtctcaactgctaatccaatttttaatttttaggcaatcactagagagataaagagcaaaaggaaagtcagttaacagtttttttatacaaatgaattttatgtaaatgaacacaaattagcatcaatgttcatcacagggggaagaaaagcctcaaatcaacaaaggaaaaaatttcagagacagtaagattacctaaggtcatatttttggcaaaagcatgaagaggtgtgggttgccaataccttcataaaattcccaacatttgtcagccccaccttcctagtaacttaggtcttctcaagggataagggtagaatgtccacattgcaatatattagggaggaagctctttccgctccgccccctcccccccacagaagatatcagcatcaaagtctaaagagcaatgggctcagagtctagagaactgttttctattgggagctctgtagttgagatttaccttgagcaaattcttgaatttttctgcatgttgatttcccatctgtaagaaaattgctaggctttctaagaaggatttaaaccttgaattgcatgacttgtccacatagttacttgaagcttcctcactccgtagcagtcttacatgtatgcagccttacaaggtgactcagaagaagtgagaggaagaggagctgtcataagggtcttagaagtcatgtccacagcagacataatgtcacacctaccatatgttatactggtcaaaacaatcaccaagaagcccagattaaagggagagaacaatcttacatgcaaagacacacatagactcaaaataaaagggtggaggaaaatttaccaagcaaattgaaaacaaaaaagcaggggttacaatcctggtttctgacaaaacagactttaaaccaacaaagttcaaaaaagacaaagaagggcattacataatggtaaaggggtcaatttaacaagaagagctaactattctaaatatgtacgcacccaatacagggcacccagattcataaaaccagttcttagagacctataaagagacttagattcccatgcaataatagtgggagaatttaacaccccgctgtcaatattagacagatcaccgagacagaaacttaagatattcacgacttgaactcagctctggatcaagtggacctgataaacccacccccaaaacaacaaaatatgcattcttcttggcaccatggcacttactctaaaatttatcccataattggaagtaaatcactcctcagcagatgcaaaagaactgaaatcataacagtctctcagaccacagtgcaatcaaattagaactcaagattaagaaactcactcaaaaccacacaactacatggaaattgaacaacctgctcccgaatgatttctgggtaaataatgaaattaaggcagaaatcaaacaacagatgctggcaaggttgtggagtaataggaacatttttacactgttggtgggatgtaaattagttcaaccattgtggaacatggtgtggcaattcctcaaagatctagaaccagaaatatcatttcaccagtcatcctattactggatgtatccccaaaggaatagaaatcattctattacaaagatacaggcatgcatatgttcactgaagcactgttcacaatagcaaatacatggaatcaacccaaatgcccaccaatgatagactggataaggaaaatgtggtatatacataccatgaaatactatgcagccataaaagggaacaagattatgtccttttcatggacatggatgagctggaaagccattatccccagcaaactaatgcaggaacagaaaaccaaataccacatgtcctcacttgcgagtgggaactgaacaatgagaacacatggacacagggatggggacaacacacactggggcctgttgggggttggggtggggagagggagaccattaggaaaaatagctaggcttaatatctaggtgatgggttgatagctgcagcaaaccaccatggcacacagtttacctatataacaatcctgcacatcctgcacctgtaccccagaacttaaaaatgaacatttaaaaaaatgaaggaacataggcagtttctgagtgccagcttttaaacgaatttgcagccatcttcaatctttcacaaaataatgcaatatttattactatttatgatgtaagattatgaggaaacattatacagaatctcttgatgatgaaaaaaaaggacaaaagcatagagcagaatcatgattccagttttgcttccacaggatatatgttcttaggaatgtcgattgatattaatcaatcaaagcttcagcatcctctcattttaaagagggatacttcatccctttcctatcttacaggaattttatgaggatttaagtagataaaaatcaatgagttggccgggtgcagtggctcacgcctgtaatcccagcactctaggaggccgaggcaggtagatcatgaggtcaagagatcgagaccatcctggccaacatggtgaaaccctgtctcttctaaaaatacaaaaaaaattagctgggcgtgatggtgcgcacctgtagtgcagctacttgggaggctgaggcaggagaattgcttgaacctgggaggcgaaggttgcagtgagccaccaagactgcgccactgcactcctgcctggcgacagagcgagactccatcaaaaaaaaaaaaaaagttctgggtcaaataccgggtaaaatgactaaagggatataaaagtgtagaatacttgaatttggctgaaaataaggaaaaggcattttatatatatatatattatatatatataatatatataaaaacatgtatgtgttaaaaatgctcaataatttctactagaacaagtgcagatgaaacaaagatattaatggatgatgaacaacactgtttcttgaaaggaaagcccagacttcctaggagaacacagaagagattcttattcatttggaagggtaggggctagaagatggaggtgaggttgaacattaggcctgggcagaacttttaaaggagagtttaataaaatagctaaggaggggaaatgtaagttatagaaccatagaacagtcagaaagctttgtgaattaaataaaataccactttcatgtataaaatagtacttgaaaaatgggcaaggaacatgagcagacatttttcaaaagacataaaaatggctacaaaggttcataaaaaatgctgtacattgctattcattagggaaatgcaaataaaaccacaatgagatatcttctcatacgcatcagaatggctattataaaaagatgaaaggtaacaagtgctggtgacgacatggagaaaaggggaccaggacactgaacactgttgctgggaatgcaaattagtacaaccattggggaaaacagcatgaaggttcctcaaacatttaaaaataaaactaccccataggccagcaattctacgtctaggtatgtacccaaatgatttgaatcagtgtcaaagagattcaattctcttatattcactgcagcatgtttcacaatagtaagtttatggaatcagcataagtgtttatcaacaaatgaatggattaaaaatgtggaacacatacgcagtggaatagtattgagccttaaaaagaaaaactcatttgcagcaacatagccttaaaaaaaaagaaaactgacatttgcagcaacatagatggaattggagaacattatgctaagttaaataaaccagacacaaaaagacaaataccatgtattctcacttataaatggaatctaaatcaatcaactcataaaagtagaaagtagaaatgtggctacaaaggctaggggctcgggggcaacagggagatgacggtcaaagggtaaaagtctcaggcaggaagagtatgttttattttgattttgagtgttctattgtggcaaatatagttagtaatgctgtattgtacatttcaaaattaccaagtaaatttcaaaggttcttatcacaaaaaagataagtatttgaattaatggttatgttaattagattgatttatttcacttgtattcataaattataatatgtgccccacaaatatatataattataaattgtcaatttatagtacagttaaaaagtacttaaaagatacaagaggaaatggacagaaacatgctaatcagtcatttgaaattaacactttcatatcttgatacagtggattaaaaattgaacaaatatatatagagcaggaaatgcagagtgaatagtgtttattatgtgtatatttgagtgtgtgtagagagattctacatcagtgtgtgcatcttttcaagtacttacaagatgtacagaaattggccatattagttaaaaatgaaaaataaattttaatgtacggaaactactcagtgcatgttctctactacaaaacattaaataaaaaataataaaatttgcacaaatggccgggtgcagtggctcacacctctaatggcagtgctttgggagactgaggtgggagaattacttgaggccagggttccagagcagcctgggcaacataatgagatctcgtctctacaaaaaggaaaaaaaaagtgcacaaaaaatcattaccttaagaaaatatacacaagcaatactttatgtaaaaaaggaaataaagctacaatttacaattatataattttaggagagaataccttctattctacttcattcagaagcaaatgcttttattaaacaaatacaattttaattaatacttaacttgagaaggtaaaaaaaatagatcaagaagataacctaagaaaaacagcaggtggaaattaattagcacaagcacaaaatataagaactgaaaaatatgagttatttacataaatgaaaacacaagtctctctaaaagataaatataaaaatatagaaacattatccaaagtaaaacccaaatatataaattcaacatatgaaaggacttataaaaatgtatttttttaaaaaatcctacaagaatttgatggttttgtattaaaatgtgaacaccaaataaccttaggagaattgatgactttttaggggaacaacggtcataattctacttatacatacatcagctaaagtccctagatggcataactaacctaaatgtttaaaatttttctcaaaattttttagttttgagattttttagtttttagttccaaaagagcagaaataagttaatgcctttcagtatggatatagtgaatacatttggggcatagcaaggtagtcctttgtattattcagggtccacttaagtaaatggagcctgtgatagagagttcaatgaaggaactttaatacagtaatttagattcaagagataggaagagtagagacaatcaaagattagcaaaagcaggaaagatgctaccagccctgcttcccttgcctattagtttcatggatgttggcagaaaacacaaaaaactcctgagtcagagacagaggacttgattcctgaggcacagcgagcatcatgagtttcatgcttccataggtttccctggtcccctggtcccacggggtcatgtggagcagccagggtggatggtgctgcatattaccacagccaagggatctgagttagcaactccccatcttatcagggggctgctagcaaccctgcccagcctttgccttggaggaaaataggatctgtactgtcctggtcaggaaacaaatctgccctctgcctggaggctgtttgctgtacaaacatacttgaaaagatagtaacaaaagtgcaaagccagagtgacacaggactcattgtttcctaaaaatgaccttttcaatgaaatgtgttcaaaagaatcttctgaagtttaggggaggaaagagagatgaggattggaatctctttgatatcatctacgaatctcaaatatttacaaataaaagataagtgtatttatatattgcctaaatgggaaaaacacaaggaacccacccttgtttctatctttacaagagccctctaaatctaaacctcttttctggttggggagaagggtctattctcatcaacttgaggacagcataactctcatttgtgttatattcaaacaaaggtatcagtgcagtctccatacagcacttaggggctaaattattttcttagactgttggctttgtgatgagatgtgtcggttgtccctctcaaataaaacacaaatgttttaactactctccaggcttatttgagctgtgatctctactctttctagatgctaactaactcctgattcattgctcatatcctagaaaactgactgctgtttcaaaagaatagaaggaagagagagttagaaccaaaaatgacaaaaagtgatggcaagtatatcaagaactgaatcaatgcctcctaatctagttgatttctgtatgtatgccagagcatcgtttctaaatcctgaccctatgcaaaaaggagaagcatcgcctacaggaaatagtcttataaataacaagggaattctggcacaaagattgcagaattttgtatcgctgtttgagacttttttttttactaagtccactgaaagaatcaatacagcagacccttgcagagaaggaatgaaagaacttcaaacacatgtatccatcttgtttaatttcttaaaatacattgtttagaaataatctcataacataattttttatataaatatttatttgcaatataagttgccttatatattttgttgatatacatacttttatggtcctaaaaatcctcctggtcaaattgatgcattgctttttcaatgaaggcattactatagcattttaagttttgttttttcttaatgcttttaattgaagcattataatatgaaaatagttaaggatgagttttaattaaatagttaaggatgtgtgtcctctttgttgaagcctgtcatcaaaaaaagttttacacctgtaatccaggctactcgggaggctgaggtggcagaattgcttgagcttgggaggcggagattgcagtgagcgaagattgcaccacactccagcctgggcaacagagtgagaccctatctccaaaaaaaaaaaaaaaaagaagttatcaagagtgcttgaaatactgtcttagtcactgcacagatcaaacaggtcaatttctaatacattgcttaaagttcataacaaaattaagaattgctggttaaatcagattctgcatttcttagattccccatgagagtactcatattagtttgctcagcctgctataacaaaataccacaaactggatgggttaaacaacagaaatttattttctcagttctggaggctggaagtgcaaaaaccaatatacctgcagggttggtttctcctgaggcctctcttcttgacttttagatgggcacttccttgctgtgtccttaatagccttttctctgtgaatatttatccctgtgtctcttcctcttcatctaagggcacaagtcctatttgattagggtccccacacttatatcttcccttaaccttcattaagctctttaaaagccttgtcttcaaatatagtcatttgggggatagtgttttaacatatgaatttgtgggggaacacagttcagtctacagcagtactcaatacataggtacacatggggaatggactctattttaaaagtccaggggaacatttagacatctgagaaatgggggactagatttgtatccctggcaaagatcccaagaaaatccatgatcaattttttaaatacaaattttccatttttcagcaataaattatggaagtagaataaggagaaacctaaagaaatagaatatcattaaaagcatcctagaacacgaaaacaatgaagagggaagagtagagaaacatgaggcgtaaaacaatacagggtgattcagaagcaaatcatgtggaagagttattatccagtggcttccaattatatttccagcaaacaaaaaatgcttactctatttccctgatgcttaaaactgaccacatttgggaagaaaaatgtctcccagaataaaaaaaagagaagaaaaagcactttcatcacattttggaaagattaatttaccatcaatgatctactgtatgctgagtaataaacaaattataatacattagaaaaaggaataaagagtagacagtaggcagaacggtgattaatatgagactgaatctatggattgttgttattaatgggcattgctgacatgaattgaagatttatgtgtttaattaagtttatgcctcatatgggaaattggctttaaagacgaaagtcctatcttttctcctaataatcctttcataaaatgagcctggcctctagttctttatggtggtggatgatggacttccatccatatgagggtgtaatgcacgtttttaacgtgcatagctctacctgcagagtcccccactgttaggtccggggtaaaactggagacctccattgttgatgcaggatttttttgctccttagttcagctaaatccaggttcttgtctcacaaccaggaaaaattaggcatgtgaacacattgaagggtgaggaaagcagaatttattaagcaaaaggggagctctcagcaaagagaggggtcccccaccagccagctcccacctcacagattgaacacaaggccaccacacaggacctgaaggggccaggctcctcccctgcatcaggtgtgatttcctggtggctccgccccattttttccagtgcacatgtgggcccttggtctgagccaccccaattcatttcctttactacgcatgtgttaagggacagaatattttttacgtgggcttgtttagacaagtcccatatgagcaatgacctgggtgggtcagaggttccccggggagccttccttatctgcctagccatttcaccgtctcctgccgttattattgttaccaaaccacccaaagattctgaaagcactactctatgataacccagaaacttgtctccttagaaccccacccctgtaaacaccaaccacaggatgtggatgtggatagttcacctgtttatgtaataagcaggaaaactttgaagtctaccaaattttgaaaaacaaagaatggctgcaaagttaccattgggagccatctttaaaaaaagaaagatacctcaacagtcccagacttttaaatagactgagtatggcacttctgtgacaagacgtagcagctcgagaaatgccttactactaagaaagtaaaatgaaataagtaagttcaagctctataattccactttctattaaaatgtaagaacctcttagttttatgtggccttgaacgacctggtgtgtcatatcaggtactttcctgatagcatcttctatgaagggtggtaagagtcaaatccaatgctggatgcagaagtatgtgacccatccaagcatcgaggaccaggcacggggtgtgcaggtgcaccgtgggaggtacacaccacagtagcagaaaggcacgcaaagcctagatttgacagagatgatctttgcaactcagttttgccaggagtcaggcattacataaagagaaaatgtgagattttattcattagaggattgctcattgtctgtcaaaaagtaaacatttcctcaggttgggtcagagacatgtgtgccgagactaaataaaaccatttctgcatgcttcttgaaattatttctgcattaataaaaataaagctatttcttggaagtccaatgtaaactattattttctttgaactaatcatgtgccggagcacgtgatattgtgtgaatcttctcagcaatccttaaaatgtatgtttcgaataaacaaacatgccacagttttatcacagtgtttctcagagaataccttttttaatatgtacaagattctataacaggggcaaggaaaaaggtctatttgagaaaatatccattgtgtaaggttgggaggaagtgtaaggaaaaatgtttagcgattgaaatgggtaaaaaaaaataataacgggtattctgtaaacctttcatgggtctctgcttctgaagcagctggcacctttacttttttagttattttacaactctgtaaattgtggaaagctgagagtaatgcaaataattcttgtccatagaaatgtaaataactttgtcaggtggagtgagtacaattgatcatgccctgagtgtttgccagcattccccattgctacaagtcattggaatcattcgtaccatcttaatgttctcttcttaattaatgagtaaaattgtttacaagtattcctttcatatttttgagtaatgattttactttaaaagttatccttacaccggggatcatgcaggtatctatagcagattctatctgtcactcacatttaaccctgaatatttagaagagcagatttcagtttaatattttaaaacgaggcctaaaacacattcttttctcttttagcttcagacaagcttgactgaaccaatgacattatccaaatcaatatctcttcctcgcagcgcgtactggcatcacatcactcgtcagaacagcgttggtgaaatctacagtttgcaaggcaagtcactttaatgtaagaaagcagtgcctccataagcttcctccaggtggactgagtcatgcaaattgctttgtatttgcattgcttgcttttcctcccattcccatttatcagctgtcactggccacagtgggagctctgagatttacagtggctttttaaaagctatcatttcatatactcatggtaaaaaatatttcaaaaattactgtgagggctaaggaccccatttggcacgagaacttgactaaaacattataccaagcacattatcagaagctaaaagctaatgctgagatctgcttcatgctgttgttttatgaaggatttcttttttcgcatctttttttccttgaaaggattcaatatcagttcaggaggctgacttcaggctttaaggctctgccataaactggtatataaacctacccatgaaagtcttaaagtttagtcaaagccttaatacagaaaccattcggaaagggtgcagggtagaaggggccacatgtagatactttgcctttgtactttttctaatgataaacggtcaattagctagcataggaatagcttgccagatgaatcaaattaatagctagcagattttttttttttactaacagcagcaaacaacccagcttcagcagttgtcttcctgttccttcccttttgttttaaactgaataatcttacccttcaaataaaatatttgattggctacaagcaactgactaacagctagccaacactggaggaagcaagaaactagaaactaagaaaataaggctgaaacacacacagccaagagcatttactcatccaacaaacatttattgagcaccataggcttgaatgtaataagcatccaataaaatatctggggaaagtatgaccaagtatgaccctctggtagttagacattcagactgtgtttttctttcacacattagcttttgctcactattaacaatgctgtaagttttgacaaaaagaaatatttccgttgcaagcaaactgaagtaatgtgttttttatagcaatatttgcttgccagggtttccaaactagactaatggagttcgatcatggaaattaatggttaaagatatgttctacaaggcaaagcagttggaatggttttagtcaattactgaaggcaattacattttatattgtaaagggactctcttatggccaacctgactgcctgtatttaagagttattatctttgttatttgtatgataaaatatttaacagaataaggattagagggttaagaaaagtgaggagtggagactggtttggcaatttcaagaatcggaaagagaagacgagtatcttatgcttttatttccctgttcaaatgccagcagccacacactcaaattgcctgagtcatgatcatgcaaaattaaccttgcctatttctgggatgaaaaataatttgaaagtatgcttgtaatataagatttttatttaaacatatgtttaaatattgatattcacttgaaaacaaactataaaatgtttaaatgaaaaaaactatcagatttctaagcaataaaagtgagatattagtgctcttaatacaaaaaacgtgggaataggtcagaagtagtataataactctagtttttgtcaagggtttggcctataattccagaaaataaaaactcttgttttcatggtagtatgaaggaaacgttttctgaagacagagctaagatttagactgatacacaatttctgcaatggctttgcatctgataaaaattaaaatgcactggaatatcctaaaacattgccagagacttcttgaaggaagatgttgatttatatgttgtatagatataataactgattgaaatactctcactgatgttaacttgcagcaaagttaaaggcttgacatgccttttcaattacaatttacttaatctcagtatttcatgtttctctggttggttggtgatgattacagagtgaaaaatatgtattgactaaggtaattacttaagtcaaatatttataaaatgtattcaacggaagttacgtttcactatactgtgggtttactttttgtactgtgtgcttcttagagcaatacgttttaccaccctgtatacccctcagtgttatagatataaaaatttaagtatccagataaggggatagatggttgatagtaggcaggcatataatatagagatgaataaatagataaagttgttagttatactttgataatggtcacgtattttattcttccttcgttcggttgtgatagtcaaaacaagtagagagcaaggagcctcagtagtttttttactaggtgctagtccctaatggaatcagggtagaataaaactattgaaaataaggaagaaataaaaagagaaattcagaacctcagcacccttccacgaacacgtacgtttttcacaaaactacatttagaagcctagttatccactgagtgcggtggctcatccctgtaatcccagcactttgagagtttgatttttttttcccccagagcagaagcgagagtttattaaaaagctttagaacagcaagggaaagaaaagaaggaaagttcaccttgggagagagcaaagcaggcgccttgagaaaccaagagaaggaaagttcaccttgggagaaagcaaagcaggcgccctgagaaaccaagtgcgcagcttgacctcttgaattcgggttttatacttcgggttggcttacttccgggatcttgtattacttctccctactcctgaaatcttattgggaagctgctgatcagtttcaggtgttttctatctagtaggagcctgcctttcccgggggccggttgtgaccaattattactactcctgaaatcttattgggaagctgctgatcagtttcaggtgttttctatctagtaggagcctgcctttcccgggggctggctgtgaccaattattactactcctgaaatcttattgggaagctgctgatcagtttcaggtgttttctgtctagtaggagcctgcctttcccgggggccggttgtgaccaattattactactcctgaaatcttactgggaagctgctgatcagtttcaggtgttttctatctagtaggagcctgcctttcccgggggctggctgtgaccaattattactactcctgaaatcttattgggaagctgctgatcagtttcaggtgttttctgtctagtaggagcctgcctttcccgggggccggttgtgaccaattattactactcctgaaatcttactgggaagctgctgatcagtttcaggtgttttctatctattaagagcctgcctttccctggggccggctgcgaccaattattactactcctgaaatcttactgggaagctgctgatcagtttcaggtgttttctatctattaagaggctgcctttccctggggccggctgcgaccaattattactttaccaaaacagttaacaaccgcctgaccatcagctgattgttgcccaacactgctggtgtgtgttgggagtggggcttctctctcttgctctgctcatacatgactagctacctgctgtaacatttctcacctcaagagtccaggacctcaaatctttggatgaaggtctgtcatccaaaatggatgacttctgttttctgtaactgcttcctgctgacagaggggtggtcgtggtcgggtggatcttggctccttgctacccgtcagggctgagttggctgcatcagttggtgaaagtggtatccagccaagtccaagggagacaggggcaggatttcaccactgtcttgtcccactgatgggaagtgcagaggtcctctctagaagggtgactcttgaatattgagaggatggttttcctcactgaggattgtctggagctcaatggccactaggaaggtatctgagtcatgtggaccaaatatgttagcagtggcagatatccgagttacgcaagttaccggcagcgaatccatatgggtccacagcaacctcagtccttgtctcttcagaagaaagaattctactgaggggcataaggcagaaggagagacctaggcaagttgcaaagcagaagtgagcatgtattaaaaagctttagaacagtaaggaaaggaagaaaagaaaagaaggaaagttcaacttggaagagggccaagccggcaacttggcagaaggattgcttgagcccaggagttaagaccagtctgggcaatatagtgagactccatctctgcatgcatacatacatacatacatacatacatacatacatacatacatattgcagggtatgatggcacacgcctgtagtcctagctactctggaggttgagatgggagggtcactgagcctgggaagttgaggctgcagtgagccatgatcacaccactgcactgtagcctgggctaaacagtaagaccctgtcttaaaaaaatatttttttaaagtctagttattttgaatctcgctttttcagctgtgctccttgaagtggcattacctcttctttacaaaaaggagaatatcgtcagccaactgtcatcactgattttgccaaatcaaagtaaaagtctggcaatgtgggaatatatcattgtcaagtaaactgcaggtagcactgaggaatacaaatatatctttagaattttcaaatattttttaggtgaagctgagatcaatatgaattaaatttagcagactacattcagaaaacaaaagcagaaaactttcatatatttaaagtttaagagattaagattcattaataagcagcacatgtactcaaagttttttaaatgcatggcgtggtaacaaattcattctatagtaagacacctataacttcagttgtctgtcagcctcaaagctttgacttagctcagttttgctgtattcatttctctcatccattgctagatacacacgtaaagattgacatagcaggacagagatcctgcatctaccttcatctttggagaatgtctaatggtgattaaaagtcaaggtgagagccttaaagtaagaaaaagtcagtaatctgatttccttgttttttgttttctttttctttctttttaccctttcctgtgctcccctcctcaattggagaataagaatctccaatacaatctgcctcatctttccatgctacgcccagaagggtgctctcaaagaataagttaatgtgatttccccattgtattctagtagtctggaatcaaaagagtgaaaaagggaataattagcttctaacaagcacatgttgtacgaagtacttggcagccactgtttaaaaatctctgtccgtaagtggtttgtagcaggttgagttatgccacctcttcttgcagaagtggcaaacagacattacttttcttttttgccagagtatcataaggatagttgatttgtatttgaaagtaatttcttatttatacttctctaacttcctctgtgcttatgaaaaatgtttatatcacgctcatactagagatgttgtctctagactgagggaaacctaaaccgtaaagggatgaacatgattttaaactcgcaactctgaagtgaatacatactatttgttttaatattcatacaattgtatttccaaggcgttgggaaatgtagtagtaatgttttgaaagccctgaggaacaatcatttaaaaaagagaaagaaagaaatacagagaagttgaggaggggagcacaggaaagggtaaaaagaaagaaaaagaaaacaaaaaacaaggaaatcagattactgagtttttcttactttagggctctcaccttgacttttaatcaccattagacatatttagatgacaggctatacagcagggtttttaagtcaggatttgtgaagatgacaaaagcatttattgaaaatgacaaatcaaaccagtaaaagccattgacggtaccaggtgtactgcaggcactcagtaaagcctattgaattctaaagtgaattagcaatgcattataaagcatacatggagatatgtgacatcaggaccacatcctcctccatgagggtggacctgagaaaaattctcttctatatcaaggaatcatgtctagtcccacatgtgagccccatgctcttgcgcaaggtgaggtgtttgttggcatttctgctttttgctttaggatcattttgactgagcacagatacttgctactactagtctttattttcatgaacacaggaaggactgtgaaatgctagatctgcccctttaacatgatggctcaaaatccgtctctctacacctgctgccttctctccggttagttcacgttcttcttttataaactaatggtgagaacgagggccaagaatatgagctgaacacagtgcccaatgagcaggtttatgggactgcacgtgatgactaaactttctctgatgtatgatgatatggtctggctctgtgtccccacccaaatctcatcttgaattgtaatctgaattgtaatccccacatgttgggggagggacctcatgggcggtcattaggtaacgggggcagttcctccatgctctccttgtgatagtgagtgagttctcatgagatctgatggtttcataaggagctttttccccttcatgctccaattctctctcctgccaccacgtgaagaaggatgtgtttgcttccccttccgccgggattgtaagtttcctgaggccttcccagccatgcagaactgtgagccaattaaacctcttttctttataaattactcagtttcaggtgtttcataatagcagcttgagaacagactaatacatatgataatcccttattttcacacaaaataacgtggaatatactttgactccttttttttaaacagcttgaacaactacactctttgaatcaagaatgattgtatataccatttgtaaaggtcgtagctttaggagttctgctttcagtaacactgattaatatccacaggccagctttgcctctgtatatctgtaattaagctacagaccaccaatgtcagcacggacacatacctaatcaccagaaggcatttgacgctcacggaaagggtgtctgtggcttcattttctcagaaggacaggatggaaataggcaattagaattagagataaccttcagaaaatggtaaatagagttctgccatagattaaggaggtaaatcaaagactttgtttcctctttgctcagcaatgaccttctgtccttctctactgtccaaactgcattgtatataaattgcttctattgagattttctattttgtttttcaagttcaaagctaataaaagcctctgatagccaattttaaaaaatatagaaatttgcaacagaagtaaaatgaagcctgatagccatttggcaacagccattaaaacatgagccactttctagaagcaacacttctgtctattaaaccttatttataaacatttattgtatgcccataccttaagaaaggtatgtcaaaggcaggaaatgtatccctggatgtcaatttttagagataaatgaattggttattccctaaagcagacatcataaaaatgcacaaaacattcccactgtgaaatgatcctcacatcctgcagtcttaattaatcacctgcttttccgtgctcccatagacatttgtgtttaactttattaaatgaatgtgtttatttacaaacctgcttattccactggattatgaggcagtaattttgtgaaagattttatcaaacaaattttggggctcaattatcttgaagatgttacccctagaggttaaaatcttgagttctggagtcaaatataccggagtttgaatattaactttaccactactgactgatgtgatttttgggcaatttactcaacctttctaagcttattgcttgatatctaaaagaagatagtattatctcccatgatctcattaaaagagatcatcaacataagatgtcaatattcaataattattaactattattaatatattaaagtacagttgacccttgaacaacatgggggttgaggtgcctaccccacccctgcacagctaaaaccagtgtatacaatagcaaagacatgaaatcaacctaggcgcccatcaacagtggattggatcaagaaattgtggtacatatacaccatggaatactacccagccataaaaaagaatgaaatcaggtcctttgtagcaacatggatgtagctggaggctattagcctaagcaaattgaacagaaaaccaaataccgcacattctcactcataagtgggagctaaacattggttacacatggacataagtatggccatagtagacactgaagaaggaggagggcaagggttgaaaactaactattgggtactatgctcaccacccgggtgatgggatcagtcgtaaccataacctcagcatcatgcagtatacccagctaacaaccctgcacatgtacccactgaatctaaaagaaaagtcgaaattgtttatttaaaaaagaaaatcaatgtacaacttttgacacccccaaacttaactactagtagtctgctgttgaccagaaacctttccaataatataaataatcaattaatgcatatttgggtttacacgtattatatactgtattcttacaataaagaagtaagctagagaaaagaaaatgttattaagaaaatcataaagaggagaatatatatttagtattcattaagtggaggtagatcattaaattgagtaggttgaggaggaggaggaagaggagaggctggtcttgctgtctcaggagtggcagagatggaagaaaatccacacataaatgaacccatgcggtccatactgtgttgtttaagagtctgctgtaaaccaaactctcactatgacgtttcttttttctggcagaggcagataggctgtcctactcctatttattccagtgttgacttggaaatattattacagagttcttactgtgcttggggaaatttgtttggttctaaggactatgaaaatctggctttaggccaggtgtggtggctcactcctgtaattcccacactttgggaggctgaggcaggcagatcacttgaggcctagagttcgagaccagcctggccaacatggcaaaaccctgtctctactaaaaataccaaaaaaaaattagccaggcatggtggctcacacctgtaattccagctactcaggaggctgaggcacaagaatagtttgaacccgggaggcggaggttgcagtgagccaagattgcaccactgcactccagcctgggcgacagagtgagaaagtctatctcaaaagaaaaaaaaaatctagctttaataaatggtttctagtttttaaggttttagaaaaactaaatctaagcttaactctcactctaagtttttaatacaaggaaaaaaaattcagtctgaagtcttcatttaagttttttcttctcatcagtgagtataaacaagacatggcaccttaaacagataaaccacctctcccatgccttatattgctcagtccaggtagcctaaggcaaactatagcctcttttccaacccaaggtttgcagaactcatggaaggactgtgtttagctcagcccagtgcagaggagaatgcccccacccaaacatactcatccacacccaccctaccacttaccctcccaccccaaatcagttcttactaattagcttaccctaactgcccagaagcctttcagagacctttcttcctccatgaggccccagcctctttcctaatgtggactagctttctcgagccagttaatactacactgattctctctcacagtgcattctactggctggactagaggcgagcaacaagatttacattactaattgaattcttctgcatcacccaaattaaaatccgaagaggactcacagtgcaaaatataccaaatcagccatttaatcactttttaccagatatgtacaagtaattactaaaagataaaagatgaagagtttccagatgttacactggattagtataatccaccaatggttttattaaaatgaattgcttcactctctttaattcaaatttggtggaaattaaaatctctgttcagtctctatatttttctccatcaagcttcccctactgaattttttaaataaaagaagtaacatactgagttctctattaatcaaattttgtggggaatatatattaaaggcatgtcaaataaattatacatatatattcgattttattcagaagggaataaacagtacataatattagttcagggaaatgtcaatacaaccagattaattaatacagacaaatgttaatacagacagattttaacacaaatggatgctcaactgtctttgtcatgtatatgtatatacacacacaaacacatatatacacagagaaagagaggagcatctggttcaccatatatggcttctcatatacttccctcaaacatgtatgtattaggctaagcttcacaaattgtaaactacaaagaagaacctagagggaaaaatgttcaattaccttttttctccttggtctctatttcttgtttgatttttcttaatctcatctctgtctctggcccttcaactaaatgttccccatccctaattataggttcaatacatgtattttgaacaagttttcctttattttcctctgcgggccaagcagaatacggcagagacttgataatgattgaaagataataaaagatgagaaacatcaggaaattaacatccttaaaattacacttgccagagaataaactgcagagttgatgttgatttaagcctggatatgtccttcacatctagcacagtggtgggcaggtgtgaagaacctctttgaaagttctagcacctgccagctgtccaacaattaatagacactaactggaaatttgttgcttcgaacttcgaaccacccaatattttgaaactcaggagcatggttatatgtttatataagaggaatttatgctaagatttgaagggtgtgcgtgtgtgtgtgtgtgtgtgtgtgtgtgttgaatgcctgtatttaattcaggaagaagaatgtagtttgggagtgctcttagaaatttttggttgccattgctatattatgttggtttggtaagaagtttaaaacttttgtgttattttttgttttactattcataatattagaaagaggagtttgatatgaaactctcagtgacatagtatgtcatttatatatatgattaatgataaacattatcaatgtcttttacatatatgtaaaattattttagtacaaaatttcttactgacaattacaactctaagacaaaagctgcacttagttttttattcatcaggaaagttcattcttccagataaacatggaaagtttcctctctagtgtatatttgaagaatagccattgtctgtggctctatcatttccagtttaggattctgtatgtgctcaaaaaagatgttgtctaagaaacatcctgtgcttgtatctgtaactctaatatgatgagttgaaacttttctttgagattgatttaccatttataaatttctttttaaaatattttaaaaattgtccaaacttctgatagtataatttagcattgttcttacatttaccaaaaacccacattttgtgcaaaaacaacaacataaaaagcaaattatagagcataatcagttttactgtttgaggatatctctacattaatgtcccagcttctttagaggcatgtctaataaactgctgtatataaaattaaaaatcccaataattaatttcctaatctactacttatttcctggatctcagcactgaattcatccttctgaaagcagtgagacactaagagtcaggaagccagagatctcaccccagttcagaatttaacagccattcaatgttcatttaacttttccaatcggtaagtgggtgggagtgaaccacttaccagatttcaaacagattgcatggtctgaatagcaagagaggaggtgtaacatgtttgaaaatttttgtaggaagaagaagggtattttattgagcaaccttctatgaacaagatattatgctaggtgttatcacaaatataatttcatgtaaaccacaaaaacccctgaaagggtagatcgttaggagtggcgtttttataaatggagagaggtggtgtcattttcagcttggctgatatttactcagcacttgacagtttcatgatatttaatcttcccaacaactctccaaggtaggggctattattgtccccattttacaaataagaaaaccgtggcacacaaagataaaataacttgccaaaggacacagagtgggattatcaacgcaggcagtcttgatttgctagctagattgtcacttggataggaaagttacataactaccttgaggcaacagagtttaagcagagagaaagaaaacatgtataatctctacccttctgcccaaggacattctctttgaactataatcaaggtttacaagaatgattcttctgaaaagcaagcaacagctcttctcaaatgtgctttaaatgagacaacccagatggaagccatctaagcaatttgtgtaaagtccgtggtgtccaaagatgacttgtatacagtttggtcactgcttttaaaaatctcgtataacagccttgctctttttgtggaacaatttaaagcacaccgtatatgtaaattaatgggtttaactcgtgagggttgccattacttttcattattgcttttccagctttttaactaagctttatagcacattcaaatgtgttcctccctcatttcaacttctttagaagtgtcttattttggagatttcagaatcacttttcctgttgcaaaccccttctatttcttacactttccactctcctaaatatttccttttcttttctttaggcattaatgctgacatatggagcctccctgttgttattccctgttgttagttcatatgacttccataacaaaagtgtaaatgtcttcttagacaagctttatttcccttaaacaatttctgtaccttccattgaaaagtaactttttaagtgaaggcagtatgatatctgaaaatctgatggaattccaaggtataaatacattaagtttaactgaaattaatagtcaaatttataaattgcaaaataaatatagcctagttgagaaaactcaagacatgaagaaatatgtgaataaaaaggtaaaaatcatcactaccatatattaacatttttaaatatgggtataaatacatagataaaagtataggtcaagataaaattcatatatgtatttataaaattaagatcatactacatatgcacttacttgctatgtttttgtattctggtagaattgaaacaaagtctaagtggcaattaagggctgcataatattctactgcaaactctagtttatttaaccattgctctattgtttagcatgctgtaccttatcctttgctttttactattataaacaatgtttcagtaagcacatgtgtatataatactttatacattatacatattatatgtgtataatgtttataataacatttctaggagtggaattgattttttttcaatcagaatttatggggctgtgtcagatcctggggatgtatctcatttacagagcgcaaaatcactgtggtcaccatctctatgtacattagcatcttattttttaaaaaggcacatagctaactacagcagatttattaatttgttcatttatttatccatttaccacctatgcattgaattgctttatgtcctatttctagatagctgaagacagagagatgaagaaaagaaattaggtattttccatgaaagtaaataccaaaaaaattaagtgaagaaaataatatatgggataatttcagaccttgatgaatgttataaagaaaatacatcaaaatgatgacaaagataaaggaacacttaggaataaatttaaggatatgaaagattggtacactgaaaacatagaacattctaggcaacacactgagacctcagtaaaaaaaaaaaaaaaaaaatggcttttaggtgaacacctttagtcccagatactcgggaggctgaggtggaggatcacatgagcactggagttccatactacaatgagctatgattgtgccattgcactcgagtctgggtgacagaatgagactccatctctaaaaaataaataaataaaacaaatattgaggaaagaaagtaaaatagatacaaataagtggaaagacatcttgtattcacgagttgaaagagttaatattgttaacatgtctatactactctaaagcatccatagagtcaatgcaatccccaaaaaaatcccaaggtatttttcacaggaatggaaacaattagcaaattcatgtatcaccacaaaagacctcaaatagcctcaacaatcttgagaaagaacagagctaaaaggatcacactcactgatttcaaagtatattacaaagctccaataattaaagcaatatgcttaaaacaataaaacataaagttagacatatagagtaatggaacataatagcccagaaacaaatcgcaacattataaagccaactgatcttcagcaagagtgccaaaaatacacaatggggaaaggatagtctcttgctgggaaaactggatatccacatgcaaaagaatgaaattggacccctatcttacaccatgcacaaaagtcaactcaaaatggtttaaagacaaaggttaaggcctgaaaccataaaactcctagaaggataagcttcaggcagtggttctggcaatggtttcatgaatctgacaccaaaagcacaggtaacaaaagcataagtaggtaagtggcattatatcaaactaaaaatcaactgcacagtaaagaaaacaataaacagaggaagcagtcaacctgtggaatggaagaaaatatttgcaaactgtatatctgataaggaactaatttctaaaatacataaggaactcctacaactcaatagcaaaaaacacctacactaatttaatttttaaaacagcaaaggacttgaacaaacatttctccaaagatatacaaatggccaataagtacatgaaaagatactcagcatcactgatcagcagggaaatgcaaatcaaaatcacaatgagacataccttcacacttgctaggatggctaattatctaaaaaacaaaaaacaaagtattgatgaggatatggagaaactggaactcttgtacaccattgatgggaatgcaaaatggtacagctgccatggaaaacagtatgaagattcccaaaacaattaaaaatagaaatacataaaatccacagctccacctacgggtatttatcaaaaaaaatatgaaagtaggatctcgaagcgatattagcactttcatgttcattgcagtagtattcacaatagccaagatatggaaacaaatgtttgttgatggattaatgaagaaggaaaatgtggtataaacatacaattgaatattattcagcctcaaaaaagatagaaatcctgccatatgctacatcatggatgagccttgaggatgttatgctaagtaaaatatgccattcacagaaggacaaatattacataattcaatttatgtggagtatatgaaatggtcaaattcacagaagcagggaacagaatgtgcttaccaggagctggaagagggagaaatgaggagttgctgtgcaacaggtataaagtttcagttatgcaagatgcacacattttacagatctgtgcttagttaacagtactgtgttgtacacttaaaaatgtgttaagactcttggtgggaatgtaaactaatacaaccactatggaaaacagtctggagactccttaaagaaccaaaaatagaataccatttgatccagcaatcctaccattgggtacctacccagaggaaaagaagtcattatacaaaaaaaagatacttgcacatgtatgtttatagcagcacaatttataattgaatgtggaactaacacaaatgcccatcagtcaatgagtggataaagaatttgtgagatatatatatatagatatatatatatgagatagatttatatagatatatatatgagatagatttatatagatatatatatgagatatatatatatatatatatataatgtaatactactcagtcataaaaaggaatgaattagtggcatttgcagcaacccggataagattggagactattattctaagtgaagtgactcaggaatggaaaaccaaacatcatatgttctcactcataagcgggagctaagctatgaggatgcaaaggcctaagaatgacacaatggactttggggactcaggggaaaagggcgggaagggggtgagggataaaggactacaaattgggttcagtgtatactgctcaggtgatgtgtgcatcaaaatctcacaaatcaccactaaaaaacttactcatgtaaccaaacactcattccccaataacctacggaaataaaatttttttaaaacatgtgttaagagggtagatctcatgttaagtgttcttaccacagttaaattaatttaacattaaaaactgaattgtgaaagtggtaacttagtcacaagtgcagagaaaatgagagagttgtaggataggaggaaatcattcagcgtgcaacagagagatgttaaggagatgggaaatataaaatatctttagacatacagaatagagtatgaatattgaacacagatttaataatcattcctaaaggagatgatacagcaaatggggatgaggtaaatatacaataactggtaattctacagactagacaaatggtatgacttgtcagattgaagaagtacattgagttccagcatgaaaaaaataaaaagcaattcatactttgaaacacgagggtaaaattgcccaattctaaatgcaaaaggaagttttaaaatcagagagataagacagataacccacaaaagaacagcaaaccagattgacatcagatatctcaatagcaacgagatagaacaggaagtgatgaaatgaaatccctcgttggccaagaattttataaccattcaagaaatgaggccagatgcaataaaagccagaaaataatgaaaaccatcttcaaataactaaaaactctatcaccaactgaaatatgcaagaataaatactaaattgattcatctttggaaaatgctgagtttaccaaacaaaaattccctaaagaaaataaataatggatgtacgtaatggaaaataaatttgaactcacaaagaagaactggagtacaagaagtaaagatactgttaaacgtgaccaaacctaatatacattaactttaataacagtgatggtaataaagagtaagttttagatgtttaaaagaaaggtagaattaaaatagttgatagcagtaacaagaaatggaaggtaataaaaagagaagtatggatacgtttatattttacatttgattttactttttggtcaagtgggcacattaagtaaactactaaaagattataaatacatctaaacaagtaaataggagaaaaggggaaatttttaaattaatgtaattagaagtagagaaaatatagaaagaaaaaagagtaaataaatattataacagacactataaaataagagagagagaaaatataaatatgtagaatcaaaagaaacaaaaatgattacatttgcctgttataaaagagaaggaagaaaaccttagattgagttttaaaagcccaactttgtgcgtttctaacagaaaacatctaaagtttaagatacaggaatgttgaaagtaaactgaaggcaaggcaaaacacaaagttttgggaaaagagggtcattacatgttatcattagaaaaaaatgattcatcagcaagatgcaatatatctgaactcttgataaaatattcccttgagtgtattttaagtttgtacacacacaaaaatggacacaattattagatggaacctattgaaactgccataattgtaggtcagtactgttaaataacaaccatttcatgtgattcaaccaaaaaaattgaaaacatgacaattataatgagacttttaaaaaggtacatcttataaatattagactgcatgaaaaaagtttctaaggaaatagaaaattaaacagcataaaacaagcttaagcaaaaacaaaaatcagagactatacattgcttttaaacattcttggaacattaacaaaatttgacaacataagatgccacaaacacatcttaacgtgtataaaataatcaagagcctatagaacatgggctcatgttttcagatcataatgcaatacaaataaaagccaaaaagcctatacttttaaaattaagaacacgtctgtaagatctttaataaaagacaacacaataagggaacttattacatattggaactacacgataatgaaaacactacatcaaaatttatgagatgtggctaagttggtagagaaaattttatagacttacatacacgtatttagaagaaaatagggatggaaaattaatcagctaagcactcaaccttgtaggttagatgaggacaatacaaaaataggataaaatcaactaatctcagaaacatcaatactaaagacatcatcacaacctaattgtatacagtccagaaagtaaggctactttaacaataaaatatcaataaatgattttatgttaggaaatggaagctaaaattctgagatgatctctataggtacagaaaaatatttgataaaattcagtattcatcaagaggtatcaatatattctaaagaaatgtaggcatgtgaaatctgtattagacatgacatcagtttgcttcacttctactttaattatcatagttctttaaaaagactgcatgttctcactcaggtgggaattgaacaatgagaacacacggacacaggaaggggaacatcacactctggggactgttgttgggtggggggagggatagcattaggaggtatacctaatgctaaatgacgagttaatgggtgcagcacaccagcatggcacatgtatacgtatataactaacctgcacattgtgcacatgtaccctaaaacttaaagtataataaaaaaaaaaaagacaggataaaaaagtaaaactaactttttcaaagcctcagtattccatcacttacatatcaatttttttgtaaacaaattttccttaagataattattttcattaatattaagaaaaatgtcttactgtattaatggagatttctttaaataaattattcttaaagtttcagatttgtttaatagaaataaaattttgatgaattatattagaggtatgatattctcagtaagtcctattatttatgctaaaaataccctttgggtttatacataaagtgcttagcaaagcagtttttcactttcacttgtaactccttaacaatgttcctgacatcaccaccaacctctcttttatccaggcctgcaaaatgacagccatccttagtttttttcttaccccagcaattgactcagttctattaatacacattaacagacctatcacaaaggactacccagtttggccagagagttctgagatgatatatttaattcaaaatggcctccttcccaatctcccacctcttctctctcctcagcccctacacttcacaacaagtattaggtctagacaggactgtccccttcactgacaaaaaaaaaaaaaaaagcagaaaggattcaacatgatatctgtttgtggatgataaaaaaaatttttaaagagaaaatcaacaaagggaaacatgaagaagaaacaaaatttaaaaaatatttatctgtacatccaggaaatcatgaaaatcggcactccgatttaacaggaaagagttgcaagaaatccgagaacaggtaagacaatgggaaggatataaagcagactaaagtgctcatcaaagtaaattgaaaataatgataaatgcttcacacaaataaaacaatttttataagcacttagaaatccaataactgtagctgaaaagagactatagtagcttcagaaaataataggcattaataaagtaacaaagaaagaaattcagtcagagagacggaaaatacatgggtatgcgcacaagtcaaataatggaattgaacatacaggttttcctgaaatagagaataaatacaagatgtatataaagtctttcctgaaataaaggaagacctatggcttaactcaggtcctcctagaagcagatgccgagatgggttgagatgcacgagagttagccagttaggggtcaccagatatttgaggaaagtatgaaacaaaaaacagaggccatagcaaataaaattgcgtcaaaaggaacctcgaagagaccgaggcagtgcagaaagcagaataaaaccatgcacacaagcaggcttacaaacaaggcaataaacacttcactcagaagttaactcagatgtttgagaaaaacagacatgaaaccactgtaaactacatggctggcttataaatcataattggattggtgatactaatgcaaatgctaaatactgcttttgaaatgtacttattctgagcatgaaaggagggaaggtgtgtgtgaggaaggaaaggagtggttcagaccactaaatcatcatattccatagtaggaagaaaatctataacatctaaaaatgaaaaatcaaaacccagcttttaaaaccattttcatttaagaatatgaaggtcaatatctgaagagatagcctaaaggattgtgactgctaacttctgaaaatatagcatagtactgccattgttagtatgtttcccttgtttgtttttagacatggaactttaaactccagccccctaatgagtggaatggggatggaaggagcagagtggttagaagaattttaccggctcacttctgctctatttgaatcttttacaaaaatcaagttatcatttgtaatttagaaaatgattttaatatacaaaatacaaaaaaagcattagatgcttattgccatcaagataatttctagatttttcttgatatttacggtgcttcatattctgacctcatcttcgtgctgttgaaagggctctttccagcactgtctccctcaataaatctgttgcccaggacttaactgtcccaaatggtcatgtactttcccatttttaccctccttttataccattgctttcactcaatgcctttttcacaatccctacttgtgatgtggctaaacgtacttagatgtccggataacagtggattaattttaccctactgcatatatgtccctgcacgctcactagatatcaaagcagagactatctccacctcctccagtacctactgagcatagtgccctacacagctttatggcacacacacagtctacacacacacacacacacacacacaaacagtatgtttctggcaagaaatgtcagtgttgttatgcttgctatttattaaattcttgtaattatgttgacttgtaatagaaattgtaaatagagagaatatgtatcccaagttactactcttttgatttgtaaggaaaaaaataaaaaatattatgagtgcttaaaagataatttagctgtaacaataggagaggtctctctgccccgtgtgtgtgtgtgtgtgtgtgtgtgtgtgtgcatgtgtgtgtatttgtgtgttcttaatctgccactgtatcatagtccattcaacttcatatgcaggggacttgtaattggtcttcttgacagaagatactattgatcatgcaacacctctgatgcccttcaaacctggacttacccttttctatcctgtgaataaatatttgccatatttttcatgttttcacagtttcatgaaaaaaataactcaaattcaatcatagtatcctatttattgtgttattactggaaaaagaaaatattttatttagaattgtacaaataactataattatataaataatagagcatgaaaatatggtcctaccttcacatttgagaaaacaaaaatttctgaaaatataattgtttaaaatattctaaaatacaaaagaataaaagcattagatactcactgccatcaagataatttcggatttttcttcgtatttttggtgcttcttattctgacctcatttttgtgctgttgaaaaggctctttccagcattgtcaccctcagtaaatctgatgcccaggatttacctgccccaaatagccatatattttcctatttgaaacattggctaggcacggtggctcatgcctgtaatcccagcactttgggaggttgaggtgggaagatcacttgaggtcaggagttcaagaccagcctggccaacatggtgaaaccctgtctctactgaaaatacaaaaattagccgtgcatggtgatgtgtgcctgtagtcccagctactctggatgctgaggcaggagagtcacttgaacccaggagatggaggttgtagtgagcagagattgtgccactgcactccagcctgggcaacagaccaagactccgtctcagaaaccaaacaaacaaaaagaaacattgaaacattgaacattatgtttcagtaatatagtatataaagctttcatggacacaatctctctttctatacggaatacaacattaaacaatcaattatcttctgctatgtatgcgagtatattcattattcaattgaaaccttggtattggcaagttacaaaactgagctgagattttaagtgaaaatcatgtgaccatgttatatgtgtctgaaggtacacaggatgaagaaagctctgtgtttccgttctctttgtttttcaatggacaccaagatgtggatatttatgggctgtctatggtagagccatgtgtagtagctatgggatttcttagtttagcctgtagatctccaccgatttctctgttcactggatgacagacggccatttgtcagaaatattatggtgcacactgtgtctttgcaatccccacaaacaatttcagctaccaagagaaaacactctgaaaatagattccaaaattcaactgctcatctgcttgtctccctttaaatttttcagaggaaactgtcagaagacagttttttctagacttcatctgcactcttaaagaggatttttttctatagtgctataaaaataagaaggttttgccaaaggaagagtgaagattgtctagttggtaagcctgactgatgttttctcccatgacattcctagatttcttgaagaaaatgcacccttggttatgtatggcatcactcaccatctgttcatggatacttctacatgcaaagttgtacatgacttggaataaaccagctctagttttatcatcagtgttaattgtaaatacattatctgtaatcagaaataaatgttagtgataccatgatttatttatgacatgacttaccacctaaacgtatgaatatgccaagtaagtgaaattatagtgggtaaagcttatgaaaagtactctattactaaccgtttctgcatggaaatttgtatattctaggagtaattgtctcagctacagatggaaaagctaggtttcaaagtagatttaaaatagtgttatgcaggattatataatattcgttattttaattaacattttcatatattgaaatcatttaccattttatgcaaatgacatcatttggaagtttaatttctaaaattgtgaagtttttcctgttaaataaaaatttatcagggtaaaagtgatcttttcatccagatgactaccttgacttcatatttacctttgaaagaaaactttgttatggttataaacaagtaaaattatatattttctagcaaaagagagatttcattaaagaaaaataattacttctggaattgggcagtttataattcacatttgtaatatagaattagcttagggcaactaagaaataagaatgaaaaatatagcagttctattacagcccatggttaataaaataattactgtgaaaaaaatggaaagattataggaagattagctatagagactacagaaagagtggatgttttgaaaagtaagttccttttttttctgtcagtgaccagagttttttaaatccagaactaactggaaattttatgtgttctaagatttttttttttttttttttgagatggtgtctcgctctgtcacccaggctggagtgcagcggcgagatctcagctcactgcaagctccacctcccaggttcacgccattctcctccctcagcctcctgagtagctgggactacaggcacctgccaccatgcccggctaattttttatatttttagtagagactgggtttcactgtgttagccaggatggtctcgatctcctgacctcgtgatccccccgcctcggcctcccaaagtgctgggattacaggcgtgagccaccgcactcggccgtgttctaagatcttctaaagcttcatgcatcttcctgaagaaactatcttagaagttagttccacaaagacaatagaacaagttgtgtttcattaaactcttgcaagacaggtgcagtggctcacacctgtaatcccagcactttgggaggctgaggcaggagaatcgcttgaacccaggaagtggaggttgcagtgagctgagatcgcaccactgcactccagcctgggcaacagagcgagactccgtctcaaaaaataaaaattaaaaacttgcaagaaaattcctattttaaaaacatatcaaaacaggtcacatgtgatttaaaacacaagcttgctattcactcctactatcctccctgaagtgtgacccatcctctttttccctctctgtgggttccagattctcatttcagtagccagcatgtgtgtgccctgtagcccacgaactttggaagaaattgacagcaactcaattccaggtgtggccacactggtgagcttagttggtatatttcgtttgcttgatcagagccattgattcagggatagacatgacccaggcaatgaaagagacttgcatctcagccttttgttcaaaagtactctcacccaccaggcttacctgagagagcagacagctcctactgtggctgtggccaacctctttccaaaggagtggccacacgacagcgaagccaacactagcactgtgcatccagtacaataaccattgccacacatggctgttgaacacttgagatatgattagtccgaattgagatatactataagagagatacacacaccagatgtgaagatttagcatgaaataaatgtatctcataatttttatattgattacatgttgaactgataatattttggatacattgggttaaaagatgttaccaaaattaattccacctcttcctttttggatttttaatgtagctactagtaaatttaacgttacattggtgttttatatactacgtgcattgggcagcattgttctggtatgatccaggtgctgatggcattcttgagtggccagatcaaccaattgtgagttccacatgacctctggattttctagagacaattcaagatatttctttattttctaaaatcactttggatttgtatttttaattatttataattaaaaacatccaaatcaacgctctggttttatatttaagcacttgatttatctgtacagttatttgaaaaatatgaaggcctatactcaatttttctttaaaattcttataattttcaatgaatatcatttaatttttcaaaaagtataaaattttagtgcattcatgtttctaaatttatatttaaaatactaaatgttccgcaagtgatatttaacgattttctgcccttggctgggcgtggtggtttatgcctgtaatcccagcactttgggaggcagaggcgtgttgatcacttcagcccatgagtttcgaaccaacctgggtaaaccccatctctaccaaaaaatacaaaaaattagccaagtgtggcagcatgcacctgtagtctcagctactcgggaagctgagtggtgggaggatcacttaagcccagtagaggccacagtgaattgtcattatgccactgcacttcagcctgggtgacagagcaagattctgcctcaaaaaaaataaaataataaaaattttccacccttttgttaatatcattaccatcataacggattacaagttaatttttgatataaaaatgataaatgtatgtgggcataataatatttgtattctaaagtaacaatcccataattcttaggcaggaaatatggacttatctttaattaaattgttagccttgccctagacaaaacatcatggttttatatggagtttttatatataaataaattattctcataatattacagtatcaaaagagcacactttattttataatttaatataaaaatataaaatgtaatataaaatattatgatgcacttgtaatttattattgcaagtaaaattgtgattaatttctttaaaaattgcataagattaagtgaaaatggctatccgtcatcactttatgttggattacattttattccatccaaaaaaattcattagtttaatttaattcctaagatattcctaagcacttatcaaatatggcaatgtagttattccatagggagaaaaaaatctatttccacaagatagataattcttgtttttatataagattttcacactgtgtttttcaaaagttaatgagagattcatcagattttccattttcttggtcatggatcattaaccttatagaaatgcaggtaaaattgactttactatgttttttatcattataaatctcaaagtcatagagactgtttgtcacccatgctggtgctgaaaatgcagttcataacctgattccataaacactacggcaacactttagactgagaagcataatctcatgctatatgctataattaaagtacactcagtgtccttttgatgggatggcaaatgacggtctgtgatgacttgcttttcccattattgctgtcatataggacacataattcagcaaatgcttccatttctcagaacttttatgtgtgtaatgacagcccaacatcagcaatgttctgttaatatagtaaagaagataagattgcctgtttggagctggacactaaacagattatttggatgatgtcttactgagcatcttattcatcaaatctagaatttaattctaagatgtaggtttgcaattacgcatttggttcagcaaaacatttttatatactgggtcttgaaattctgttcgtcctgttttgcccagacatctgtaattatgtcctcaaactatataactatggtggtctccgtttcaattctaataaaaacctatgaccctcgttctgcagccaaggccatggtggtttaacaataaaaagggatattaacatgaaaaatatcgaagagcatcaagacattaaatcaaggcaggttttttttcccctaaattgtaccagttattgggaatcttcttttaggaatagattttccattagttcatgggtatgcagatctagaaacctcaagaattctttttgttccgttgccagatttgaaactcagtcactgcctttttatctcaatgtgctttgttgccatatttctgatgtttctttcctcattcctgacattacgttgtccattatattattcatttctcagttgcttcctttcttatgatttatgctataagttaccataatactttgtggaaagtcttggtatatagttattaaatgtgaatgctaatcaaatatgattaaaatgctcttctagctctctttgttagaaaggtaatgctctctcagagttagaccttcaaattaagtcatacgtactcagctagtcttaatgccattaaaatatcttcaggattatagaattggggaagttatactaagtaaaagacttttgcatatttggtttgtttatcaattgtgctttcctgttgtatgcgtttgatatttaaaatgctcttatgaggaaggggaaaaaacacctatatttatttcttaatggtttccacatgcttgaaaaaataaatcaaaacttgacatggagaccatctaaaaattcattgacttacgcttaatataaaatctgaggcctatattctcagaaaacaaccaaagcacatgataataatctagcaaaaaaatcctatatttgatttttgaaatatgtgttgatcttaaaaattatattttgatacaagcatatttcatatgttagactgcttccctttattttacaagtctgagctttcaatgaatgagtcacttgtggcttaacctaattcctattctgaacataatctttaatataaagagtcagccttatggaaaaaagagattgatgtagagttgaaataacggtaatgttatatcacagaaagtgttgggggaaatttgagtggtgagatcaattaattttcctcagaacttaaacacaagagaatcttgcacaatgaagtgttatttcctactagtagcaagtgttcattttctggctttgacatacaatgtatagtttcaaaaatactcagaagttagtgccttagcacaaagcttgcaacagttgcaaaaggcacctaaggaacattttgcactgtgatcagtaaaacactgagacatgcacaataattaaatacagtaaactttgacattttgcagacattttgttatataaaattcatacatatgggtacattatgttgaaccacgtgattcctaattttgtaggtcaaaagtgattaagtaccagcaatttcagattgtttgacctaattcaaaaatgcacagatcccaagtgtacaatctgatggccgggcttggtggctcacgcctgtaatcccagcactttgggtggttgaggcaggcagatcacttgaggtcaggagtttgagaccagcctggccaacatggtgaaaacccatctctatcaaaaatacaaaaattagccaggcgtggtggtgcatgcctgtaaacccagctagttgggaggctgaggcaggagaatcgcttgaacctgggaggcagaggttgcagtgaactgagatcacgccactgcattccaggctgggcaacagagtgagacttggtctcaaaaaacaagacaaaacaaaacaaaacttgatgaattttctcatactgaaaatatttttataactagcatcaagatccaatatactttttttggtcataattatgtgtctttgtcaaaataggacaatataacatatttccttttacagtgtgttaactttatttgtaacatacgtatttagacaggtggcatgtccattcagattctcaccttgggtccacctctctgacagtggaagagaaaatggaatcaatacattataaggaagaatcatgaaagtcattttatttgtttttcttctgtcaagggtcacagtcttgtgctgcctgttgtccagtgtgtgaaatcaattgttttatatgttgatacagtttttttaattgtttacaaccaaaagggaaagccagctcattcctagatattccattatgaccagaaacagaaatctagggcacgctgctaaacaacctcaaagttaaaagtggttctagtatgatacagtacctgttttcaaactttttagctaagacagatacatgaagggaaggaatatgtgcttctctagagcctgggagaagacccaaatgagttccgaaaaagacaaactatctttattgtcatacttaaaaggttgcaattaatctgctttctcctccatgctctacctttagactaaatatatatgcactttagactaaatatattcagcctcggcaattagcttacttttgagggtgtccatacccaacaggtgctaccacttataagtgtatttctgcagaagttgctgagtcaccagcagctctaagatattatgaaatcctccagtgcccttctggagccacttgggggacaagggttttaaatggtagagaactcttgcgtggaatcctcaagtctccaaacatctgtactttgtctagaagtcaactcccaagtgcctaaaggattattaaataaccaggggtaatctaggtctcttctggattaaactcagtgccctaaagttctcctcacaaagcaggatacacacccaacaaggtactagaactggcacgttactagttgtgtgtgttaatgtctttaggaatctagaaatctcctaagtcatcttctcactcacttaaacaattgtgtagttcacaaacacggagggatgactaacttcctgaagaatgcagccacaatttgtaagcataaatgggctctttgtaatgagaagaaattagagggttctgttccatttttattatgcagaatggaagttttcaatgatatgtaacacataaaaattaaggagtaggtggagattccaacattaaggtaatgttaagcatatgatctatttaaacttggcacttaacgaacagagagtaaagctatccaaggcgtcctaactgatcatttggaagactggcaaaagtgttcggcataaaacaatatgcattagtgtaatcagaatgtgtaaattgtaatcataatgcctcttaaatgtacccatgtcagtaacagaatcgctgccaggtaatgaagacagactacttggtgagaaagagctatctcatttactttttattatgtcccaatctgtaaattaggagcacaaaaaattggtccagctgccctgtgttttcactttcagcaacgctatctcatgaaataatggaaatgttttcccgtaaataaccaaagaacagaaataatgcaactcattaaaatacaatagtgtatatgacttcaactcgtcttaacaaggttggtattcccaataaacagttccttaaaacagaaaattagtgggcatttatggaagttctttaaagataaatgatgttttgttattactttttaagaaatcctttccaataataaccaagaccatgtatttgagttacaaacatgaccatgattcaaagcaacaattgtgaaaatgatgctagtacaattttgtctccctaattccgagtttcttcttccacagtgattagtatttattcataggcttaatggaaattattaaatatttgttaaataaaataatatatggtatatacgcatataaaatctggctttatgagtaaactaaataccttttataggaccttttactcttatttcattcagtttgttctttccaaaccaaaaattaatgcttgcattatgttggtaaatctccctaaatgttcccaactcaactataaataaagtggatgacccattatattgggtcaggtgtgtgtatgcgtgtgtgtttgtgtgtgtgtgtaagtaaaataaaaaagaaattcaacaaataaaactaaaattatctctatattttataataccacaagaaactgctggtcactgtactcctttttatagtggggtggtaagcaactgagaacctgagattgtttatgttcccaaagatgacattaaaaagaaactttttacaaacattcttggcagtatttcttttgccaaaatttgtatcaatttattaactacatgaaacagattaaatatattaaacctagttttttccaaacctgtccatggctaaccattaagataccagctagaactatttgaatatcatcttcagaataaatttgtaaacactttttcttctttacttgattatccagcaagttttctgccactaagccctccacacaacagtaagcacattaggggaggctgcagtgtaagtctgtggtgatattccactatttctgaaacacaaagacacttttgatcccctatgacttcacatgcatgttactgaaaaggcattattgacttccctttgttgctacaatggagtaacaagatcaaagtcctcagagttgaacaagaggtacagactaaaccccaagtcctctattatctgtgaccagagattttgtcaaaggagaggatgtctcttaatccatcaggagaagcaccaggcacctgtgcaattttaaaaattgctgtgtttcaccacgtttcactcataagtgggagttgaacaataagaacacatggacacagggaggggaacatcacacactggggcctgtcggggggtggggggcaaggggagggataacattaggagaaatacctaatgcatgcagggcttaaaacctatgatgggttgttgggtgcagcaaaccaccatggcacgtgtatacctttgtaacagacctgcaggttctgcacatgtatcccagaacttaaagtataatttttaaaaaattgctgtgtttctgagaaccactaaattataaagtctagaatgtgtttataattaattatacaatctgaagcatgcgctaagtaagaatttttatattcttaaaatagtatatggacaatattaagatcttggttttctatatttagtaatatgtgcagtaatgcagggttgcattgctattgggcttttttctttttagaaattttattttatttttgtaagtacataggtatatatatttatgggatacatgagctattttgatatgggcatacaatgcataacaatcacatcaggggagtatttatcacctgaaacatttatcttttcttcatgttacaaacaatccaaatatactcttctagttatttttaaatgttcaataaatttttgttgactgtggccatcctgttgtgctatcaaatactagatcttatttattccatctaactatatttctgtacccattaaccatcccacccctcccccacccttcccatcctctagtaaccaccattctactctctatctccatgaggtcaattattttaatttttagctcccacaactaagtaagatcatgcaaagcttgtttttctgtgcctggtttatttcagtttaaatgatgacctcaaattctatccatgttgttaccaatgacaggatctcattcttttttatagctgaatatgtctttatccatttgcctgttaatggatacttaggttgcttctaaatctgggttattgtcaatagggctgcaataaacatggaagttcagctatctcttcaatacacttatttcttttcttttgggaatatacctagtggtgggattgctggatcatgtggtagctctacttttggttctttgaggaacctccaaactattccccatagtggttatactaacttacattcccaccaacagtgtgtgaggattcccttctctccacattctcaccagcatttgttattgcctgtcctttgaataaaagccattttaactggagtgggatgatacctcaatgtagttttaatctgcatttctctgatgatcagtgatgctgagcagcttttcatacacctgtttgccattcgtatgtcttctttcgagaaatgtctatccggatcttttgcccattttaaaatcagattactagatttttttctatagagttctttgagctcctgatatattctggttattatcccttattggatggggagtttgcagatattttctctcattctatgaattgtctctttactttgttgattgtttcctttgctgtagaagctttttaacttgatgtgatcccatttgtccatttttgcttgggttgtctgtgtttgtggggtattactcaagaaatatttgcccagtccaatgtcctggattgtgtctccaatgttttcttttaatagttgcatagtttcaggtcttagatttaagtctttaatccattttcatttggtttttgtatatggtgagagataaggatctagtttcattcttctacctatagatactcggttttcccagcaccatttattgaagagatggtcatttccctaatgcatgttcctggtgactttgtcaaaaatgaattcactgtagatgtatgaatttatttatgggtcccctatactctcccattggtctatgtgtctgtttttatgccattaccatgctgttttagttactatagctctgcactataatgtgaagtcgagtaatgtgattcttccagttttgttctttttgctcaggatagctttggctattctgtatcttttgtagttttaatagaattgtcttttctgtttccgtgaagaatgttatcggtatttttgataggaattgcactgaatctatagattgctaggtaatatggaaattttaacaatatggattattccaatccatgaacatggaatatctttccattttttggtgtcctcttctatttcttgcatcggtgttttacggttttttttgtagagatcttatcactacttgtttaattcctttttcagattgtttgctgctgacaaatagaaatgctactgcttttcatatgttgattttgtatcctgcaactttattacattttaaatcaattttaatagttttttggtggagtccttagttttttccaaatattagattatatcatctgcaaacaaggataatttaacttattccttttgaatttggctgctctttatttctttctgttgtctgattgctctaactaggtgcattgctactgtgacccaaattccagtatgtaagagaatctcacccatcaaaaataagaacaataagtcctttgaaccttgtaattgcaacatattacatgcttttccaggttttgctgtccttgatcaatttgctaaatcgtccttcaggagataataaaaagtgatgcaaattatagaaaaacaagaaataatagtctccattgaaaattagtaatgatctattgaaacaaagactgacattgaaaatgaagaataacttagtgacaaaatgcattcaaatttatagccagtcatcttctaagaaatagataaatatccatattagaaacaattatttgcagcagaattttacttttattgtattaaaatctcctagttttaataaatagtaccagaggatcaataaactgtatcatttgtatactgcttcacagcctgaaagctgagaccagtaactcaatagattgacttatagttttctggtgagttttcggactttgaccatgattttcagtttatagaatttttgaaacagtaacaaaaacagacatatccatttaatttagaatagcatccacaaatagttatctacaaatacaaggcactgtcctaggcatatactgtttttacctatctccaaggaacttgtgtccaactgatgatccaaacataaagaaagtgttggctaatggtgagatcaaggtgttgacagaaaggccagctagttgattaccgcaccagagtttcataaagtgacaatgctttagttccacacaactccagtgccactttacatgtgtaattatggttgcattgacacctatatcacaatcacaaaataatgttttattttaaatacaatcttttttaaaaggggaacttaagactcctagggatctgaggaaagggttcaatgtaaaaattttcttacttttaggaaacattgaattaaatcatataactggaacgtgacagagccagaatttaaacccaagttttcagagttcttttcactaccagagagaaaagatttcttagaagagatagcactttcccaacatcttttgcacatctagagagaaagaaataagcactatgggaaaaacaaatggtattttcattgttccttgaaaaaaataaccctacaccaagaattataggacaaaagcccaatgggatattaaagtaaaagccacactcaacgaaactgaggactcttttcttgttttgttgagatgctgtgatatagacattaagtttagccaaatactcctcttcctatttatttttatttaacatccctgacagaattatgaagcttcagatgaatactcagagtgataaacgacagactgctctcccaacaccctgaatggaaatttttcattttgctcagtacatttatgaaataatcctgttatgtgtcttatggtggtcatcacttggatcctgcctactttccatgtcattggggccccattttcacgtcttccctcccaagcatccccagtactgttcagttatacataattctatcaaatactcaaattccttttagctagctttctacagaagtatctgccttttgcactgttctagggtaagcaccctgccagaggtctgcattgatgtcattagcaaaaggagaaagtaattaaatggaaaatgaatgcctattttcaattccaccaaaatatgtttttttaaccattatgatttttcagctataatatccattgtttctgtttcgttaaatgaggtagtactttcccttaggaatactggcagtgggaacattgacaatgtctcttatttcacagaatgggatttcagaacagatatgccaagtaagttgagtaagattccactccatcaccatactcatcatattctacttccagataggatgcaaagcaggggtcccaatcaccaggccaaagaccaatactggtttatggcctgttagaaaccaggccacagagcaggtgagcagcgggcaagctagtgaagcttcatttgtatttgcagccgctccccatcactcacattcctacctgagctctacctcctgtcagatcagcggcatgagattctcaaaggagcatgaagcatgaaccctattgtgaactgcgcatgcgagggatttaggctccgtgctccttatgagaacctaatgcctgatgatctgtcactgtctcccatcacccccatataggactgtctagctgcaggaaaacaagcttagggctcccactgattccacattatggtgggttgtataataatttcattatatattacaatgtaataatagagataaagtgcaaaataaatgtaatgcactggaatcatcctgaaaccatcccccaccctgatccatggaaaaattgtcttccatgaaactggtccctggtgctaaaaggttgtgggcgtctgatatagtttcatttacaataactccattattcttggagttcggacacctgggttttcaacccagtttggtcactaacctcttaaacaaccaagacaagcggatgatcatctctgagctgtacagttctcatacaagatagacaccagacgatggcaaaggctgtttaagctttaaaatgcttagcccttccatttttttcattcagaatatgttttacaatgggcatagaaatctttcagtctttaaaaacgtgatgaaggatatgagactatttctatagagctaaaaatatatttatattttgaattatgaaacagtgtgtaggaacatcttacaaaacttaatagtaatatattgaaagacagcataacccagttgccagagaaagcagaaatcaagacaaagatcttggaacaacattgtttaatgtgagaacaaggttccagttctctgacgcctgtattcatttaacaaatgtttactaagcaccaactgtgtgctaggcaaaaggccaggccctctttttaataaagttcgttcatgatacacactgattgatttaatgacagcccgtttgggaattttctccatttggctggcaggataaatggaatgtcttgcagcactcaaagtaaaggtctttaaggagaagttttatctgcttttaaccacctcctaacaagtgggaaagaagagagaaacaactctatgtgtctgttcaggtttatttttcctctgagtaatcaaactgtggaaagcagctttgaccacgtagggaaagagccagccactgaactgtgatccgagctcatcctgtaacagagggcctgaggcactttctagaagaatgagttttctgcctgagtgtttctttcagagaagagagaaatgaaatgtcacagcaattatctgggcagcggcagtgcagggaaagctggctgtggccagagtcccaattactggattaggcagagacggatctcagcaactcctgttgcttcaaggtgagctcagtaacagcgtgatggaaaggatgaaaattccaaagaagggtcctggaaactcacaaacgaggctgacttgcttttgtgagaaggctttgggatccacatttacaaacaatttctctaatccccagttctgccattccacataatgagaaactgttaccaaaggtctgtctgcaacgataatagcagagtgccctccttgcccattccttccattctaattaacttcttattaatatacataagcctaatacatgctggccacaagagagcaatttctattcactttcacctctttgccagccttctaagaacatgagacagcagcatctttgatggtactttgtcagtaagagttctgataggtattaacaaacctatccttaaaaatagagtgtgctgtgcacaaaacatagcacacatcaatttcaaaaaaagaccagtctttctcatgaaataaagtttatggaaagattaaagtcactggcaatgccccatcatgaatgaatttaaaaagtgtacctgtcaaattagctcgtgtgtacaaatactagacaaagcacacatgtccagaaaagaggcacagtcaatctccacaactgtgaagccagctgcaggactctgtgaggcattggcttgtaattctcatatgcttgtttcttgagtaggctagaatattgaagttatttgatgttacataactcctcctaaggctgatgtcttgaaaagagggtaaagtttagatgaaataaatcctgagtctgattcaatgtttttctttagtaagattcttgaaaagagcttatatttgatgaactgactaagctggactgtagtgataactctttctggaaattgtatctgtcaatctactaatttctttgaagttaatcgattatttccaattactaacttacctcctgatagatgaaattgcctgtatttatcaggaaataattagaaagcaatactttacacctgcacaaaacctgccccaaatgatagggcttctcaccaaccgaaaggaagaatataaatgattttaaatttaattatgtgttggcattgctcagatataactcgtctaagattctttgagaagagttacatcttttttatggtaatgaaatgccaccatcactgtagtcggataattttacccactgaaaatgcatattaaatgtgaaaaatataaagttgtaaagttgttagagtgttgcctcaggaagttaacatcttgagattatattaacctttacaaaataccctcatacattaaggcagaatataaacaaaagcagaggcagtaatcctctattttgctaacacaggaaaaataatagcccagtttttagtctactaatttttaaaataatatacagaataaatttgacataagtattattgcaaatcagatgtcttctacttattttattaagactttatcactgttttcccaatgagatgtaatttttcctcttttgaattgccataacatttttttccttcttttcttatttggcacttactgttttctatttgatgttacagataacattgcatagagctcttaggttgtaatattttcttacttcctcacagtgctatcactaagccttatattgtattcatttcttcttactattcattctttcatcaaatattaaggcaggcagtagtgcactaaaaaaagtgattattgcctccttgtaatgttctctaaatagcagttgttaatatcaaagaaaaggagtgaaaaccagactgtgccccaggtgaaagaatctagaactaccaatagccttgacaaagattcaaagccgaatctaatcaagactctatatctgctactaattttcaggaatatagagaggagaaaggaatataggcagcaaaagtgtgcaacagcaaatctagtctgtggacatatccgcaggtcagtcagtctgggatctttgacagataaattgcaaggaaaataaagggatgaagagggaacctgtagattaaaagagacatacaagacatataaatgggtctagggatgcacacttaggtggtaaaacaatggagaattgcaaggaagtgattaccataaaggtcaagacaatagttattttggagggaagaagtctatgataaagatggacctattgaagggcttctgggtaggagggcaaagttccatgacttattgtgaacgatggttatacaggctaaaggattgtaagagttacaaacgctgaagataattcattaagctatcatttaatgtggttttctgtatctgtgtgtattttaaataaaatggttaaactcttgtatgtgtagtaccaaattatacatacaacagtttatctactgttaaatttttttaattttaatcagctgtatttattgtatagcatttgtgcattagatcatgttttcaaatctctgtgaaagtttaggttatctgaaatgccagaagttaatcttaccagatttggggagaaataaaaaaggtttttgttttctgttttatgttatttttagaatctcttaaataaactaaatcaattgtatcatatgttattttaaaattattattattatatatttagaaataaatgttctgcatattaccatttacaagtttttatgttatagagacaagcattttcacttcatgatctgttctttagcttcaacttattcctactgttatccttcatagcagagaggacggttttgagatgagaccaacttcattggaatcctctgtcaagtactagcaatacaactgcaggcaggacacttaacaactgtattgtctctgtttcttaatgtacaaaatagaactaaaaatcgttttagcaagtcactggattgtaaacagaatttaatataattattgaaaacatggaccctagtacataaaaaacttacattcagcattaactgtcatcatttttgctattattattaccaagcattactattattactagtatactgacctataagaaaaaaaatggagtcgtgagctaaaaggaaatacttcttcatttgacattttaaatgttttcagattttctataatccattaagatgtttcaaaattagaaattcctattctttaagaagtttatcgtcagcagcaatatgctgaagactagctaaaaaagattaaatatttgaaatttaggaacacctaacctcattttgtaaatgagattattaatcttgactcgtctttaacctaaaaactaacagaatcaactatgaaaagcacctatcattctgaaatcactaaaattgtccattctcggaaaaaagtgaaaaaaagcataaaatgtttcttcattaactccgtgtaaaaagaaaggtgcatgtagttcttcagcattgcttatctccaatattttcctgacaagcattcaagatcacaaaatgcccctagcaagtcagtaaactctataaagaaaactacttccacaacaagttttggccatgggttataaatgtgatagctttatcaagcagaatcaatgtcttaagtaatcagactgtttcagccatttgtggaagatacagcataataaatctgaggtgtggttctattctgagaatcaatcagttttagggtgccctcagtgaccgaggcattttattacgcttatctcacacttcagtgtctccagtctcagatatcagctgagcaacctctaaacttaaccgcacaacttgattctccaagccatttgactttaatataaaagcaaataaaattaattataatagctgtctttcaaggggtgggaatcggttcccagcatatacaattttaaggcaacaaattgaaatcagcaggaaagaaacatttgcagttcagcttatttttatggagttatttttactatttttagtttttctttatttctctacgttctattaaaaaaaaacacacaaaaatggagccattcagtttggcttattttttctattgcattgaaacagtaaatgaaatataaagccactaatctatggatttacctaatttcagagtattttaatattttcctttagatactctgcttaccaaatggcttctcattaagtgggattttaaaattttcctgtcttacaattagtttcttctcttccccattatattttcaaattgcttataacaaagaagctaaatcatcctgcgcttattttgtttctttttagttcttcttttcataaatcacttatgctagagaaattacccattatgcctctggaaaagatattaagtgctattattaaacatgattcatccaatgtactttatctgtatacatgtgtaatacaattgctttaacacaaaaaactttgttagtttattttgtcagaactggttatttggggggaaaagggttcatgtgaatattttgtcttcttcagactttttctatttcagttctataatagtttcagaaagatagattgtttttcttatttatgaaagtgacctctgaaaagcatgggacatcatttttacagtggttcatatcacatgcccttatttaacctggcctctctgaatcaaccactgagcagtttggacactgcacagattagaaatgttatcactatcattttgatgaattttattcttcaagaaatgtgtgactttacattacattcttttcagataatgtgatacatgacttttgaaatatttctttaatgatttttcttgttataacaaacaagtttattttaaagtacatgttcttctgagtaaaataatgcatagccaccaaagaaaatttggagaaagaaaagagcaccaaggataaaatgaatttttttattttaaaattgattcatatctcccagagacaattgtattggtatttgggtataaacatatgcccagcctttttctttactttgattttgttttgttttgttttgttttgttttgttttgttttgttttgttttgttttagtgactcatggctttaagactactttttaatcagccttttcctcagcaacatgccttgggcattttccccaatcatgaatgttcttaaacaacatcatttataatggctatatagtattctagtccatatgtctgtagcataattaatataaccaacactcattgtcaggcatctaggttgtttcctgatcttttgtttgtttgcttgcttctgctattaagtgccaaaattaaaaatcattaattaatttttaatgaatagttctagttttaaatgataatttcaaggccaccaaatatcggaagattatgtaaactattaaaacagccacgtaagtagtttcccaaactcgtctcctcctctacagcctgcttcaatccatctgttgctttgcagcaagcatgatctcagtagaaatgactgctgtggtcccattgtaatgactccctttggtcattgtgttaaagtctaaactgctttccaggacttttaaggccctttacactgggggctgtattttctctccaacccctttgtcccacctcttcacacggtccctctgggctgccaagtcagccacactgatgttttaattaccaaaagttactgttctttctctcagattaaaaccatcttatgtgcttttcccttgcctgggcaacctaacccaggctccttatctctgctgtaggtaaaaatgatcagaattgttcttgcagagtgttgagtaaaagaaagtagggcttatataggaaacaatttctgttagctattgtcaatacatattataaataacattggcaaaggaagaaggaaaaattcaaatttcagtcttcttctttaacaccatcactttcagaggccttttatgatgctctagttctgggaaccctttttcctccatcctatgcactccatggcccacccatgccaagggttctttcatatcatctgaaccccaccctcccatgataaggcacataatgttttatatgaatatatgtttaacggtgcaatcatctctttctacagtagatcacaaggcccctgagaacagaaatggtgtgttttttctcctggtaaagagtgcccacaacaaataaatatacatagtgtctgatttaccatggttcaacttgaagatttttcaacttcatgatggcaagaaagccacatgcattcggtacgctccttgactgataatggagctacatcctcaaacttttccagaagttaccccatagtaagtcatggagcatcagtacttgttacagaaataaatcttatctcaaatttctaaaaagaattatgtctttcttattaaaattaaaatgcaagatgttatggtttggatgttttgtcacctccaaatctcgtattgaaatgcaagctccaatgttgaaggagggtctagtgggagatatttggatcatgggggtggatccttcatgagtgtcctagtgctgtcatcaccgtaatgagtgagttctcactctgagttcacacgaaatcaggttatttaagagtctgtcatggcctccctgtcttgctctctctttctcaccatgtgatatgctggctctctcttggccttctgctatgattaaaagcttcctgaggcctcaacagaagtcaaacagatgctggcaccatgcttgtacagcctgcagaaatgtgagccaactaaacctcttcttttttttaaataaattaccctagtcctaggtattctttatagcaacagaaaactgaccaacacagaagataaattacaatatttttctataaaatttaagccaaagaaagtaggaattgatataagaaactatctcctttagctcttatttttaataactttaaaaatggaagaaatgataattagtagctattaaatgatatatgaaagatagattgaaagtccattattaaaaatttgtttgattttatgatgttatatatactatttttgtattgatttatctgattataaagcctccattttcacctaacactttgcagaagcattttaccatattattaaataattattgaatttaaaagtaattatgttgttgaattaaaatttctaaacgtaaatctggtaattataataacaattttatgaaatgctcttttgttaatattaattcctagcaatatcacagacatttgataatggtttcccaatcactacatagtaaggcaagaaaaaaggaaaatccattttgtacaacattcagaaaattcttcttaaataagatgcaaaaccaccttcaataagaggttaatatgtcaaatgcaagaaaactgtataaaaatgcaccaagcaggaaataagatgactcacaattttatagaattcatttactcttgataaatctaatgaaagaaattccaaagggaagatttagtgagtaacagagatttatttttaaaaaatagctatgaccaggtggctcacgcctataatcccagcactttgggaggccgaggcaggtggatcacgaggtcagagatcgagaccatcctggccaatatggtgaaaccccgtctctactaaaaatacaaaaaagccgagtgtggtggtggacgcctgtagtcccagctactcgggaggctgaggcagaagaatcacttgaacccgggaggcagaggttgcagtgagccaagatcacaccactgcactccagcctgggcacagagcaaggctccgtctcaaaaaaatatatatatagctatgacccacactgtagaagaagtatagtgcagaaaagttgcaggaagaaatagaaagtcactttggtttaaattaccaaaaactctaccttatttctctatttcacatgagttttggttaaatataaaccaaaaacaattcagccaaatgaaaacagaggtaattcaaactagaaatgtcagaaagaggattgattttccctaaacaaaatttttgaggttaatgtctgggttcccagaagagagcaatacaaagagaaaaatgacctgggggagagcatgtttgtctgttgttttaacttggtgaataaatatttaggttcagatgacttgaggactctcattgaaaagttgttttcactgagacaacgaaaaaacaagacttttaactttataattcattatcacaaagtagacttatgatgtctaagaaggtcagttgctcagaaaaatgaagacattttgtgctgttgaggtttagaaaatctcctttcaattatattgacaaatggtttaattcttcaatttactatgtgatgacagagttttcataatctgtaagaatagaatatatacatatatacaatcatcaattattccttttaactctgatttcaattagaaacagagatactttctaaggagatactatgataaattatacacattatatgaactgtccatgttttctaagtctgtaggctagaaaatcagtggcatgtattaacaaaattgttatttatctgtgtttatggatgaacacattaacacatttaggacaatgatttttgtgactgttatttctatcttcattctatggccagaattatgccatagaggatgagattcaggaccaaaccagttcagccttcaacgaaactacttaagcttcctcagaaaatcttaagtcaaatgtttttatattgacacatatgcttgttctgcagcctcagttatggacacagacttccaattggtattggtgttgtgtagtcaaattttctctgactttgactttggtgacgagtatctaccaaagggagtatatgccctgttggataaataacgtacgaaggaatatgaacaggggaaaggtcaaaatacatttctgctcagagagtaaggtggagtccttgtactgtggaagcaaaggcagtaattcccagcaagctacacttaaaaaatttcatggctaaaacggaggcttacaaaggagagattcgaaacccactcacttagtgattagtatgattaagagctatcaataaatcaggaactgcacagcacaaaaagagataagctcctgcatttatggtttattctgtaacagaggcaaacatactgttgagacagtaaactcatcatgaagaaagtttttttatctcaaagggtaaaagttcatgagcatgtataggttggttttatttcataggttgtgtccttttatagagggtggagatgggggacagggtgtgaaggtgctcttgaaggcccttgtgaggttttatgaaagaagtgagtaatgagaaataatggcctgagatatattaactagtctatgcaaaataaaatacatgtaatcctttttaaaatacatatttctgtattctggatgtgttcaaagtaataaaaaataaaacaattacactgcaaagtaggtggtgctataattttgcttgaacctgtttctacagtttgatgttcttcacttgatattccataaaaccataacactgttaagagccatctcatgaatatgtggggaaacaaacaaaataaaccaaacagaccatagtatttccaaatagatttctcaccaaaaaatcctgatctaatgtaaagcatatatatgataatgtttgagaactgtcaattaacaagcaatacacattttcttgaaatactggctgaaagtttataagcttaactgaaacttcttgtggtacgagtatacaaataagctgttaagaaaagtaatatgaatggtgcctatcctttcaaacccgttttttactttattatgacagtaaagtctattataataatttatcttaattattaattatatggtttttggaactaagattatgtatgcatatgggaagtacatgtgtgtatttaaatttctgcttgaaaaagtataggttttttgctttcttgttttttcttcaaagtttcttggacacattttgaagttttaaaccgaaatttttattgtacccatttaaatccctttcttttctgggatcatttttattcttctagccttgtatagccccagccatagagaagtacttgttctattataattagtataataaatgatgtcattaatggtatccacatagctaagaaaattagttttacttatgttttcttagatggttttgctgccaagaaattcttattggaagatagttgaacaaaatataaaaatgttcagaagcatgctaattctatttctggatttgtgctgtatgttaaattttggcactttctaacttttaataatgtaaaaggttaaacactcaatgcaaatgtattttagagtatctacactaaatgccacattaatctcagtgtaattaatgagcttaccctgtatgtattaagcaggaaactaggattatttccctcagaactcatgaacctagcagaataacagattagaaaaataaattttgcagcttctgtcctgactagaaacaaactagatggtccataaatgcattttgatttaattttctaagattcagaagtacagtataaatctcatttatccatcactatagttccattatcatcagccttagggatcaatattttacaaggaagattaggtaatcagagactcacaccactgggcaggttataatataatatcattatgttaaatgacaagctcacttagtaatcagattgcatgcaaattgactgttacgtctacaaatttctaaaatgtaaacacgatccaatcaagtacatcatgtattcatatggaaagtagaatcaatattggacttacatcaagttttatacagaccttgtcaggagatgctgatgaatatattatgggcaaactatatcttagttgcttattatctaaaatgtcaggttacatagttttattgtcagtttattgataatgaccactatttgttactctcaatcacaaaatgtcaaagcctatagaaacttagagatgttctaggtcagtagttcttagcgtgtgggccccaaattagcatcatcagcatcacctgggaccttgttagaactgcaagtcctcagtgtggaggttttttttaatgcaatcaaagttaagctgttatcagcttaaaataacctgttataactataagatgtttcctataagcctcacagtaaccataaagcaaaaactcctatagtagatacacagaaaacagaaagtaagaaatcaaagtatgtcactggagagaatcgtttaatcacaaaggaagacaacaagagatgaagaacgcagcaaatgatctacaaaacaaccaaaaaacaattagcaaaatagcagtagtaaatccttgcttatcaataattactttgaatgaaaatagattaaaattgtcaatcaaaaacatggaatggctgaaggtattaaaaagaaagacacaaccatatgctgcttataagagactcacttcatttttaaggacacatatagactgaaagtaaaatgatagaaaaacatattccatgcaaatagaaaccaaaagagagcaggggtagctatacatgtatcatataaaatagactttaagtcaaaaactgtaaaatgaaacaaataagatcattatataatgacaatggtgtaaattcatcaagagaatacaattgtaaacatatgtgcaccccaaattggagcacctaaataaataaagcaaatattaataaattattgaagggagagatagactctaaaacaataataataagagactgcaatatcttacttttagcaatggatagatcatccagagaaaaaaaatcaataaggaaacattggacttaaactataccttagaccaaatggatctaacagacatatacaaagcattccatacaatagcagcagaatatacatttttctaagcacacatggactattccatgttagatcacatgttaggccacaatacaagtctgaacaaatttaagaggactgaaatcctgtcaagtctcttttctgaccacaatggtataaaactataaattaataacaagaggaattttagaaaattcacaaatacatggaaattaagcagcatgcttttgaaaaacaaatggaccagtgaagaaattaaaagagaaatttaaatataccttgagacaaataagggacacagcataccaaaatttatgagggccagcaaaagcagttcaaaggttagctaataccaataaatgcctacaccaaaaaagaagaaatgtttcaaacaacctaatgtcacacctcaaaaaactacaaaaagaacaacaaaataaccctaaagttagcagaaggaaggaataataaagatcagactcaaagtaaacgagttagagacaagaaaaacaatagaaaagagcaacagaactaaaagttggttgtttttgaaagataaacaaaatcaacaaacttttacctagactaagagaaacagagaagagactcaagtaaataaaatgagaactgaaagaggagacatcacaactgatgacattaccactacagtaatgcaaaggatcgtaagacactgctagaacaattatacaccaacaaattggataacctagaagaaatggaaaaattcctaaacatatacaatctatccagactgaatcatgaagaaatagaaaatgtgaacagaacaataacaagtacaaagattgaatcagtaataaaagtctcccatcagtgaaaaccctaggacctgatgccttcacaactgaactcagccaaacatttaaaaaatagggaacattaatcattcccaaactcctgtcactcttccaaaacatagaagaagagaaaatacttgcaaacttattttacaaggccagcattaccatgatatcaaaatcaaagacctacaagtaaatcacaagcccttatctttgataaacatagatacaaaaatcctcaacagaaaactagcaaacagaattcaacaggacactaaaaggatcattcaccatgatcaagtgggatttatcccagggattcaagggtcattcaacataggcaaatcttatactcacaacatatgcaaatgtaacataccacattaacagaacgaaggacaaaaattatataatcatctcagaatgcagaaaaagcattggacaaaattcaacgtcctttcataataagaaaaacctcaataaattaggtatagaaagaatatacctcaacacaagaaaggccatctatgacaaacccacagttaacatcatactcaagagtgaaaagttgaaaatttttctctaagatacagaacaagacaaggatgccccacttctctgtaacatagtactggaaaagcctagccaaaataagcaggaagaaaaaagaaataaagggcattgaattgaaaaggaagaagttaaattgtccctatttgcagacaacatgatcttatatatagaaaaccctaagacttcacacacacagacacacacacacacacacacacacacacacaaaagaaagaaaaaaaacagacaaaactgttaaaaataatgaatttggtaaagttgcaggatacaaaatcaaaagtcagtagtgtttttatacactaacaaaaaaaatcaacaaaataatcctatttataatggctacagaaaattaaataaatcaaatacttagaaataaattcaaccaaggaggtgaaagacctgtacacagaaaaccacataacattgatgaaagaaattgaagaagacacaaataaatgaaaagatatcctgtgtttatggattggaggaattaatattattaaagtgtcagtaccattcaaagctatctacagactcaatgccatatctatcaaaattccaatgacattttttataaaattgaaaaaacaattctaaaattctgatggaatcacaaaagatcctgaatagccaaagtaatgttgaacaaaaggaacaaagctggaggcatcacactgcctgacttcaaaatatactacaaagctaagtaatcaaaacaacatggcactattgtaaaagcagacacatagaccaatggaatagaatagagagctcagaaataaatccacacatttatggtcaattgatttttgacaaaagtgccgagaacagtttcttcaataaatggtattgggaaaactgtatatccacatgcagaagaatgaattcagacacatctcacataatatacaaaaatcaactaacaatggattaaagaatgaaatgtaagacctagaactgtaaaactactagaagaacacatagaggaggagctccatgatattggcctatgcaatgatttttttgatattatatgacccaaaaaccacaggaaatgaaaatgaaaatagacaaatgggattacatcaaactaataagcttctgtacagcaaaggaaacaatcaacagtgtggagagacaacctacagaatggtagaagatatttgcaaccatccatctgataaggagttaatatccaaagtatataaggaactcaaacaactaaaaagcaagaaaacaaataacctgatttttttttaatgggcaaaggtcctgaatagacacttctcaaaagaagaatggccaacaggtacatgaaaaatgctcaacatcactaattatcaaggaaaaacaaataaaagcctcaatgagatatcacaatggttattgtcaaacagacaaaaaagaataagtgttagtgaggatatgtagaaaaggaaccccttgcacaactgctaatgggaatgtaaattagtaaagccattatggaaaacagtatggaggtcattcaaaaaattaaaaataaaactaccatagggtccagcaatcccagtattggttatttagccaaaggaaatgaaatcagtacatcaaagatatatccatactgtcatgcttaccatagcattattcacagtagctaagataaggaatcaacctaagtgtccatcaagagatgacgaatggataaagaaaatgtggtacatacacacaaacaagtagagtagtattcaggctttagaaggaaatccaccatgtattacaacatggatgaacctggacaatattatgttaagtgaaataagccagacacagagcggaaaaaaataccatgtgatctcacttacgtatggaatcttaaaaagttgaacccacagaagcatagagtccagtggtggttactagaggctggtggggagctgatggattggggagaggttggtcaaaagacacaaaatttcagttacataggaggaacaagttcaagagatctattgtacaacatgataactatagttaataaaaatctattcttgaaaattgctgagagtggattttaagttctgtctctataaaaaaatgttaagtatgtgaggtaatgcatatactaattagcttgatttaaccattccattatatatatatatatatatatatatatatatatatatatatatatatatatatcaaaacactacgttgtacacaatcaatatatacaattttggttaactaaaagtgaattaacttttaaaaagatatgtaagtgccatccagacctcctgagccagaaattctatgggtaaatcccaagaatctgtgttttgcaaaccctttgggtgattctgatatatgcttaaattccaggcaacactgttcacttcttccagttttgtgagaaaaatgcagaggtactggacagcaaagtcagaaggaacctcagatctcctgatttccctaagaatatcccactgccatttaagttaccttgacttgactttgttatgcctcaagacaaaataaatgtttagtgaacatcttctctgtgatatatatgatatacaaagtctgccttcatggagatatatttgcaaagaggaggcaggcaacaaacaaaaactatgaagactacaatatatttaacaaatacatacatactcgaataaatttaataaattatatatacacaagaatatatttaatagaatgttaaagagtgctcatgccataaagacaaataaagcacagtgaagggaaaattaaccacagagggtggaatcttagcgttgtcagagagaccctctctgtaaaagtaatttcatgtttgttgttccagagttacatactctcagcctgtatcttggttaactcaattcaattgcaagatacttttaccctgtactgtgtgttccagttaatagggaatatagtgataatactgtactgtctccaccatccaacacccttttctgtgataataaattatatcatttttcatatatttttgaaaaatctttaagaacaaattgccatgcaaaactgaggaatggtacatctcctagatcggacagttgtcaatggcaacaaacgggctgctgtcagctcccaaggatctgaaggcaaattgcagatgtcctgtgatggacagctccttaccagaacctacctcttgaggggatgcacagttgaaggacaacgctacctggtttgaataatcagcatgaatgatcctgacttaatgagtcaaagcatcctacattcttcattctcacactgctaaaaacctgagattgggtaatttattttaaaaaagaagtttaattgacccacagttctgcatggctagagaggcctcaggagacttaaaattatggtggaaggtgaaggggaatcaaggcaccttcttcacaagggcagcaggaaggagaagtgctgagcaaagtgggaggagaccctgacaaaaccttcagatttcatgagaacagcatgggggagaatgcccccacgattcaattacctacatctggtctctcctaggtggggattatggggattacaattcaagatgagatttgggtggggacacaaagcctaaccatatgaacgtgacacataaaaaaataaattgcaagataccagtatagcatcaagcacgtttcacctgattactagaacacagtagcttcatcttatgcagatagacagtgtcaagactctacttcatgcctacctgacttccaaacttgcacctgacaagggcactactttattttacagatgaggaaactcaagcccaagagatattaagtgacttttgaagttccaaaatttgaggtgcccttatctgccattgttttacgtagtaatgaaaaaggatcataccaagggaaaaatatacatgtaattaattgaaagttgtcactgtgtgggagtttccaggttgaacgtatgtccttatggggatgttcaaaatagtatttaatgaaaggctgtgagaaggctagattgttgtcctgcagtgccctgggagtataaaaatgttgtccctaatgtttctatgcttactgatctagtgaagtatgattggggaggcccaaatagaagcacggtttatgcaaaaaacaagaaataaataaattaggagaaaaggaaaccctctaaccttgatgggcattttctttaggtggaaattaaagaatttctagagattgcatttttttaataagcaagctgggtttcatcttgggggttaagtgatgggataggggaacctaaggaaagctttgtctttaaaaggatcatggtgtttcagaagctacaaagcacagcacagaggacatctagagcatggtacacaggagcaaatacacaaactaggaattgggcaatctgggttttagaccttactgtaacctaacaatcctagcaaaggcattagcaaaatcatgcaaactcctccaggttcagtttttccgagtgctaagtaggaacaaggcttattctcatttctcaatgctattttcagaattaaatgaagtaattatatgtgaaaatattatgaaacttaaaagcaatatacatacatgttactacctcgattaagcatgtgacctgccaccaagaggatgtagtgccaaagggaggagacaccagcagaagaaggccaggagtggcaggtgtctgacccagggagggctctggtagcagagtagggatgggagagacacccagggaggaagtcagagaaagcccatggcctggagtgtgtgaccttgagaaaatcaataaaagaaaatccaaggaaaaatacagaggccagtagtcagcagcaagagccaactggaaagagaaatgaaaaaggtagcctagaccagatactcctgatcagaaatctgcagtgcaaccaaagtgtatgtgcacttttcaggctatgttggccctgagtgaggtgagggaggcaaagtgtgttgccatgtcatttgaggcaaaggccccttcaggtggatagatggtcccatctggaggtgatgggagacagtgacagatcatcaggcattagattctcataaggaacacacaatctagatccctcccctgcatagttcacagtcgggttcatgcttatattagtccattctcacactgctataaagaactatccgagactggataatttatgaagaaaagaggtttagttgactcacagttccacaggattaacaggaagcatgactgggaggcctcaggaaatttacaatcatggtggaaggtgaggaggaagcaaggcatgtcttctcatggtagcatgaaggagagagagtgcaaggggaaagtgtcacgcacttttaaaccaccaggtctcatgagaactcactattatgagaacagcaaggggaaagtccacccccatggttcgggcactttccaccaggaccctcccccaacacatggagattacaattcaagatgagatttgggtgagtacacagagccaaaccatatcaggtgtcatgcgactagcagagtttgagtgtccagataagaaaaaaaaaggtaagatggagaggtggcgaggtaatccctcttctctgatattttttttctgaggtcattgtgatcaaacctgacacccataggaatgaaaggggaaggagctgcgtgctctgttccctttaattcctacccccagaacaataacttgcaatgcagtagatcaggggagtcaacacactgcatcaagaaaagcaaggcaagggttaatgggaaatgaaagacagcacaaggaagaaagaagggagggaggcgggccacacatcctcctgtgagataagattcccctaagggaaaactaaatagagatgtagagatacttcagggctgacatagaaggaagggagggcaaggagggaagattcactttgcctttgttcacctttatattgtattatctcacttgttgtgacaaatgtgcattccttctgtgatttggaactcatcagaggaaaaacgttaactacaaagcagtaatatacgatagagataggtgctaaaatttgcattgtggcaattacttgggactacgaataaggttagacccatctgcagtgtcaacgtgattagtgctgcaactctgtttatattacgatcatgctttcacataagaatgaagctgcaggaaaaaataatttaaataaaagcaaatgaaatgacaagtaagagaaaatcttatgataaccacctaattcttcattccatctatgtattttaagttgaactgtgtgaaattacttatattttacagtagaggtgtgatctactgtaatttcataggattcaattttatctttttatctagacagaccgatgggtagatatagatagtagatacatacatacatgcacatatatatgtatatatacaaacatatatgtgtcatttgaggcttttaatatttgcttaaaattgtttgttttggtcctactttctgtttcattaagtatatttacataaagatcatcctgccagttatatgcttatccacttgcactgtctatcctacattttatgtcttctaggatttatggaaaacacaagtttctgtggacatgattatgttttccagaaataacacactgtgacttaagaggagaaatggaggagagccaaatatattgataataatgacaatgttagaaaaagaccaaacatagcaattcatcctctatgtagtgatattttcaaaacataaaataggctcatgactccattaggaggccctctccgctcccactgctcctattttgggttattgaagaatcaaattccagacacgaaaggcctacggcattgccaggcccctttccaaatctcctgatctactggacattgaaacgacagcagctgctcctatatttttctctgccaatagactttacccttttatgtctcttgtgctatatgttcctcttcgaaataataggaactatgcataatgacagtcgtgaccacacatctcattatacatagaccacagtccctatgagcaaattagtgaattcaccatacaaccttaaaacagattagcagtaaagagactatgttttcagaccaaagtttggagacttgttactttggagtattatatcttcctccacgataaacataaatattatgtatggagcatttacaggagtaaataaatactatactttttacttagcctaagccatgaagtaggtattattatcccctgttttaaaaacacaaaacctggagcctttcagtgacttctcattaaaggcaaattagggtttaaaccagatcagtctacatgggaaccctgtactctatcttagactttgacttggaggttaacttcagagccgctggtggcggaactgttcgtgaccattgaatgaaagcaaataggacataggaggagaagagaaggtcaaaaccatagcaaattttaacagcaaaaacttcaacagggtcttagcaaaaattgcagcaatatctaccagtaggaacttgaagaaaaccccaaaaggaaaacagtctgtatttggtgcttcatgtgaagaggacagcagcattctcacacatttctttttgcccatgtaagtagtaagtagacacataccttcaataaacaccaaaggatgtgcatattaaactgctagaggtgttatcttttgactattcttgaagagtaagctttagttcctcgagtatggagcccaattcatccatttctttcttattctttcataaaacatttttatacaactatggcagctgttcagtaaatgtttacgtcttgaactgactcttcatttgtgatcagtaccgttgatcatttcagatatgtttcaactttatttagtgaaagaagtccatttttcttcttacttaaaaaaaatgaaaataataaaaataatccttaaggttatttgaccctaaaagaggtatctccaacatttaccaaagtcagtctttgtcttgctctactcagattgtcataacaaaataccacagactgggtggtgtaaacaacagagatttattttctcacagttctgaaagctgaaagtctgagggctctcttcgtggcttgcagacagccgccttctcactgtgtcctacagggccattcctttgtgtgtgtcatggagagagagaggagagagagaactgcattctctctctctctttctctgcttcttataaagccatcacttctatagccttaggacccacccttgtgacctcatttaaccttaattacttcctaaaagtcctgtcttcaagtacagtcacattgtgagtgaaggcttcaacatatgcattttggaaggaatgtgatccggtcctgagtcatcctctaacaacggagtgtagtccaagatgccagtagtcacacgctagatgcaacatgagcatccagagaccagttcaccaccagctgcaacatctcagagaaactgcctggctacacttaatccaattatggattttatttctagactaaagcaaaggcccatttaaactaagaaagcttgccaaaaatcaaaattctgaggtttggactttcttagagaactgagaaactcaggaagattccttgggactccaaacaaaacatacaccatacacctccttctcctacaaatacctatggaaggaaggatccccttcaagtttagaacccaggaactttgagtaccttataaaaccaccagactcctgacacttgcccaagatacaaagcatccctggcctgcgaacagggggcattttggcagcaggggctctcccagaatcattctcctttgcacgtcccattccaatgcagttccttcacatcttgagacatctcaaccaggagggagtgatgagaggaatgtgctctgagatggctgagtttgttctccgtggacacccctgtgcaccaggcatggttcaggcaaagaagcagaaccaatggaagataaatattaagaggcttatttcgaagaactggagtatgtgattgtggggtaacactaggcaaatctgaagtccagggaccaggcctccagcaggtgtaagctggatatggcctgaagttgctgtccacctgaaggatttctccttcaccaggaaatcctcagcctacttttcaggactttcaactgatagaatcaggctcgcccaaatgacctaggataatcttcctcataacggaccttaatcacctacaaaataccttcagaacaacacctacatgagcatttgattgaataactggggctgtagcctagctatgtttacacatccaaagaccaccacagcctgtatacagtcccgtgacactgctgaaggctaccaggccccaggccaaaaactggagccacgtagagatgataaaggccccctagttagatcctgagaagcaacgagaaaagccacagtcatagccctgggatttggcacaaccaccaatagtcacacaagcctcccaccatcaccagcaaaacctgaaggatacttcccattgggcttgccctcagcaggctattgtaagggttaagtggaagaaattttttaaaatacggtgaaaatcaaagttttacatacatataaaggagtgctgtttttactgttattattttttgctatcagagaatgttcacttttcatctagaacctaggaatatcctcacaagtacacaagggtattaggcagtatcatctccataagagtaaactctttttctattgtggagttccatatatttcttacttttaaccagtatcactcaatctaatccatatcagtatcttaatcataggatagtagccatctcttttagcatgtatttctctcaatggatgaagagtatgcatacaatcaagaaaaaaaatcccgagtaaaatgtcattaatgcacatttttaaacccaaaatgttttgctgctcatcaaacaagcaagcagctcctcacaattctgctatcctggctgcaagaatatgtgaatatctctcctgggggaactcatgcaacttgcccaggattcattttcattccagcatgtacaatcccagaaatttaataggatttcaggccatctttttgctttctaactgtggtaagaacacttaacatgagatccaccttcttgagaaatttttaagtgaacaatacagtgctaaaatgacaatgttatacgacaaacctgtagaacttattcatcttgcataactgaaactttagacctgttgaacagcaacttcccacttcctcctgcccgtagaccttgaaaagcatcattttaccctgtttctatgagtttgatgattttagatacctcatataagtgaaatgatgctgtatttgtccttctgtgtcaggtttatttcacttattataatgtcctccagattcatttgtgttgtagcacaggggtgtccaatgttttggcttccctaggccacattggaagaagaataattgttttgggtgacacataaaatacactaacactaacgataactgatgaggtttacaaaaattgcaaaaaaaaatctcataatgtttaagaaagtttatggatttgtgttgggccacattcgtagctgtcctgggctgcaggttagacaggcttgttttagcaaatggcaagatttcctccttttttaaggctgagtaatattccattttgtgtatatagacatatagtgtgtatgtttactatattttctttattcattcatcagtcaacagacaattaggttgtttccatatcttagctattgtgaataatgtttaggccatgatcttaccactacctagtatcctatactaatacttaacactaataccccaatcacaaatactttaatgaacaaaaattattatgcttgcattttctgctacatagatttttatacatgcaaacttactcaatctctgtaaaatagcaagtgtcagaagaaagcaaaaagcagaatcccaaataatttttcctagtaatacacaccagtggacttcaagcaagaatcaagctgcctctgtgcatgggatcatctccatagggtgcgtagattactactaagaatgaaaagtaacagagacatttggccttaaacttgctatttttaaatcatgtatcttcccatccggaaacttaacgcagtattaacatataaatttaaacatacagaagcaataagaaaatatcatcagaatgtattgttattaaactaaaaaagctaattcactcaacagtttctaaataccaaaataacatactctatacaccatggaatactatgcagccatcaaaaagagtgagattatatcctctgcaggaacatggatggagctggaggccattatccttagcaaacttaggcaggaacagaaaaccaaatactgcatattctcacttataagtgggagctaaatgatgggaacacatggacgcatagaggggaacaacagacactgggacctatagaaggatagagggtgggagaagggaggggatcgggaagaataactaatgggtactaggctttatacctgggtgatgaaataatctgtacaacaaaactccccatgacaaaagtttacctatataacaaacctgcacatgaacccctgaacttaaaataaaaattaaatttttaaaaaatattcattgtccattccttgattacattatcatatttttgttaatacaatcatgtgaaccatgctatgaaaattgtatatatattggttaaaatggtctagaatcctgagaaaagtcaataattgaaagttaccgataggacatacatgtctgagtctcgacttgctgctcatactccctgcatcacacttcctatgtgggcccatatttctctgctttctattgcacattctaacagccagtaccagatttccctaaaatacattatgtctgcatcttttaggttcagttcaactgtctgttacgggggtggcagtgaagggaataaaaagaagctctcttaacaaaagaattctgataagagatatattctctagtgaatcatcctctgaatgttaaccatcacagtttataggatatttaccccgtaatctctttattttccatctttaaaagtaccctattgtggtatagcagtagtctcgtagagcaattttatggggcagcaaatctttgagaacaattttctatattcagaattaaaacacgcttcactctttttaacaatggctctaacaggataaaagcttgattccaaaaccacaggagtcattcattttctcttctttgtgtcggtcctaaaataatttttcccctgtgaaaatcacatgagctctctgatttttttccatttcatatttgttgatagcatgctattgtttttttttttaaaaaaaatcctttgaagactcttgccatcaaaacaatagcaacaacaaaactctatgggtcttatgagaaataatttaaacaacacttctcaggtaactgaactatccttaccagaaattaattgtgattaatagtttaattcagttctctgaattttattggtaagagggccacttacctaattttcttttctctagtgaaaaaaacattgtctgtattcactctttctttctcatatatcacgaggttattcaactctccctatgaaactatccagttggtcactattacataaattatctcattaagacttgataatgcatttcatataaaggaatgatggcactgaaacttagcagagtcttactgaataatgggtaaatgtcagatccagcaaaattttgaagcctccacctttagcgtgggaattgttaaatatcactccttattgacattgtcaagaactatgaagggcctgaaattttaccctacttataagctaacaaattagcctgccacagtttcatggatgttggcagaagacatgagactgctgggtcagagacaatgggcagtttattactcatagcaattgcattaacaagagtattagcctttttgatggctaattgaatcccaattcccaaaagatgatgtaaaaagttcaggtggcacctgcacatgaagtagcttgtatcacaggagggaaactacaagtttggggaaccccagtgttttaaaataggcaataatccagcctgacatttcccccagaaagagacattatcttttttgtactggaaaaaacaaatcttcctttggcttcagaggaagacctttgcaggcgtatgtttcttgacatatcctcaaaaagataatccagaacaaggcagtcattgcctttgctcacaaaacatgcagaaatgcaaaagactcacggagaacagtctatcaaaaaacgttcattttctcactaaatctgcatctgtttacattttttaaaaatactttaaattgttatacttgttgggaccagtgtgttataatgaagttataaaagtttttttaaaaaagaaatagtaatttccttattctcatacctatagcatacattgacaatcacatttagctttatagtatttttacatttttattttataaaggattgtcatttccccatgtcaggaccaggctaaataattaaaatactttgattcaacaggtaatgattaacaatcaaaaatgtgcagggcaagatgagacatctgtacttcattttgtgttccactctatctgtgtacacaggagtgagctgctgcatccatttttcataattttactcattaatatttattgagtgcctgctgtgtgcctggcatttcacaaggctccaaagacacaaaagtaaataagcttcctcttctcaactcagtataatcttatagaggagagacaaaagcaaggagatgagagatgaaatagaggtatgcagaggatgctaacagacagagtgaagtggcttccaactcaggttgggcaggatggtggggaagagcgtgtaagccttcctagataaattcttaaagaaaaaatggtaattagcatggtaggagttgaagttcagatgagtgtgagggcgagcattcctagtaaagaaagaagcccatgccacagctcagagagcctgctttctctggaaactatgtgtagtttctaagagggccattagagcagagggtgtcaggatggtactggaaagctgaggctggagaagcacatttcaaaccacaaagagtccttaggagaaggagaagtgtgtgtgtttgtgtgtgtgtgtgtgtgtgtgtgtgtgtgtgtattttaaagacaaaggaattaattgtgaagcaggggtattctccattctcttatatcagcatcttcctggtgccttccttctatgactctgtacttttagctcccctgagacccgtttgagttgcttctctcatctctatcaaggttcttctatgatcatttcataggatttatatttggaaagaactgtctacaaaaaaaatagcatttactctaaaaatacaatttgtatttcatttgcacaagtcagaaacttacgtgtttgaagatcaaaagttataatcattagatgatagtgctaccaacctgacctgtgtgtggtatgtgttccaaaaaaagcaaacagaaacttacatcagacagccttgttatagtagttatttttctttttttttaaaaattatactttaagttttagggtacatgtgcacaacgtgcaggttagttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgtttaattcccacctatggatgagaacatgcggtgtttggttttttgtccttgcgatagtttgctaagaatgatggtttttacaaaaaaaaaaaattttttgagacagggtctcactctgttgcccaggctggagtgcagtggtgtctcagctcactgcagcctcaacctcctcctgggctcaagcaatcctcctgcgctcaagcaatcctcctgcctgagcttcccaagtagctgaaaccaaggcacgtgccaccatgccaactaattcctgtattttttgtagagatgaggtctcaccatgttgcccaggctggtttcaaactcctaagctcaagtgatcctcccaccttggcctcccaaagtgctaggattacaagtgttagccactgcacccagtgtccttcaaatttttaacaaaaatcgtttacaaaccacttcaaacccattcactgtcatgaccccttgtgaatccaggctgaagtgttaatgaacacccaaatggtatttattaaaggagattggtaccgccctgtcctgagaaagccactttaaattgcggctccgcaggactgaatgaagtgaagactgagaggagtcatatccagggtatgattcttttagtcttagtcttgaaaaattacaaatgatcattcatttcaacttcaactgcttttgtacttagaaaaatctcacaattcaaactatttttctaaatttctttctagtgttacttaatgcttatctacttccttatttctcaaggtctttgtaatttcttttcatctataatgtagagagagaacataaactaatatgtttctccaaagagctacccaaatttcccagtacaggaagtttttttcaaatttgatagaggtatagagacttgtgtgcaggcttagagacaaaaagactcgaacaaacataaactgtttctgtctttgatttagtaagatttagaaaaacttaatttatgtgacttaccaatttgcattaagtcaatgttattaattatggaaacataaatggtttacattaaaatactcttatcttctactgcagtagtgagagcacagagtgaatttaggaacattagccaacccattgtcaccaatgtaatccaagaatccaagaacattgcaaacggtttatcaatcataacttcttttttttttttttttttttttttttgagacggagtcttgctctgtcacccagactggaatgcagtggcacgatctcggctcactgcaacctctgcctcctgggcatgctattctcctgcctcagtctcccgagtagctgggactacaggtgcccaccaccacgcccggctaatttttttgtattttttagtagagacggggtttcaccgtgttagccaggatggtctcgatcaatcataacttctattcaagatttaactttctattctattaaatgattattactcataaaataaaacagaaacactaatgtttctgactttcacaattatgaaacgaaagtaaaacgtaaagagataacaaatgtttgggaaaaaatattctcatagtcaagtacatacaaaatacaaataattcagattatgctgtgctcttttgaaaatcttgtaacagtgtggcattaaaaaaaaaaagcatgatgcttgccttgcacctttgcctgtaaaatatgcttttatttgcaaaatattgtccttttccccaatcactgtgctgtatggcagtgttaacattttggaggtcagtgaagagttttgagctggtagcctgagttccaccattactgtctgtgtacttcagtgtcctcatctaagaatgaggataagagcacctctcctgtaggcctatcaggtctattaagtaaattgacataaatgggatgtctgacactgctagtgctcactaagctttcagtattatcatgagcctaacactctgctacttgatatgtgattatatttgacccaaagtaagctggtaagtgctaggactggccttggcatctgtactctcagccttttccatatcctgcaggttttcagttccatcagaacatggaccagaatattgtaaagtagcagttactctgaacgtacatttctttagccaaaaacattagtatttaatatgaaaaataattcataaaaatatatctcaaatatattcttccaattaatacattaaagactaataaggggttaagatgacaatttttattgctgcccactggcagagtggtactatggctaataagggttgctaaacccacctagaaaagtgttctcctaaaacatgaggaatgtcaagaaaattccttctttctcctacaatcttgactccattttcatgaatctctgatctcttactttctattgggatggttacaatactagtagaaacatattgcaatatccagtccagtaggtgttactaactagaaagttatttagatttcagatttctaggctctgaaattattgcatggtttattcattgtataatgcagaccttagaatcatgaacttaactgtaataaataattatagatttttctcagtaagaataaactttctcaattccctatcatacccaccccttctggtcccattcttatatagatctgtatccacaattctcaactctcctattggatgctagaggattataatttgctgcagaaaatggggaattgttactaaaccttgggaaatgcaaataaaaccagaagcttctttttaatctctgtactagtcttgcataaaaacaattgtttgatctagggataaattgttactcatcagatatagtatagtggaaacagagttgaaagcagctacttggtagtcccattgaatgagcttccaaaccataaatctgatccaatcactcactttcttaaaatcattcaaagcttcctatcacctattagaaaaaattatccaatctgtttggtagagtataacaaactttccatgactgattccctctccattcccaatctcatctgctactacttgccatttggatttgggtataattcataatgatgaaacataaaaagttttaaagccatgaccatttggacattgtagccttataagagtgacaaagggaatatttacaaatatgaaagtcaaaattttgttcctgatgatcagaatgcttcccagatctctgaaaaattaatctaatcagttatcagaaagaaaagccctaggcaaacttcttctttggtaattcattttgataattacatatcaaacttctagaaagtaagatgaaaattcagatctttatcaagttaagcaaatttttttaacacatatcgtcgaagtcatttcaaaagcccttggactaaatgcaagcttaaccctgtatccaccacagaataaaattgtgctacattatatgaatgccagatagtaaattttaaataatttcatgatgtttcttatatgtagcctgagctttctgcatactgactcctctgtaaatgtacgtaacattcaataattttgtctatactatttcttttgtaacaaatctttaagtatatattgcgcagagaagtctcattctcatgaaaatgtgttttcttgcattcatttaaatttttagaaaagaaatgtagcaaaattttcaagttttttcttaatatatcgttttaagaactataaacttacatgtattattcttgttattgatttgtaggacattaatatggtgtttcagtaaatttctttaaatagctcactttatggttcagatctctatctaaaccgggaatactgtacttcatcatcctaagtagttccttgattattaaaactctctaataatatgttcagaaattaaaacaaagatactttaatataatattctttatgactgagactttgaagatagcaatgaaatatttatagtttaaaaactaaatacctgaatttttcattatattttcccattcctcttgttaatcaacattagtgaatttttatttcatgtattctccagtctttatataatgttttcacttagattatgccattttaacatttaccattttactggctgtcacagattgcttataaacttcataattattcaaatgaattatctatttgctaatggtaaagaattcatctaagctttgcaaagagatcgcagttgtagaaaattaatatctcactaggtaattacaataattaaaatacaagagaaattaaatgcaagcaacagaaacaaatgaatgctacattgactaaaataagagacataagactatttttattatggagaatttataaaatagctatgaaaatataattctatttgaatcaaattaaaccatcttcaagacaaatcaaattattataaactacattatattcactatattttagtgtttggatattgctgttaacctaccagtctttttataactgtgggctgagcactacataaaattaaatgataggcagttttcccactcaaatatttctatctaaggtttaaagatataagtaaagaatagttgcatatccacttatgagataaacaaaaaagaaccaagctttgagatgaaagtcccattattaatagcaatacatttatgtgtatatatatatatatagtatgtatgttagagaaaggagagagtgaagggagaaggggaataaaagcctttataaattaacatttgggtaatagaatgttttttaattctgtaaatctcaaagatgaggttaaggaaatcacaaatctcccacatagtaaagcagcaaaaaggagagtgaaaatagacaagattagaaaagtaccagatcagtacaccacttgaacatataattaagaaatgatccagaaaaagagaacagaggtggaaaagagggagagaaaacagagaaatggaaggaaataattaacaggaaattattttaataattctaaatatttcttggaaatgagagactttggttccttaattaaaaaaaaaaaatacagcttttcatcctgaagcttaaaacactggaaacaaagagaagtttctaaaaattctaaaccagacaaaaactaacactattgttatctaatattatcctgcaccattatgtactaactcatttaatacatgattctattagtagaaactattatgattgccattgtacagctgaggaacttgagggaaagagtaaagaactttctggatgtcacccagctggtaagtagtggagctggaagtcaaaccaagtagtcttcttttagagtttatactattaaccattacacaatataggagtccttaatttagagtgagagccaagataaattcccaatgaattaaagagctaaagttagaagaaatttatgaaagtattaagaagaaagtaggagaaaatattttaatattactgcaatgaagaaagacttgttatcaagacacaaaacccagaaaacacaaagacagatttgaccacgagaaatgaaatactttctataggaaaaaaaaaaagaaattaacaaaacaatgagatgtagttttttgtattcaacttggaaaaaagatttttaaaaatctaataatattcatatctaatgttaagaaagaaagtacttttatatccgttaggtgggaatgtaaattagtgcaatgcaatttgacagtttatgtcagaaacctagtgacatataacagccattaaattaaaactaatttttttgacaatttgaagaatcagaaattacatgccatatttaatcattgtatgtaattttaagccaaattatataatttcacaaacaagtgcaaataccttccagaaaaaaggccaagaaaataattgttccaacgtccaaacccactaaattatgtacattaattatgttcagtttttgttaccaattatacctcaatgaagctggaagaaaaaaagtccctagaaaaagaaaagatgttatgaattaatgtctcctgattcattttgatttttatagcttgttatagactgactttatccccccaaaaatacataggttgactccctaaacccacatacaactgtatttaaagataagatctttgaagagataagtaaggtaaaatgagatcatatgggtagaacctcatctgatacaactggtgttcttataagaaaaggagattaggacaactgacatgctcacacacagaggaaaggccgtgtgaggacacagcacaaagatggccatctgcaaaccaaggaaagaggcctcagaagaaagcaaccctgccaacaccttgatcttggacttccagcctataaaactttgagaaaataaatgtggctgaagctacccagtctgtggcattttattatggcagccccagcagactaagacatagctttacctgtttgaattgttttttgttattcagcaacacacttcacaattttgaaggaacgtgaatcaagtcttaaggcattgagttgtgaaaattgacattacttcttctctgaagctgtactgtatcctaaagtgacccatgtgtttaaagaacttctataaggaaaaggagaacatgttcagggcaatgctttggcttctgtttccaggaaacctaggtctgacttcttctgcactatccagcttggcaagttgttaaatacctctgagcttctaatttattttttttccacatgtaaaatgaagatatgtgtatgagtaagggttttccagagaaatagaaccagtaggatacatatagatatataagaggagatctattatgggaattggctcaccttattatggaggccaggaagttccatgatctgccatctgcaagctggagacccaaaagagccagaagtgagacacagtccaagtctgaaggcctgagaaccaggaaagccaatggtgtaggtcccatagtccaaaggcctggagctctgatgtctgagggcagaagaagatggatgttccagctcaaacagtgagaaaatgtgccattcctcctctttctgttctatccaaatggactggatgatgcccgcccatattggtgagggcagattttcttttcttagtctactgattcagatgctaacctgccctcaaatacctacacagacacactcagaaataatgtttcaccagctatctgggcattctttaacccattcctgctgacacataaaagccatcacaatatgcaatctcactgtacagagttgatatgaggatttttaaaatatgatttctaaggtacttagcactggatctacatgaaatacatgctcaatgaacagtggttattatattatggcttttctacatcactgtctttatggattgaaaccattgatcttcattccccatttctcaaatgtgctgaatatgagcctggacacccccaacaaatctacttaaggtcatgaagctactgagaccctgagatctccaaaggaatttcagaagcactctaggagagcacagtgatcaaatcataaccatactagtctggtttgacttataattaaaacaaattgagtaaaattcagatacagtttatagaaaagatgttggcaataagtcctagtattgctaagcataattaatatatggtatattgattttgtatcctgcaactttagtaaatttatgtaccacctctaagagttttttagtggagtctctagatttttctaaatatgagatcataacaacttcaaacaaggataatttgacttcttttacaatttggatgccctttctttcttttgcgtaattgctctgactagggcttctggtactatgttgaataaaagtggtaaaagtgggcattcttgttttgttccagttcttagtggaaaggctttcaatttttccccattcagtatgatactagctgtgggtttgtaaaaaatagcccttatttggttgagatatgttccctctatacccaattctttgagggttttcataatgaagcaatgtagaactttatcaagtgcttctatagcatctattaaaatgatctagttttagttttagtccttgattttgttgatgtaatgtatcatgtttattgattgttaaaccatccttgtatcctgaggatgaatcccacttgattaaggtgaatgatctctttaatgtgttgtttaattctatttgctactattttgttgagaatttttgaatctatgttcatcagagatattggcctgtagttttctctttttttctatatttttctggttttagtatcagagtcatacttgcctcatagagtaggtttggaagtattatctcctcttcaattttttgaaatagtttaagtgaaactggtattactgataggcaaaggttggcagtgattccactaggtcctgggcttttctttggtggaagacttttattactccttcaatctcattattcattatggcctgtcagtagtgtttctatacactaacagcgaacaatctgaaaaaaaaataaagacagcaatttcatttacaatggctacaaaatataaagaaaacaatttcatttacaatagctattaatacaaatataatacctaagaataaatttaaccagagaagtgaacatctttacaacaagggacaatataaaatactgatgaaagaaattgaagagtacaaaaaaatggaaagatattccatgttcatggattggaagaataaacattgttaaaatgtccatactacccaaagcaatctacagattcgatgcaatccctatcaaaataccaataacattcttcacagaagtagaaaagacaattctaaaattcacacggtaccacaaaagaccccaaataacgaaagctatcctgagcaaaaagaacaaagctggagacatcacagtatcccaattcaaattaaactacaatggtatagtaacaaaaacagcatggtactggcaaaaaacagaaacacagaacaatggaaagagttgaggacccagacataaatccacgtgcttacagccaactcatttttaacaaagatgctgagaacataccttaaagaaaggacagtctgcttaataaatggtgctgagaaaactggttatttatacacagaattaaactagagtcccatctttcaccacatataaaaataaactcaaaatggagtaaagatttaaatgtaatacctaaaacttcagactattaaaagaaaatattggggaaatgctacaggacattggtctggacaaagattttggggagtaagaccacaaaagcacaggaaacaaaagcaaaatagacaaatggtattacatcatgctaaaaagcttctgcacagcaaaggaaaaaaagctaacaaataaatgagacgacctaaagaatgggagaagatattcctaaactattgatttgactaggtattaataaccagaatatataaataactcaaacaactcagtagcaaaaaaaagcaaaatgtaaaaataagcaaactcctgaatagacatttctcaaaataagatatacaagtggcaaacagatatgtagatataaaagctcaacataactaatcattagagaaatgcagatcacaactacaatgggatatcatctcaccccacttaaactgttattatcaaaaagacaaaaaataacaaatgctgtcaaggatgtggaaaatgggaatgctcaagtgttgtgggaatattaagtagtacagctattatggaaaataaaatggagatttctcaaaaaaactagcaatcccacttctaggtacacatccaaaagaaaggaaattagtatgtcaaggaggtatttgcattcccatgtttattgcagcatcatttacaatagccaagatagagaatcaacctatgtccataaacagatgaatggataaagaaaatgtggtacatatacacaatgcaatgctattcatccataagaaagaatgagatcctgtcatttgcagtgacatggatggaactagggtcattatgttaagtgaaataagccaggcacaaaaagacaaatattacacgttctcactcatatgtgagagctgaaaatgtggatctcctggagatagagagtagaacggtggtttccagaggcttggaagggaaagtggaagaaggagataagtgacgttggttaatggaaacaaaaatacagttagatagaaggaataagtttcagtattccatagtatagtagataaattatagttaacaataatttattgtatttttcaaattagctagtaaagaactccaatatgtccaacacacaaaaagagataaatgcttgagatgatgaatatcccacttaccctgacttgatcattacacattctatacatgtttcagaacatcatgtgttctctcaaaatatatgcaactgtaatatattaataaaaaatatacaaacatacatttaaatagtaagtttatttattacaagatgtcgtagagagccctgggttgcttctacttacatctggttttcacatttacttaactgcccaattattagatactctgtatgtattagtccattttcacactgctataaagacatacccaagactgggtaagttatagagagaagacatttaattgactcacagttttgcatggctggggaggcctcaggaaagttacaatcatggcgaaaggggaagagtcacatcttccttggcctcaggcaagagagcaaatgatcaaaacaggaccttgccaaacacttataaaaccattagatctcgtgagaactcacccactatcgcaagaacagcatgggggaaccaaccccataatccagtcacctcccgtcaagtctctccctcaacatctggggattacaattcaagaggagatttgggtgaggacataaagcctaaccatatcaccataagaagcttctgggccgggcgcggtggctcacgcctgtaattccagcactttgggaggccgaggtgggtggatcacgaggtcaggagatcaagaccatcttggctaacacggtgaaaccccgtctctatttaaaaatacaaaaaaaattagttgggtatggtggtgggcgcctgtagtcccagctactggggaggctgaggcaggagaatggcgtgaacccgggaggtggagcttgcagtgagccaaaatcgcaccactgcactccagcctgggcgacagaacgagactccgtctcaaaaaaacaacaacaacaacaaaaaaaaaaacagcttctggcccccaattcattgcagtaagagcctgtgaaataaataaaagggctctcttctgtacccaagtcgttccttccattctgtctccaccatccatccatgcttacatctgcagcctgcccgctccttttttctctaatggctagaagcttacttgttaaaggatgacagcgtctcctctgtgtctatctaggcccaactgttaatgctttgactctgggctgcttgtgtcctcatcagatgactttgttatttatttatcacattgtttgttgttttctttgttatttatagggacagtacccttttatctcccccagattctaacaaagtaataaaacacataaattcaaactattaaatagctttaccaggcccattgtcttttaccaattaatactgcaagttttatgctttgggatctttctgactttctacaaaaacaatttccttcatagtatatatcaagaataaaatcagtgttattaagataaaaattcagagactagccaaaagggaacccttgttggtcattctgtgtcagcaacaatgcatttcttaattcctcgggaaggagaggatattcacaatgtgttgtcagtctccattttttcttccattcataatgtgaatctctggtcttgcatttcaatttgattgttattttctactgaatttgtgctccttctagttcattactggtttggattttttatgatacagcagggaagcttctttttaaggctagagtggttttgcttttattgtgtgatactcttgagttcctggaattagagagagggtcatataattttggcagaataaagcaaatgttttaaatgtctctgtagccaatatattttcttatttatggaatgggactacatttctagggcatgtatacataccttagtgagaagctggcaggtagtggtagtatgaatgtcatttcagagtatacttgaactatgagataaatgtgatatgttttttttttccccagattgtcaacattacctagatatatgggtagaaaatagtattttctattaaaacaaacatgaatgcacaatagattagaaaaggtaagaggacttttaaaataaaccaataaccattaacaattttattgcttttaaattgtagcatcccttagattccaaagttacatatttgccttatttgtctttagtgggtgatctggaggaaaagtttaggaagcatttaactagagtccttgtatagtgtgatgagcaaggctgttgcatcaggtttttaattgaagccacagagttgatttttattttgttttgcttccatcaacactgtctaggggcataattcaaatgaacattgaaaaaatgcttaattatttcttttttattctcatactcattgttgccaaaatcagacagcatttacaaaaccttcatatatagagtactgactgaggtatgctatttttgtaatatgtattaaatagcatcatttgtgaattatctgtaaagaaacggttgcagtaagaaaaatcataatttaatttctaattagactagaaattcttcacagaggaggtgaagaaagcgatgctgaccttgagggggagaatattctaagtatgtcatagtgaatgtcttagtcttttttgtgttgctataacagaataccacagactaggtaattaataagaaaagaaatgtatttgttacagttctggagaccgggaagtccaatattgaggggcccacatctagtgaggtccttcttcttgcattatcctgtggtggaaggctgaggggcaagacaggatgagacagcaagaaggagcagaactcacttttatagcaaagccacttctgtcataattaacccacttcggtggcaatgaaattaacctattcatgatgacagagccctcatgacctaataacctcttattaggccccactgcccaacactgttgcattgaaaattaagctatcaacacacaaactttggaggacaaatgtgaaccaattaccagtgagagacagcatgttgagatggtggagaaagcgcaggtgttcagcaaaaaaaaaaaaaagtgcaagaatatcacccctttagtgcagaaaaaagaaaattaacatttattgcctatctgtcatactaggtgtctcctatatgttgtttcatttaaatcctgaaaataccttgggaaactatattctccccatgcagaaaaaaatgaggctccaaaaggcatggaagaactcatgtctgtctgtttcaaaagcccatggtagtgggggagtttgcacactgtgcagaggaagttatttgtgattattgaagtgacatgtacagttttataacatgctcttctaagccccattggctttcctctgtgaccctgtatagcactggctgtatggactcttgatttgatgtttattgttgtctgtctttgaccatcattcaaaacagcatgtggactctaaaagtcatacttccacactttgcctttcctgtggagcctggaattttttaatagatgatggttaatattaatcgcatgattgactttttacatctaagattctaggatttaaaaaaagtgttaataagcaaagtctaatttgaattttctttttttatatttttttattataacttaagcttcacttctcagcccacaagtagtgtgaattaaagctgcctcagcatttgttctctttcagatatgtctaaaactttaaaaaaaaaaaaaaaacaggataaaaccaaggccaggagcattatcttaatattatactttccagctatcttatgctgataaatgccagtatccccaattacagaaactatgaattgtcatctagagtcaatggtaagatgagacaaaatcatcaaaacttttaagtgctttttcccatatcagcttagtgtatcagaactttgtcatttcatcatgccaaaatgccacctccttagggaggcctttgctgacctccctagttaccaatcctatttggcgattaccatgacatggtggcagcacttagcatggattaactcattgatttaatactcaaaaggatcatataagctaagtgccactataccatccagaatttttagatagggaaacaaacccagagatgaagtaattcccttaagatgggttacaagctaggaagtagcagaggcaacatatatacctggtgttctagctccagagatcctacttctaacctctaactactcccttaaaatctcccctagcccctcccctagagcctccccagctcctcccccttccctaatcccttccctagctgctcccctaactcctcccctagttcctcccctaattcttcctgcagctcctcccctagttcatgactgcttctttccctagcccctccattagctcctctttccctagcccctaccttagttccttccctagtccctcgaactcctccccaagcctcacccctagattctcccctaactcctcccctagatgttctcctaactcctcccctagctccactcctagtctctccctagctccactcctagtctctccctaactcctcctctagctcctccccatcccctcctgtgtcgctccccttgtccctcacctagactccccctagctcttccccactctccctaactcctcccctagcttctccccgagcctcatctccttagctcctctcccagtctctccctaactcatcccctagtccctcccctagtctctccctaacccctcccctaactcctccctagcacttcccctggtcctgcccctagtctctccctagctcctcccataactcctcccctagcccctcccctggtctatcccatgactccttccctagtctctccctagcccctcccctaactccttccctagcccctcccctggttccgcccctaactcctctcctagcttctttggtaatcactaccttaacccatcctttaactctcttaactcctcccctcctctgccctgcttcatttttccttcactatatcatcagggtcttgcaggaaagaagatgcactcagctgagattaaaagaatttgatgaggaggctgcttcaagagctgggggaaccgatgagaaaatgcagacatgcgcaacagcaggaagcatcaccaccctcaggcctgcgggccaggcgaggaggagtgcggggcaggaccctgggagagaggggaaggagggactagtagagcctccaggcgccgtggggcagaaagttctggaagctcagaggactggcggtggcagagccaggggcgtggggcaggaggtgcgagggaaaagcccctcttctctttgatcccctcttgctgagcctggtgcactttccttgacgtggacagcaacagaatccaggacatagtgaatctaaaacaactttttttttaatgcaagatttttctctcagtattttgacatttaaatggttctaccgctaagtggttaagtggttccgttctaattagccttttaccacccagttcatccgagtttcctccctgcatcccaagcttcccacagtgagagagtattttccacgtcgccaaacacacctggcaatagaacaggctgaaagcgagtgacattgccaaggacagagccacctgcggagcctgacacagagatggtcggtgctcggcgttaacagattgtcttctctgtgttcctcgcccaggcgatcagatgacacacaaatcagactcagcacagtccctcctttgggtaaaatagaaactctgaaagagcatgacttactacatctatttttcttctccctctaagctcatccattagatacaagtcattctcaagtatgaagaataattgctggcttaaaaaggatgagggggaaaaaacaaataaagatgaggaaacgactggaaagttcatcagaagctttagttagcatgcatgcgtttctctgtacattgttagcattctgaaaagttttcggtaatcacttctgttttcggtttgcgatagactatttctcatgcaggggtgcagctgaacaaccaaaagcatagacagaattttctttaaatgtattttgtatggaatttaacttttggccattttggtagccatcgagcttaattgtttgggttaaccatatcatgaagtgagttcagtgacggtgactcacacaccggctaggataagtcagaatctctatcattgtaaaagctttctttctgataattcatggttactggttagggtaaagcacagcttgcctgttcccagagattttaagaaagtgtgtaatttgcttttatatgctgaaattgagcataaaggaaaagaaagcagcttacaggctctccattaaaaacagctttttctggggaaaagcttttctgcttttatttcaaaagttgaagaacagcagaagtttcagattccctagaaaatctacctagctctctggcatccagaatttttggcaaagtacatttggaggaaatattgagctctgaatacattttaattcatcaaggatcaaggcaacaagattgctcaatttttaccaacttatcttgagctcaatattgaggatgtgaaagctgctgccttgtttattgttcttaaaaatatagatagatagataatagatagatgatagatagtgtatcttttgtgcttctgaatctgtttctcagtagagctctcctttcttcctctctaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagttgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaaaaaaaaaaaaaaggcttcttattagcaaaagtatatgtaatccagtctgttcctaacaagtgtaagcaaaaatgtgagaaggggaacattcagaagcaaaagaaccagtctagctgtcctacacatcatgtcataccctgtctttctggtgagcgtttccttgttgctgacaatgttgctccctgtggccatccatctgagctacgtgaggaggattccatgtgaacgccgatcagcttccatttaaccttgagagaaaagagaggttctaaatgaagaactctttaagaaagaaagaatacacccataaagaactcagctattttgcagtaaagagaagaacaaaatgggtacaggattgtggatatcatagatgctgttctcacacaaccactgggggcttgtaatttactgtgtaaccagaacttgcagggctttattttttcttttactggacacaggttgtctgagattataagaaataaaatagatcaataattttcatcatccctgacactgattacaaacctacagtgtttaaagggaggtagtgaattccacggaaactgagtttggctaattcaggtcaacaaagatatatttgcccttaattctggagttaagtaaaaataaaaattatcctgcctgaatcatctgatgctttgtgcctaagatggttatctctcaaatactctagggtgggtttaaagaacagtgagctcaggtcacgcaagatgaaaacccaggttttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatctatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacatgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccagggtcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaaatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattatttttaaatctgtctgtgtgatttttccccttggtaaaaatacatgaaatacataattgaaaaattaccttcttctgaagtcgtagtttttaatcttaaccatcaataaataaacctattgttaacaatgtcttattcataattctaaaaaatttacaaatgatattgctatgaggttgtgcactattaaagtttgctccatcacttaaaggtaaagcagttcaaaaatactactttacatcacaactttgcatggctgagattttgaacaactaaattgatggttttacccacaagttatttcataaagctaacactgtaatattacttggttttcttatacttttgttatcatgtgatgaaatgtaactatgtaattaaacaaaattctgacaatcatattctgctaatgtttaaaatgttacttattccttcacttattagcttgctattttgaaaataaagtgaaagaaggccctttattaaatgaa

SEQ ID NO: 1228 - DNA, 294230 bp, Homo sapiens
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcgaggttcctgcttccccgaagccgaggctgagagttgacagcgtgcaccctgccgcggtctgaattctttttaaaaagcaagaccgatgctgcgtttttatggatacccttttcttttctttccccttccccgaaatgctatgtaatcttcaattactttttaaaatataacgtggaggtataaatcaccccggtaagaggtaccttttaattacgaggtgcagtggaagagctgaacattggaatctagctgttagcgagggcggaggggcaggaggatgatttacaaacatcatgtaagaatttgagcactgaattatgtttgagttagggagatcccttacaaaggaaattataaccagtggacaattgtatttcaaaccgaatctattaatttcatgagccgtttcttgattgagtgaaatgtctgtgaccataatagatacagaactagtaagcaccttaccagactatgacccatttgttagcaactaacatacacatgtaaccatcctgcttacaaaaaaaaaaagaggtacacaaagaaagagtgggaggagagaacctctttttcaaaataatctttgtgaaagaatctttcacaattttactcgataaataaatgttcattttttccacttgtctttcttcatcaccttaagccccttcatcctttacatatctttgcatttagacactctcacacttgggtaagttcttctataatttatataacaaataacaaatgatagtggtttgaatcttgcttttgactaagcattaaattgtgtttgtattaaaaaaaatctccttgccttcgtagcaaactcttaacttttgccattgtgaaaagaccaatgtggttagatgcaaaagagcctgaacttttttttactttaaagcagtttatatgtccccattctcttgtaacttcagcttcacaatatcattcactattttatctgaaaggaattggcatttttcttttctgtcttaaaatagctcacctggtgttgtgaccatgtgtatgagaatactctataaacacacaaatcacttccccaatatcagaaaaactaaaggaaatataaaataaaataaaaagatgtgtatctcaatactttaggatttttttaaaaagttttcatcacgtaagttttagaatcttcttttcatgtcttttgttttgcattaaacacatcataaagaggtatgatttgttgacttgttataggattaccatttggcaaaaacgcccaagacacgctgtttcaaatatgtggtattacttctgctttaaattgcgtgtaagagattgcaaaccttgttccagatggataaattgataaaatgctagctgctgttgggagaatggaaaagccctcagcaaaaaggctctgtggtgtagctaagtacattttgaattagggtgagcaagctatggagaccccagccgtttgtgaaaaaatatacacagtccaagcacgtccactttaagacgttgttggatcctccgtgacaagatgactcctttcccacaaagaagaaaccgtttccttattttttcagttacttttccaaagacaacttgcatcgggcgcaagagagcagagttatgcagaaatccaaccgtaaccagctcagagcgaggactcattctctctccttccaccagatgttttttaggtgtcctcagctggaatgcccagtttgaaactaattaggccagcagtaaactccttgtataataaaatcgcaggccgtaatggtgaataagtgaggttcccagccgcttatgacagatgcctttctgggcagagagagaagagagcctgtggctgtcaggagaaaatgaagggagtggaggtgccttctttagacacatgcctttcctaagtatccacgcacatgatcgcagagcggaggagtggaagttgcgactggggtagagttttgtctttgctgggcaggcctccttcatacaaagatgcttgggggagaatcaattataagtattaggcagtgtcttcaggtcttaggtgtatgctgtgtgtgtgtgtgcaaaggcttggggagaaggattggtgtcacgtgcggggcagtgtaaaaaacttaactgcttcccacctgggcacaaaatgaaaagaaagactgcctggcctgacataaattccttgggagagaggagaacctgctcccccagagacttttgataaagggagaattcgcctaatgatgtggttccccttatctgtgaggtttgtgagggtgaaggagttggttagtctgttacctccaaaggctggactttctgactaagactgggttttgttggtggaaggaaccgggttttttgggtttttgtgttggttttttttttttttggttgtttttgtttttgttttttttagctaactgttctgaaaaaggagttggtagactgtgctcaaaaggaatctctttacaaagaattaatcccagagttaagaaaacacagcctgttgacagaaaacacacacacacacacacacacacacacaccacaattcttcactcactcccaaccctcttccctgatctccatcccccaatgtcataacagcttcctgaatggcccacttctccccactatcatttgtggcagttcaaacagtcctaaacatacaaaacaaaaagaagattctggtaagaaaacaattagcagagaattcgctggagacaatgcttcgttttcactgtttgaagatcgtaactggcctaatggtgtttgactaacacccttttctagtcggaggaggataaacaccccctccgtcaggtggtaaatacttgaagtgacagtaactgaggctgcagacccacttgtgttattgtaaatgaatcagaggggcaagaccttgttctttacggcgtgtgatttaaaatcagttttaaggtacctgccaggtgtatttagaggaaaaggcatgaaggaagccacaggcttatacattcatttttagtgcatatttctttttgttcattttcatcctattgagttcctttgtcatttctctgacttgcaaattatacccttctgtttaatagtaatgatgaaaatagctgctgtttattgagaactggtataccaggcctgcagtcagctcttcacgtgtatttttaaagtggattcttgccgcaaccccttgagtattattatcattatttcaactttgttaacaaggaaactgagtcgcaggtcaaatgaccgacacagggccagactgagtgaaaatgaaatctacgcttttgcttctctgcaaagtatgccttatccatgtgcaatacaagctttggctcaaaacatttctgctatcatttcctttggaggaagatgctgaatttggatggttttaaatgcacagaacacagttattttctgaacctgccctgacgttttttgccactgtcgtttgaaatggggaaacaaaatcatattaaatattcaggaacacaaatacaaacctctgtgagccatgacccttaaccggttgggtatggttctgtaaaggaaaatgacggtttatttaagggctaatttgatttattccttcgatactaacactacgcatttcaggtcctaaaaagagtcaataaatttaccggcagtggagaggccctaaaacattacggtaggcgcagcccaagtcaagtttaccggaaggtgctggatcgctatgggtgggtgttgtttcgggttagattttaaacatttggagagcaaagaataatttggaacaggtggtgccgagagtcaggtagctggaatgatttatctttgcctctttgaacgttaagggaggccactggttgcctgaatctggaaccagcaggctgcgggtcagtgggggctgagagactcgtctttgggacaaactttggcaggatccaggggcttcgtcagcgctgtcatcgcctttggatgatagtagtcagaacacagttgtgcctgctcgtgcatttttgaaaagtctgcctctgccttcagatatatgcagaaatctaaaacaggaacttagacgcgccgcaatgccaatttaaacatctttaaaaatgaacaaagtatgtaatagaggttagaaactcttttgtcatttggtatcaatagtgttgtgtcagtaacatgaaaatgtgtgtaatttcaatggcattgcactttcttcttcttttttccttttgagtatctagtaaagttacattttttaaaagtctgtgttcccagatgtaatagatacgaacgtatctacttgcagtcattcagaggagaattgtcaactctctgctaatgtaactaaaggaaaaatgataaaatcaacatatttttccccaaagaatgaggaactggagggtttgactactgtatatggcaacttacttttgtctcgcgtcagctaaatctgtcagttcccctttcttttctattcatctcccaagaatggcctttcataactgaaatacacgtgtattagccaaaagacattttaattttgtaaagaaaaatcatgccagagacagccgggtctgtttcaaccattattgtttctgcagcatgcatactttgggtttcatggtaagatgtgggtttgtcaagaaagaaaattacagcaagaagctatgctgaaaacatatacacttctgtttaagaaatgagaaaaacacagaaaaattccacacagtaattgcttttacgtgagttttaaatgtcattgtttgacttatgtcaaaaagcccccttagccagttctctcatactccgttaccaaatatctcaccttaaaaacagcaaatgttggacttcattttgatgatctttgaggctttcagagatatccttagtcctagtggaaacattccaaatttttagattgtgcaggccatttttttaaggttacttagatatcgattttattttcttgacccaaaatgagaaaacacggggaattctcaaaagctttttacaggctgctattacgagaagagaagccaaaccaacatgtattaggtcatgcgcttgaagtgcataaataagccctatgaaggtcaccaaacagggtgaaaaccactagttctcgttaccttggccacctctaaattcctgcctgttagacgtgtttggttgaagtggacacagaaagcgggtttccgagcccgtggttgaaagatctcaatttgacttgggtcctcaaggcgtccttgtggtaaagggagataggaaggctgaaattctggtctcctccccatggctccctctcacggttccggagaaaaagcaggtactggggccttctcttactccaaagcagatgtttcctacctggtattcggatatgcggaagtcagaagctgaaaataaaatgaaatgaaaatgttccttctggtcagtttcttcacctcccattcccttcctatagtcactttgtggttaaggtattcatggtttccaaaacaattttttgttcccactatgttttctagcatttaagatgcaaggtataagtactcacctttaaatctctattgattggcagcttcctgaaatacagagtcagagagcgtgtccaccacgtcctgagtttggtaccaacccaggtgctgatggaaattccaagtagggagaaaacgtcctcttcggagaggcagggtgtcagcgcaaagaggttattttcttttgtgggtgtgtattatttgcacatatcaggacttttgtttcagggtgttctagaaacattgatctctccagcaaagttctgcgtgtccttcttggttgggaagggagcggagaggaaggagccccgaggagaatcgtgcacctttggccttttgtgtgactcctagagtagagggaagcctccgctgctcggaaggtgtcacgtggtataacaagttgtgacttgtgcctgtgttgtcaacagagttttagccccgtccagacatgaaaaagaatggagccccgaagatgattcacctccggtctgcgatgggcccaagctgtccagtgctctcctcttgctaaacagaccatactccctggaggagttaatggctggggtgtggagagaagaccggtaggaggggagaaagaatgccttaaactcagcaaatgtctaaaacgctcaaaatgtctcagcattgctcaggcacccacaagaaagacaaactgataaaaggacatagaatcaggctttttttgagggggaagcacagagaggttgggggtttgctagaggtttgatctagagtggacaatttttctaacaccttgggacccgattttggaaatgtcttcctgtagccttgctgtcattcctttgtgcttatttttagtgaattagttttggggattttcttttgtttttaagaaaacacagagttgtaagacttgtttgggaatcacaggttttattgaacacttattatttattgaatatttattatgtcccaggcattgtgctgtggaaatactttatatgttttgtctccaaatggcagtagatggaacgtgctgttattattatttctattttacagatgtggaaactgagtctggagagtaacttgtccaggatcacatggcttatgccagagccaggattaaacccagttttgattcctaaccactaggatgtccagcctgctcccgtggtataacaagaacttccctttctccatctgtctgccctggagagctagattttaaagtccttttccacttgcattgccttatggatatttatcgatggttaggtacaaaaatcaggttgagaaagtaagagacgccagcagattctcacaagattttgaatctgcccttgtagaaatgaatgaatgtttcaagctggacctatggaaatggtcgtagcatcactgcagttagtggcctaagtcattgcttacagctgctcttgccctataaccgcagggttgaacagccgtactacaaagaccatacggcctgcaaagactatctggccctttacagaaaaagtttgctgacctctaagctattgcaatatgacaagacaatccttgtagaccagaaataacatgcacttgggacatttcgtataccatttcaatgatttattatttatcaggtgcctccaatgtgcttgacacattgcacagtgataggggaaaattacaagtgacttcattccttcatccatttacttaacaacacttatttagctgtgttctgggctgtttactggagagccagaggtgagaaggaccaaatccagcatctccggtaggaggatcccaatgtgttctcaccagtatcccatggcctcttctttcctgagggtgcagagggtgttgacatgactttttgagctttctaatgtttgagcagcagaatggaagcaacacctcagtctgtagaccctcacccacagaagctatgcctggttcagtaagagcagtgcctcggcttctgcacctgaaaccgcactaggcatataggacttaccagtgccccaggcttactcggccgacagcaactctctgcttccctcaatgcgttgtgcagaatgaggaggaatgtagagaatcagactttccaaacctcagcctgggtactgactttcagcctcgagattaagagcttgagtccaggagccaggctgctcaggttacacttcccctcagtgttaacctactcctgcgtttaacttgggggtaagttaccagacttttcggtgcctcagtttcttcgtctgtaaagcagggtgaataataatgcaccttcctcagaaagctatcgtggagattgagttaataaacatgaagtgtttggaactacggctggcaagtggtatgaattatatcagtgtcagctacagttattattattatttatgaatttgacctgaagcaaattacttagactctttgggatgataataataatagtaacaacaataataaaataacttttcatagtgccattgtgagaatataaatgaggcgatacatggaaaacacttagctttgctacactgcctgcctccattcaatgttcaatgagctagctattgagattatggggaacagtgcactggatcagtgcggtgtctataagctattgatcagttgagtcattttaggtatcgagagaatgttgggcagtggtcgatagcacaggccctggactcagacagatctggcctgagcctgagtcagtccatcactcacggactgccatctccagcaggggtctgaccctctcaacgtcccagacatcggagacagcagttaactgttcctggggtggttgggaggcttaaaagagtggctggcacaccgagcacagagcagggtgtttggcacatagtaagcactcaataaatggtagcttgtattattaccacccccatttcttgctgtacccccacccccaagaaagcactgaacattagtaaattttaatttgaaaataaaagaacacattttaaaactgccaaacagatttaaaataatattcattacacaaaattaaaatattctattaaagccagactttgggctcagaccaaatttttataacccaagcttaaaggccagggagtcccccagccacaatggggacattgtgattgaacttgagacttcaacgctgctattgagcagtctttgaaatgcatgtttcccctaaaataaaagggaagtaatgggaaggaaaaaaatgaggttcttgctcccctcaacaagccttaatgaattggaaaagaaaaacaaaatatttctcatttttctcctgctactcgatcctgccaaagacgcacggcccctcccaaccctggctttgaatggtgcccactcagaaccttccagatctgatatgctatatgagcaaacctaatctaagttgtaacattgtagtcttcaccaggttttacagatggcggattgtatcactgggaatccagaatggggagcccaaattcctaggttcaagtcctagttctgcctcagtttccctattcacaaaatagagacagtcctcctactgcataaagtggtggtgggagtctgaacggttagctctccccatggatgttttaatcttctgctgttacctaatgaatgaaacttgccctgagttctgggactttgaaaaattaaagtatacaggtatgcctctgagagttataaattaaaaaaaagtctattcagggaggagaatggaggagggaagaaggagacataaaaatggctcacaggagttattatgtgacagacactttcacaaagctcatttaatcctctcaaaaaaaaaaaatacatgatatacatgtgtccatttaacaaacatggaaactgagacttggacagatcgagtgactgcccagcggcattccattccaggtctgtgtgacccaaagcatgggcctgttgtaccacatgacccacagccctcctggaacaaggtcacaaacaatcatggtggactggagagactcccctgaccaaccagttatttatgatctattcttacatttcaatagcatccttcatcctcaatgagcctgagttgctgtggccttttaccccacattccattgagaaccagtagattttttcttgaacagcacatggaaaaagtaacgtaagtgggttgcaaaatccttttctggatgaaatccttcaagaatccctgccatttcttgccaaccggaatgaagtgacttcctcctcagaccaggccaggcccttggctatggtgtgggaccatgagacagagttgtctgaggctgggcagctcctggagagggtatggggtcccctctatcaccaacctgctgtgtgtcttcgggcagatcacaagagccctctgagccccaatctcctcatcagcccatggagcagacaccttctatataggatttgttatacgacttaaataaaatgacagtggaatacttagggtactgtggaattggacccattcccaggagtactcaaagaaaggggagaaaatgaaagttacttgccccaggcacattccttactgttcttcaggtagctaccgtttggggactttagacattctggaagaatctgttagtctctgaagggcagacttctttttaatgatgtgggcaccctttccacattaacttgaaatgtacatggacattttttttctttagagttctgtctctatcttattatgcatttggaaaagatataaaaagcatttgaaacaaatggttttacaattttttactgcttaagacaaaaatgatttaaaaaccaagtccatcaagtaattgatagcaaaagtggcacacagccatggcagagttcatgagggaagtttcagaaacacgaatctgatgatgtgaagctttccctgtgatctattcatttaaaataaaacattttagttttaaaactcatccccgcaggctgcgtacgacaaattccacccaaatacccagaaccttttactaaccagaattgcaatgctgtgctgctttcaggggaataaaatgaaacaaatgcagtctctcggggacattggtaaagtcatctcagagtacatcagtgtccgggcacatctagtctgtgtcttgtatctttgaaagaagaataactaacctttggatgactgtaatgttgataaaaaataatctctgagggctaactttatgccgggatatgttccgaaagattataggcattaactcatttattccttgcaataattctacgatgaaagtactgttactattcccagtttaagtgagaaaagtaagacacagagaggtcaagtgacttgttcaaggtcacccagcaagtgcaggggtagagccaggctttgtatgtgggagtatggttctagagtttgtcttcataacccctgacttccctgattctttaaccaccataaaaaattaaactctttgaccctcacttacttgcacaatgaattaattaaggacaggcatgagaaggggctgaaagcgatgttaaatctcagttataatttttcagtttcttacaaggatgtatttgcgtattccattatctttagggtacagtacactacagaagccagtctctccacgttcaaatccactgtctaccacttactagccttgggcttccttcacctctctcagcctcagtttccccattgatgacatgaaaataacggactctgcataacaaatgcattgaagaccacgagacacacacagtgattgttaaaagctattgattacctgtggaagaaaaattaagtctagaaatcatatcttcctacagggcacaaatgcagtttggtatagtttggagtgaaaaagaagggaaaaccgcctgagctgtgaggttcaagctggaaaatagctcaggtttttccagatgccttaagactgagccaaagagaccggctttccatgtctccacatgagaagttaccgagctaagtcctcaacaggcagcctacaagccattgatgttagaatctgtccaggtgaggaagcagcagcctgtgggagggtcttgcccatggccacatggccagtctgtggcagagtggggactccccaccctctttcaagacgagtgagggatcttgggtagcatgggtcagaggtggagaggaacacataaaaacaagcgtgaggccaggcgcagtggctcacacccgtaaccccagcgctttgggaagccaaggcaggcggattgcgtgaagtcagaagttcgagaccagcctggccaacatggtgaaatcccatgtctactaaaaataaaacaattagccaggtatggtggcccgcatctgtagtcccagctactggagaggctgaggcaggagagttgcttgagcccaggaggtggaggttgcagtgagccgagatggtgccactgccagcctgggtgacagagggagactccatctgaaaacaaacaaacaaacaaacaaacaaacaaagtgtgcctggagcgactgtctatgcaaactctgacatcagctctaggctctagtttcatgattttcattttatttcttgttcccttctttacattggggaaaatgtgtttttctctagaagcaactacctggttttcagtggcaaggtgcacagactttctgggttttccattcaccattctcctccactgtgcctcccgcttccatttcctcttcagtatggaaatggcacttatttattcattcattcaaaaatatgtattgagcacctgctgtgtgccaggccctactctggacgtggggaatgcagtcaagaacaaaaatgaccaaagtctccttccttgtggagccacagttaagtaggagagagaaaataaacacatatgtatataaggtacgcagaatatcaaatgataagtccatggagaaaaaaggtcaagagaagctgacgagaacatgcccaggggaggcgagaggaatgcagcgctgaaggaatgtaggagaacattctagaaagaagcggtagcaaggacaaaagtcctgaattgggagcagccagtgaacaaggagggcagggaagatgaggccagttctggtagggccttgctcagaatccagctgccgttctgcgtcaatcagtcatgtccagagtcaaaattatcgtaatttaaaaatgatttttcaaagtacatagagcctaaatctgaaatcaatgactgcaaccgcagatacccagagaacccaaacaggtaagaattagtggagtaggtatgctaatagcagggactccacccggtgccattcaggaatggtctccgtgttgctaggtgttctgatttttcaaaatctgaatttttaagagaaatgtcccgcttttaaaatcactatgaggaaccaccagaaatatacctccaggctcatagtgtacgatccctctcccaaacatcgacacagaccctgggaatcaaatttcagtgaaaaggcactaagcctctctcccgcactttttttttttttttttttttttttttttttttttttaccaattcctgaccagaaaggatgccaagagatgctaaaaattgtttccaggaaaaagtaggacttgaatctcatggggatgaggctgagacttcttccaaggagcaatcagcttgcttcattattatgtctttctcaggagtttttcctgatctccgctcatcatggggaaaggcaagatggtccaaatctatcctccttcgggttttcattagtttcttgatgatgattattatgtcatctggggttgatttaagagtggtgaaatgtttgcaggtctcataaatggttgtcagccactgtttagaatggcaaagaactttttatgttgttcccattgcaaggagtggggtgatagtttccaatggctacagacaaaagggggaaagtgggttctgaagccttttacaagaggagattggaaagttgagtaattcaatgggggtgcaggtgggaggcagtaaggaaagctccaggagctttttaagacctgagatgcctacattgacaatactgaaatcatcgtcggcctccccagccccaaagctgggcttaagcaaaatcccagccagtggtcgccttagctgtggagattgctccagatgtaagtgacaaaaaaacttacttctgagttggtttaagaaaaaagaaaatgtattgccttgggaaatgaaaagttcgaggagggctggtttcaggtacagctggttcaagagctcagatgcaggtcatgtgcccatctcttaatcagtctctctgttcaagaggattctgtactgtgccacctgtggagctgtggatggagtgagagaaaggtagatttccaaagtgaaatcggcagcattttctggaagtgtgggtggactggttccttatatcccccaaaattgtacctataggtatgccttctccacccctctcctcctggactacagtgctgcttatgaaatttgtgctttttccaggcacgatgttatactctttgtgtgcatgttttacttttctcctcaaacattcttactaggtcagtatttttaagacctgctactattctgccctccacatgctcttccccatgggcctggaagattatcttttatttcaagtaagggtgtttgtcttacttatttcaagtaaggatgttcatcttaagggtgggtcatctgtatttgtctgttcttgcactgctataaagaaatacctgagactgggtaatttgcaaagaaaagagttttaattggctcacagttccacaggctgtacaggaagcatgttactggcatctgctcagcttctggggaggccttaggaaacttacaatcatggtgggagacgaagaggaagcaggcacgacttacatggtggagcaagaggaagagagaaagaggcgggaggtgccacactgttgtaaacaaccaggtcttatgagaactctgtcacaagaacagcaccaaaggggaaaatccaatcccccttgatccaatcacctcctaccagaccccacctacaacactggagattccatttcaacatgagacttgggtgtggacacgcatccaaaccatcttatcatctcttttcatggtctctggtacaaaagttgaggcactccagccaagcataggacatgcgctgggcttcagaggataagtgagagatgaatcaggatcactaggagtagaagggttaccctggcaatgcacgcattcccaggcccctgatggtcagcctggatttctttttctgctctgagcttttgctcccgttgctgcctgtattgaactttctcatgctccatctaggggcatggcagtaacatcgggtacacacagaggttgcacactggcaatcaagatgtgttttgtttggtctgcagatcatttaaaaaatagaatggagccaactttgaagatctggatctttcacacaaaaatgtagattgctggctcccatcaaaacatcacaagatctgtcaacactgtgcccacatttccacattaccgcagttgactggggctgggaactgtctgtcccttttaggtggataagttagttcacccaagtcctcacctttccctatagtctctccaacaccgaggttcaggttagttaccatttaccgttgggaccatgctgttggctctcctagagtagatttaagacagaaaagaaatctttcctatatctagatctccattagaagtatgaaaatgaagtgtaaaccaaggtggtccttggtatttacaaaaaagagaaagcatctgtcttcaggtaacacagggtttctcaactttggcactattaagatttggagctggataatttgtgtgtgtgtgtgtgtgtgtgtgtgtgtgtccactctgtatactctaggatggcatttaatatgtccatgtggacatcatgcaccatctagaagtaaataggtccctgtgctccaggcgctcaccaccaggttggtacaaagagttaccataagtgaggaaagctgttcttctgcatggcacccgggcaggctcagcattggcagtagaggttatgagttggctgatttttgatttagtcctaagtggacttgccaaccattgaggctgtttatgactgcctgtttgagatgttatagaaggaattcagtgttgaatgagaggttaaactattttaaagagtctttggagaatttcttaactcttagctgagtgaggccatggtggatgctacttgcaaaaagtttgaaagtagcatggatggaactggaggacattatgttaagtgaaataagccagatgcagaaacacaaatatctcatgttcccacttgtgtgtgggaactggaaaactcgatctcgtggaggtaaagagtagaatgagggttcccagtggctggaaaggtgggggtgatgaagagaagctggctaatgggtagaaacatacagctacatagaaagaaaagttctagtgttcaaaagcacagtagggtgactgtagtcaacaatatgttctatatcaaaatagctggaagaaaagattgaaatgttcccaacacaaagcaatgttaaatgtttgaggtgacggatattctaaataccctgatttgatcatcacacattgtatgcatgtatcagaatatcacatggaccccccataaatacatacaattgttatgtatcaataaataatcttgcaaatagaaggtggagcatgggcagtggttgggcttgttggagagtgagcagaaggaccaaatgacctctggatgtctcttatgtctcctccagctctggttctgtgagctgaggcttagtgagtttcaaaatgttgcctactacatgttcgcaactgctaaccgtggtctaccatggaaactcaaaggcatggatattcagggaggaatctcatttttccctaggctagtactgtgtacgaggtgagacttttttttctttttggccttcccctagtgttacaaatcctgtcgagtgtctgaaataccatccatgtgaaggtttcccatgataactgtaacagctgccattcatccattcaacacatatttattgaacacttctatgaggcagccactgttccaggcacttggcaagcagctatgtacaaaactgacaagtccttgccctcatggagcttttgtttaggggggaaagaagatagacaataaaaaagcaaatagtaagacagtcttggcattgctatggggaaaaagtaagtagaggggagggaggttgatgggaaacattgaggtagaacagggaagaggaatttttaattttttttttttttctttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttaattttaattttaaatagggtggccactgtgatggcatgctggtaaactggttctctggaaattaaaggtcctgatttgtagcctctgccacttacagtggtgtaaatactcccaccatggtcacttacagcccaacagtgattttaacaaggagttcacaacattcatgcacatttaacaattgtttcttgcaggctggtacaggctggctgcagcacatcactggcaggcaaggcctccctgaaactatctggcagaagagcccacacagaagctctgagtggggttgtgcctggtgtgttcaggaatgaccaggagttcattgtggctggagctgagtgagaggagaggggcaggagatgtagttagggaagtagccaggggcagataatgtagggtgtttgaggccagggtcagatttttgacttctaagctgagtgaggtgggagtccctggaggaatgggatctgagcagaggaaggacatgatctgccttaagtagagcagaactcctctggctgccaagagaacagactgcaggggtcagagggtggggcaggaaaaccgttaagagactgttcagacagggaggtgacggtgacttggaccagggtggtggcagtaggatcagggagaagagttggattctagatatgcttttaagatagagccgatagaatttgctgagggattggctctgggaagggatatgaagagaggagtccaaggtgactccaaggcctctgggctgggcatttgggaggatggagctgccctttgctgaaatggggacagtggagggaggagcaggttgggaaaggagatgggagcacctcgtgtggacctggcattgagccaggtgtttgaatatatgatcatctccttctgtccattttatcacgcccattttggaaaggatgtgacagagagttgaggttaatcagcatgcccaaggtggccctgctggtacatggccaggccaggcctcccacccctttaccactctgctgtcctactgtgttttcttggctttctcagtcccgttcctcctcttcgttttgaggaaatgacaacaggagaactctgcagaagaaaccacctaggagccgagacctctccctcgttcctaaagagctgtccagcggttaacgctggacacacatcaggtctgctcagtggatctgtcacccacatttttccctgacaaatttgttggattaacctcatgaagatgaatattccacagtagaactcacacttaaaaaaataggagtcagtggcataaaggctttgatttttctgtggacacaggcttaaatccagattctaccgcttgatggcttctccatgggagcctcagttttctcatctgtggagtgggtgtgtattactccattctcacactgccaataaagacatacccaactgggtaatttataaaggaaagaggtttcattggctcacaggtcagcatgtctggggaggcctcagaaaacttacaatcatggcggaaggggaagcaaacacatccttcttcatatggtggccggaaggaggagaatcagtgcccaggaaagggggaagcctcttataaaaccatcaaatcttgtgagaactaactcactattgtgagactaggatgggagaaaccacccccgtgattcaattatctccacctagtccctcccacgacacgtggggattatgggaactataattcaagatgagatttgggtggggacgcagccaaaccgtatcagggagtaagaagagttcctctctcagattcaaggagataatgggctgaggcacttagcactgtgccagccccatcgtcacactcagcacacagagggaatcatgaccatgattgtttgagagagggaattagaaagttgggttcagttttaggcaaaagctgacctgccttcaaagctggagtatggggacagggggccgtgcgtgggacatcgtgcttgagagctttgcagtttggccttttcttttctctaccggagatgggaggcctctgtccgtgtttctgctgtgttcaccaggaggccagtctggggcaattactgctccccatctcccaaaggagccacatcagcctcatagcagtgtctctagcttcgagctgttgcctgtggcaggcagaacagtgtgtactcgcaacaagcaaatccccagatgtgagcccattcggggctgccacgttttttcctgatgaaattcctgacttggtgtgttgtgtttttttaaaaaacacgcccactgcctccaaaaacctcagccggggaagagaaacatttctcgttgaattcccagtttttgaaacggtgtcaaattatgcccctctcatggcctggatacgccattctttccacttagtgcttttcagagaggcctgggtggcagaacgtggatgttatctaggccagcctttgcattatacaggtggggaaactgaggctcagacaggccaaggaggagccccacatgggaagttggtctcagagccttggtgatacccccagatctcttgattccaggcccactttcttccttcttcatcagaggtcacaaatgggcaggctgcagccacctctaccctacagatgtgctttctttggcctgagattgttttgatttgaatgagttgccggcatttaaaaattaggagattccatataaaaacccagatttctggcttctctggggccattgggagatctgccaaatgagctgtgcattcctgcatggtgacaattgagggtctcagtcatggccactccctttagccagagcatgtcttcatcagttcaccacagtccccgcccctccctctagtacccccggacctgggggctcaatgtcacttgtcatcatggcgctttccctcccagttctataggggtgcagttaagagaaaagtgaagtatttcttgaaactgtgtctctatcaaaaagaaggaaacaaaagatcaaccgaaatgaccacttgtttaaacattaatagtacatagcatgattgctttgtggcagagcaaaaaatttctatgaatttcatatgcaaagagaatacgtcagtgttgaaaatcgctggccccttcactctctgaggttaccttccccttctctgccagtgttacacttgccatccctgcgtgccaaggccatagtttccacttatttttttaaggcagcattaaacttatttgacctacatctgcccccctcctgtgaaacttgaaatgctattaaaccaaattaagaagtttttaaaagttgaaatggtctttaactgctcgagaaagggtgtatgtgaatatgtgaatgtattgtgcagtgtgtgtgggtgtgcatggacaagtatgctgtgtgtgagtatatgaatgtgggtgagtgtgtcagagtctgtgtgaatatgtgtaggtgcttaagtgtgtgagtttgtgtgtgtgtgtatctgagtatgaaggtattatgtgtgtgtgcatgtgtgatgggttcttgatttatagactttgcaccaagtagaattggacaaaagtgtttttctttggctctgggactggcacttctgggctttaccatacatttaagccaaggtgcaaagccaagttggttttaactctaatgccacgtcagtgagctgggttgagattgaggttaaggttgactttcctttcttctgggatatagtggggggcttttggaggggagagctcggggtgctaggctttacaaatgatgctcactttcttcccagagcagatggccagaagagagggggctcacactttgaggcctgctgtgtgccagacattcatatgaagattatctctctactgttcgaagtgagctttggacccttccttatttactgatgtgttcattttggttctgttaggaaaaatatatagagagataacctataaaatacataaattagtagtatttcttagaacaaggctcagtttatttaaggaggaaaaagagttcatttaaagaaaaaatatgttaaatgatatagtttgtggaggtgagaaaatcacaaataattgatccttaccatgtgcaggagtggtcaggtgggcagcctccccccgagtcaaaatcttcctaacatcttgtacttcctcaaagcacttaaacttgttaaatacttaatcgtatatgcttttgcataattttgtctcttttcaactaggactgtttatgtcatttcaaggttgcctttccagcatctagcagagtgccaggcacgcaggaagtgctcaggaaatagcagcgaatgcatgcacagactccctgccaagaggggaattactgtccccattttatagatgaggaaactgagggtcagagtgacttgcttaagatttggcaactaggatatggcaaaacgaagatttgaacgcatgactctcaggctgcacaaacctttttgccaaacaccaatacgtgggactcaggtcagacagactatgaccactggcccattgcaaaatgaggaaagcgaagtggatgtgaagagtttcataaagctacaggcattccttggagatgctgcggggttggttccagaacgccacaataaagccaatatcgcagtaaagcaagtcacgtgaattttttggtttcccagtatgtatgaaagttatgtttacactattactgtacataggccactaagtgtgcaatattattatgtctaaaagaatgtatgtaccttaacttaaaaatacttcattgctaaaaaacgctaatgatcgtctgagcctttagcgagttgtagtctttttgctggtggagggtcttgccccattgttgaaggctgctcactgatcagggcggtggttgctgaaggctggggtggctgtggcaatctcttaaaataagacaaacatgaagtttgctgcattgatgaatccattctcttccttttatgaaacatttctctgtagcatgcaatgctgttttatagcattttacccaaagcagaacatctttcaaaattagagtcagttctcggctgggcgtggtggctcacgcccacaatcccagcactttgggaagccgaggtgggcggatcctgaggtcaggagatcgagaccatcctggctaacacgctgaatccccatctctactaaaaaatacaaaaaattagccgggcgtggtggcaggtgcctgtagtcccagctactcaggaggctgaggcaggagaatggcgtgaacccaggaggcggagcttgcagtgagccgagatcgcgccagtgcactccagcctgggcgacagagcaagactccgtctcaaaaaacaaaacaaatctcactctgtagcccaagctgatgtgcaatggcacgatctcggctcactgcaacctctacctctggggctcaagcaattctcatgcctcagcctcccgagtaactgggactacaggcacatgtcaccacgcccggctattttttttagtttagtagagacgggtttcaccaggttacccagagtggtctcgaactcccgcactcaggcgatccatccaccttggcctcccaaagtgctgggatacagacgtgagccaccagcacctggcctatttccaccacatccgcagtgacttcctccactgaaatcttgaacctctcaaagtcattgatgagggccagaatcaacttcttccaaactcctgctaatattgatatttttacctcctcctgtgaatcacgaatgtccctaatggcatcttagaatggtgaatcttttctagaaggttttcaatttactttgcccaaatctatcagaggaatcatgacctatgacagctatggccttatgaaatgcatttcttaaataataaaatttgaaagtcaaaattactccttgatccatgggctgcagaatggatgctgtgttagtgggcgtgaagacaacatttatctccttgtatatctccatgagagctcttgggtgaccacgtggactgttgtgagcagtattattttaaaagaaacctttttatctgagcagcaggtctcaacagtgagcctaaaatgttcagcaaaccatgctgtaagcagacatgctgtcatcccggctttatgttattctgttcatagagcacaggcagagtagatttaacatcattcttaagggtcctaggattttcagaatggtaaatgagcattggcttcaacttaaagttatcagctgcattggcccttaacaagagattcagcctgtcgtttgaggctgtgaagtcaaccattgacttctcctctctagctatgaaagccctagatgggatcttcttccaatcgaatgctgttttgtctgcattaagaatatattgcttagtgtagccaccttcatcactgatcccagctagatcttctggataacttgctgcagtttgtccatcagcacttgctgcttcgccttgcacttttatgttataaagatggctgctttccttaaacctcctgaactcttggtagcttcaaacttttcttctgcagcttcctcatttctctcagctttcatagaattgaagagagttagggccttgccctggattagcctttggtgtatgggaatgttgtggttggtttgatcttctatccagaccactcagactttctctgtatcagcaataagactgttttgctttcttatcactcgtgtgttcacgggagtagcacttttaatttccttcaaaaatttttcctttgcattcacaacttggctaaacatttgttgcaagaggcctagctttcatcctgtctcagctttcgacatgccttcctcactaagcttaatcgtttctagcttttgatttaaagtgaaagccatgcgactcttcctttcacttgagcactcagaggccattgttggattgtggattggcccagtttcagtactcttgtgtttcacggaatggggaggcctgagcagagggagagaggtaggggaacagttggttgaggtcagaacacatggaacatttatacattaagttcaccatcttatatgggcacagtttgtggtgcccaaatcaattatgaataatatcaaagatcactgatcacagatctccataacagatataatagcaatgaaaaaactttgaaatattgagagaattaccaaactgtgacacagagacatgaaaatgacactgataaacttgctcaatgtaggattgccacaaaactttaatttgtttaaaaaaaaaaacagtatctgcaaagtacaataaagcaaagcaataaaacgaggtcttcctgtatttgctttattgcggtgatctggaaccaagcccacgatatctccaaggtgtgcccgtatactgttccaatttaaaaaatggtctgttatttttattttcttcctattttgaggacgtgacacgttatctttttatgactaaaatttctcattttttgtttttaaatgtttcactggacaaatcaaaatggcagcctccttttgtgggttctcccagtttttttctttgtattgctttttttcgggagggagattttctagttggtggaatcccagagtctgagaatcatcagacaacttcaagctcctctggagatcttatcaggtccattggggaaatctctgagctcccctctgacttctttccaagtcacttcaccatttccccttcatggggtggggccagtgtgtctccctcattccaggccccagggacacaaatgcaaaaaccagagccacatctcaaggatgtgtcctgggacctctccagagggccagagcctgcccttactgattttccagggagctcaggactcatcatctctctgggagaaactggtgccacccaggatggccttggttagtacggcatctcttcatgggctctgctcacctcttttggtttcagcacaatgcagctttcctttccattttcttaaccaattcagatgcccctcatctaactgctaatcatagctccctgttgagcgaggtgtcacctctgaaagtctgcccattgttgaccctgcggtctcttcttccaggcttggaggctgggtagatgccatttctctaaccctgccagaactctagctgtgcccacacctccgctggctcttagtaggggcgccttctcagtggggaggctgacacagggctgtggagacttggagccagcaatgcgccggccctcgcctcagagagcttggagcctcgtaggtgagaccaggcaagcacagatgtttccttgggactggattctaggccctgttgagggctggagggtaacctcttaggcttgcatagtatattacagtttacaaacagtctccacatttattttcctcatgtccatttgtagtcctctgcagtacgtgatgcttatcttgcccagctggcatccattcatctcctggttttcttttctttcttctcctttctcgtttctactgcaccttcaggccattaccccactctccagttctaagtgcagacctgtgacctccccatgggcagtcacaacatgctatgcctctgccctcagggttcaggcacaggaactggacccaggttgaatggggcccaattctgggaactttgctggaattgttgaggaatgatgccctcttttctctgggttgctaaactcatagaatgtagccatcttgcttaggggaagcctgcctgaaactaaaggcaactcaaaggaagacagagacaagatatggagggcaaaagattcccaatgacctcatttgagcacctggatccagctgttcctgaagctagataccatgtgttattcccttatattagccaatacattatttcttttttacttaaagaagtttgaatggagtcttctcccaattgctataaactaatacaggtggttttgcatttactaagttgccctgcttcctctgatcacagtaaaactccctttcatgtatgaaaccctcttgtaagtgttttcatagcaatcagactcatgtctactagacacagcactggcctaatttcagtgaagagggatttgaggcacagaagagaagggaagcaagttgaggctggaacctgcgtttcctaacacctgttctagtgcattttccacttggagcatcctcaccagctttcagtttggagaacagtttttaatacccaggacatcatcaccccggaggacaggagtgctaattgatttaatgaacaacccaagcaaggtcagagaaaactcttaactacatcacagagtaatcagaagagttacactaatggtaattttaggtgcctagaaaatctctggtagataagagaggaaatagttaactgtagttacccaggggaaaggaaatggggaaaaggagattcttagttttttactgtgtatactctactgtacattccaaaatgttttactaggggcaccgattgtttcatattcaagtaaacagtgaattttgaaatgtaacaacagcaggcttccatctgagacaattagagcatcaaatagtgaattataaaccattgaaaaaatacaaacctatgaatatataccactaataaataggtaaataagtaaatagggaggagggaggttttgtgcttacagtcgaatgccgaggaccagctagaattgtgggggagagctgggtaagaaacacaccatgttgcgaccactataataaagattggttcagtcaagaatcatcatcaatagatgctgaatttggggtggggatgttgataaggagtagcattttgcatggtcttaagtgatctcttcacgatggcttataaattttaagagaaaataatagtcactatgcagtgcagaaattggtgatctgtatcaatgtcatcactgagaggcagatagacaggatgtccggagaaggacgcagcatcacccatgcagtattctgggagggtgcatgacccgaatctaataagaaaagagcagacaaacctagaatgaggaacattccatttcaaaaaaaggtaccttcttcttcaaaaatgccgatgttgcaaagtacagaaaaagactgaagaaatgttctagatgaggccgggcacggtggctagtgcctgtaatccaagcactttgggaggctgaggcgggcggatcacttgaggccaggagtttgaaaccagcctgggcaacatggtgaaaccctgtctctactaaaaatacaaattagccaggcgtggtggcagacacctgtaataccagctactcagaggctgagacatgagaattgcttgaacctgggaggcagaggttgcagtgagccaagatcgtgccactgcactccagcctgggtgacagagtgagactctgacttaaaaaacaaacaaaagaaatgttctagaccaaaggaatctgaagggataggacaactaaatacagtacccagttctagactggattctagatagagggggagatgtgatacaggaaattattggtgaattgacaaattgtactgtggagaatggattggttaaaatattgtgtcagtgttaaagtgattgaagtgggtaataaaccggagattctataagagaatgttatttttcttgggaaataccattggaatatttacgagtaaaaggccattatgcatgtaactctgaaatgatgcacaaaagaaaaataatacacgtgtgctgggtgtgtgtgtgtgtgtggagagagagagagggaattggtaagcacatgggtgaaacattaacagcagatgcatctgggtaaaagatctgtgagtattctttgtactgccatcacataggtcagcctctctccaaaacctgcactcttgtttactaaaacagtatttctcaaaacatggaacgccttagtgattttttttaaatctcattttgctaactttcagctcttttaattaagcccaaaagagaatcttaagttggtgctggatggtttggtttttaacaccaaacacttgctaattctctttgtataacaaagagagtcatcaggcaagcagtggcctctagaaagatctatctttcatgggggattcctcatattaatttttctagttatcttctattttttgacagtgatttatatttgtgatttttaaaagttcctttttaggtatattaatttaagtttatttttaacttgttttaggaagtgagtcaattcaaagaaaatattaaggtggtgacagtgcacggtatgggtggcacatggagatggcagaggctgggaaggactaaagtttcagccactgcagctggaaactcctctcaagtttaaaatgtttgggtcaaggtgacactttcccgtctgtggtccctgctttcttaacactatcattcagaaaggccccaagtgtaggccgggcacgctggctcacgcctgtaatcccagcactttgggaggccgaggtgggtggatcgcgaggtcaggagatcgagaccatcctggctaacacggtgaaaacccatctgtactaaaaatacaaaaaattagccaggcgtggtggcgggcgcctgtagtcccagctactcaggaggctgaggcaggagaatggcgtgaacccaggaggcggagcttgcagtgagccgaaatcgcgccactgcactccagcctggccaatagagcgagactccatctcaaaaaaaaaaaaaaaaaaaaaaaagccccaagtgggtaattcctttcctctaaggcagtaaccagaataaacccttctctatcaccaatgcatgatgcttccattatgtttcacctccctaatcttcagaacttggaagaatgagtttggtaatgttagactggaaactcagaccaaggaggctgtgttagtttcctgggactgatgtaaaaaagtacagcaaacttggtgactttaaacaacagaaatttactctctccggaggtggaagtctccagagagcctgcaaggtgttagcagagccgttctccctgagcctaggtagaattcttcctcacctcctcctggctttggtggtggccatccgtccttggcattctttggcttgtagccatgtcaccccaatctctgcctctgtcatcacatggccttgtccctgtatgtcttcatgcagctttttataaggacaccagtcacattggattgaggacccatataactccaatatgacctcatcttaactaatcacatccacaatgaccctatttccaaataaggccagagggtgacaactttaatatgtcctttggcggaacacaattcaatccatagcagaagtttactcaagcactcaagggctaggaaagaaaagattcatgactggccctatgtaaaaataaaacacctcagcataatgcaaataccatatgcaaaatcaaaagataaatgacaaactgggggaaatctttgcagttcatatgacaaaaaaagaggctggtttctccggcataggaaagagagttcctagaaattgatcagaaaacagtaacaataatccattagagaaatggatggaaggtatgaacaggcaattcacaggaaaggaaatacaaatgacttttaaatatttgaaaatatgttcgatctcacttaaaaaagagatatgcaattaaaatccacccataaaatcgagaacaatttcaaagtttatgaacatactctgctggtgaggctgtggggaaacagacactctcatctattgttaggaggagtgtgtgtcactacggtccttttggagggcagattggcgtggcccatccagattacaagtgcaccctcctttaatctagcaatctgttcctaggaatttactgcaattgtatgtgtgcaaagtagcacttgtaactcagtgtttattgcagccttatttgtaacagcagaagtttgggaactgtccaggtgctcacagataatagagaattggtcacataacttggtatctccatgcaatggaaaattatgcagctgtaaaacaaaatgaccatactttccaggcaccaatttgataaaaacccctggaaaaatattactgaaaggaggtaatatagcatgctactattcgtttaagaagcaagtgcggagtgaataagaatatacatccacatttgcttctgtttacataaagaaaatttgaaaggctacgcaagaaattaattattaggactaattaactattaattaggatttttccagagaaacagaaaaaaataggaaatatatacgtacacacatacagtgatatagagaggggggttgatttattataaaggattggttcatgcagtcattcaattatggaggctgagaaatctcatgatctgccatttgcaacctggagacccaggcaagccagtggtgtaattctgtcccatttcaaagacctgagaaccaaagaaactaatggtatcaatcacagttcaagggcaggggaagatgagatgagatgtcccagttcaagcaatgagacaggaaaagaagggagaaattccttcttcttcttccttttgttctgttcatgtcctcagtggattggatggtgcccacccactttggggagggccatgtactttactgagtccactgattcaaattctcatctcatccagaaacaccctcacagggatacctagaaataatgtttcatctgggcaccctgtggccaatcaagctgacatgtaaaattaaccatcacactaatgaaagtggctgtggagggtggtagggatagaaatgagacttttccactatatctctttataattttaatttttgaattatgtgactgccgtgcctaattaaaaataaatgcaacaccttgggtgtgggagcagagttgccgtgggctcactggttgctgcacacgttgctctgcatgtcctgggttccttttcctctggttgctccttcttagttattctgggggaaagcaggtgccatggggtacctgagactaataaataaatgcaggtcagcttgtggcccacagaggatggcccagcaggcatggggtgctgtgtcatgggcaaggacatgggccattcttcagtggcagtcattttccttgatgggagcccagaagtgctttgggaaggtagcctcgtgctgggcgtgtctgccctaagttgagtttaccaacacataggaaggtctgaaattcatttcagcacaagagcagaactgaccctgtgtgcttacattggaaatcacagatgccccttccctcagtcaggaaaattacccaggtcacctctggtgagcagaaggccttgcagaacaagtgctcagtggacagtgtgacatatgagccccgccgggatctcccgctgcagcagcgaggaagtagtgtggtgcagtggttacgtgttgcagtttcagagctgagttcacagcatggctgtattaatctgttctcacgctgctaataaatacatacctgagactaggtaatttataaagaaaaagaggtttaatggactcacagttccatgtgactggggaggcctcacaatcatggcagaaggcaaaagggcacatcttacatggcggcatgcaagagagaatgagagccaatcaaaaggggaaaccccttataaaactatcagatctcgtgagacttattcactaccacgagaacagtatggaggaaatcacccagatgattcaactatctcccactgggcccctcctacaacacgtgggaattatgggagctacagttcaagatgagatttgggtggggacacagccaaaccatatcaatgccctgccctcttactaaacgtgtgaccttgggcaggtcactcagctctttaaccctataggttttgtcacctataaaatacgagtcgctagtacctgtctccaaaggtgtatgaggatcgggtgaggtaatgcagtgaagtgcacatagtaaccctaaccgtgacccgaatcaatagaacacttagaattatcacaaacaataataacagataatactcatgtagcatttactatgctgcagacactgttttaagctctccaactatatttactctccctgcaactctgtgaagtaggtattgtaattattctcactttacaagtgaggaacagagacataaagggtaaatgtcttgccctacattactcagctctgcactggaggaggtgggatttgaacctaggtggtctggctcagagactgcttttactgacttcatcactgtgttcagtgagttccaggacgtgagtttgaataaatggaaaaatgggaacctgaaaccctcagcaaagtctgctgtgagcatgtgtctctgatctttcaagtactgctttggccactcttaagcttcgtgaaccttattttcctcatacataaatgggaggagagtagtaatgacatctactatttattaatcacctgctgagcatcagaggctgtgatgagtgccttacaggtctcattttttcctcactggagccctataagataagtactgttttccccattttatagacaaagagactgaggttcagagaggcccagaaatcttaggcagccagtaaatgccagaaacagaagttgaagccaagtctgtttgatgccagagcctgggcccatcaccaccccctggactctgtgccctccgggagctgttgcaaagatgagagttatttttctgtgtggtgcctggcacacagtgccggtgtgcaaaatcaccaacgcttggattgtcgatgtaacatttgctcacggaaagctgacctcacccatgttgaagctccctttcctcatctgctgagtcaggatgcagatggggtggctttcagggactgctatacagacagagttctagaaggttgtgtggcccggaagcggtgctgtgccgatgttaggggcctctacctctgaactacaagcaaattctcccctccaacaagagcacattgtgttctggccccggtctcccactaaggctactttaaatgcagatccttctgccaacagctacttttagcaagggcagactatcataaggagagaaacttgcaagaaaatagcaaaatggaagcattgttcccgagggtttggagcaggctcagggaacggtggggtgggagagccctggagacgtgctttgccatcacaaataagttgtgcaaaaaaaaaaaaaaaaaaaagaagaaaagaaaattcacttaaagtttttcctgaaacctggaaggaggagagggcagacaaaactaactttggaaggatttaaactgctatagtcctgtggaagcttctctgaaggaactgggaactgtttatagcaggagaattgcatcttgaggctggagggagcacagggctattgatggatgagtccctagtaacacgggaagatgggaggcaggagaaaaagcttgtggactgagaaggggctttttttttgaggaaatttgtgttctcagggatgaactagggccatatgataaaagattgcaaggatggtttcaacttcacaccatttagagcctctggcactatgaggaggttggctcatgcagtagtgagtggactgtcctcagaagcatgcaagcagagcccgggtgatgatacagggagtccagctttaagataggacacaggacttgagcagaggctcataaacactgggccttgtgcagggtccgctctgtgccagctctcacactcatccatgatgaaatgagagcaaagaggactgaggctgggtgcggtggctcacatctgtaatcctagtgcattgagagaccgaggtgagaggattgtttgagcccagcctggccaacatagtgagacactgtctcttaaaaaaaaaaaaattgagtagtgagattttaatccaagaagactgttccttgagactacacccttcctaaacttaggtgttcaaatgctctttataaaatgacccctctgtaaaagcctggaaatattgggattagataatgtccaagtcttttccattgctaagattttgtgattctaggaaaatatgtttctgatttggatgaaacagaataggaggagcgtaaaagcaagcctaaaactgacacatcaagaaatggccatgtcagcataccagttagagatgcagagttacttaccaggaggaacagttacaagttgactgtggtcctcctgaagaacagggctggaggtgagattttgcataagtatcaattctgcattggtatataaattttaaaatgacatgcatgtactatatgacctttggttaacactaaaacttttaaaaaataaaagacaggtaataattatagctgccctttactggattctgtgctaaaggctttttataatattatttcctttaattaatcccatcttagggatgaggaaacaggctcagaaaggtgaagttacttactttgctgtgcagacagggtgaatttcaggtttttttgacgtgagaatccaaaccagatgcatatacacgaagctcagttgtcctctgccagggtgagacttctgtggggcttcaggagaggaagaggatggggggatgtgggggtaatgctatagaaagcaccagaagataactggaagagagatgatgacaaaaaagggggtcctggttaggtttcttgatcaaacatcttgaggaattcagcagcttgtcataaactaaaaaaaggcacacttgcacattaaaagagaaataattaaacagttgcatgagacacttatgttcctttctcccctcaatttggatttgatgggagggaggccacatgggaggaagcaagctgtttggacgcgttgactctgtgccaggcactgtgccaggaaccttatggaaatatcagcccatctagtcttcgccatgactctgagaaataatattaaccaagaacgtcacttaggaatgcctaccgtagggtctctcagcttcagccctgctgatatttgggaacagatcattatctgttgtgggaggctggcacccattaggtgccagtgtgataaccgaaaacgtctccacacattgtcaggtgccctcagggagtcaaactcacctccaattgagaaccactgtcctcagatgactaggcatgtcatatatattatcttgagtcaccctgccagctagctgtcatgatgcccactttgtaaatgaagacactgaggctgagagaaggctgacatcattgtcagtagcagggctaagaactgtgccacgtgttttcaatactgaatttagagaagcagcaaatgaagaccccggcccagttaaccttgggctaacactaaaatatagattgtatcttctcttttttaaccacagtgaatgtcttagaggaggggctggtgtttcattatgttttgtttgtttgtttgtttgttgtttttaagtacgctggcgacatggcacaggctctggaaccaagcaccttcacttattatctctgaaaccctggcatgttacttaacctctttggctctcagttttcttctctgtaaaatggaactaatgattatacctcctcatagggttgtttggggatgaaatgagatcacgtgagcgaagcagtgcctggcagatagagactcagcatcaacaaatgtgagctgtcattcttacgagcaagtttttaaatccatttcacatactcagacctggaagtggccccagtggcatcattcagggcaccatctctggggtggctgactctgcttctttgcagtcaagcccaggggttgtaattcatgtcggattttcgctgaccactgagcaatcccctctgggctgcaggagtagccggatttggcttgagcgtccagaggagaagccgtccaagctgatcaagcatttgccttctccaccaataggagtctcaggagaattatggaactgtctttgcacatggaagagattaattcgtgtggccacaaatagcttgaacactgtgtcctcagcgctgtgatctagtatcccctgaaatttacacagggtgccagcccggcagccagaaaagccacaggaccgtcttaagctgcccagcgctcctagccgggggacccctcaggaatttcagagggtggggacaagattaagtcgtttgtttttcatttcatccacctacctcgccccccgcctaataagcctgctttctggcctcccgtttatcagccaaatggaatgattgtgcaccccccatccccgggtttgcacctccaggctcagtccgtctacttcctccacctggcgtaccctcttttatggtcatgctcaccttccagtctctgcatagctaaatgccaccatcctccaagcctagtgccaccacctctgctccccccaccaagtggtacatggctttaaaggatgtgggctctggaatagagtttaaaccccagctctgttagatgtaggtgaggggtgatatggtttggctttgtgtccccacccaaatctcatcttgaattgtaattcccatgtgccaagggagggacctggtgggaggtgattggatcttgggggcattttctcccatgctggtctggtgatagtgagtgagtgttcatgagagctgatgctgttaaagtgtttggcactggccaggtgcggtggctcaagcctgtaatcccggcactttgggaggcggaggtgggtgaatcatctgaggtcaggagttcgagaccagcctggccaatgtggcgaaaccctgtctctagtaaaaatacaaaaaaaatcagccaggcgtggtggcgggtgcctgtattcctagctacgtggatggctgaggcaggagaatcgcttgaacccaggaggcagaggttgcagtgagccgagatcgagccactgcactccagctgagcaacagagtgagcctctgtctcaaaaaatattaaaaaataaagtgtttggcagtctccctcaccacgaccaccccctctctgtcctgccactgtgtaagatgtgtcttgcttcccctttcccttccaacatgattgtgtttcctgaggcctccccagccacgcagaactgtgagtcaattaaacctcctttatttataaattactgtctcaggtatatctttatagctgtgtgagaacagactaatacaaggggcttactttcctgtgaacctcagtttttgcccctataggtggaatactaatggctgattaattcctgcctcatcagatcatttgagatttaaaccagaaaaggcagactaggtgcttggctccctgctgagaacgtagtaaggactccctcgatgtgagctcagggcaggtcaggcaggtagctggcctagacagctggggcaggaggagaacatccgtgcaaagaggctagaggccctcagcagcagcgtggtggcagctgttggatcggctggccacacttccacagatctggcccataaggagacaacactccagatggatgtaggtgggttcttacttcacagtgggcaagatcaggttggtgttggctcccacatcctagtcccacagggtgaccccaaactggaagggccagacaacagatggcatcagtggtgggtcactctgttattgaggaagcaactctggacacagctaagtggttttgtagtcttcatctgtaccaaagtggggcaagatggaaagcgccaagtctcactagaacgagggaggccgatgagaaatgaccgtgctacagctcctcacaggactgctgtcttgcagcaccccacgcaggatcctagggccttccgtcaagatttgggttggactgtgctttagtcttgcctatggggcttttgcagaaatacacaaggtcaccggggcccagagagtaatgagagaggcaggaagacatttgtgctcacctagaacagtgcctggcacattgtatatgctcaattaaaaagtgttggatgaatgaatgaatttaccccacagtatttaacaaacccctgcctggagcaggccctgttctggttgctgggaatttggagataagtgaggcttagcccatgctctcaagacctcacgtgacagtgccagagatgcttcaactgatcattagcaaagtgttctgagatctctgaaaaagctaagcatggctcggaggcactgacagtggagtgtctgcatttatgagagcattttgggtggcaattggcagaaatgtcaaagccgttgaaacaaacaaaagaaagagacttaattggctcatgaaactgaaatgctacctgcaggcatggctgtatccaggcactcaaacaacatcaacatagtctctctctctcaccccgtccccactcacccatgtctcttggctctgttttcctctgtgtcaccttcctcctggccagcttccttgtcgtggtggtccccagcccttctaggtgttcatcatcctgaggactggcagtggcagcagaaagagggctcctctttcccagtagctctcccagaattcaaggattgactcaaactagcccagttaggtcgtgggcacatccctccacaaatagcactgtgggacgcgaaagtgatcagctccatccaaaggatgtggagggagggtgaagcgggagaggctctccaagggaaagtgaggatgctgctagggaagaggaggtggatgctgggcaggtacagacaacagatgtccactagatccacctagaagaccgttcattcaaacttgattatgtgcactgggtggaaatttattggatgggacaggggaaatagaatgggaggaagggaatctctggcagagagaacagcatgagcaaaggcccagagggagagaagtggatcacaaggaattggaccaggagatgggtaggtggttgaggttggaggattgagcagaggccagatgattgaaatccttgaatgtcaagtgattcaaagaggaaagagctatggttagatttgcatttttaaattcattcatccaacacatatttactgagcaactactatgtgaataagcaaagtccctgattatattctaatcataccctagggtagtgctaggaagcaagactggagacgctgagtctggaggcagggagagggaggaggttgcgcaccagtctagacgggagtggctaagacttagctggggcgtggagcacatttcccctgcatcagctctactcagggccaaacctttgctatgtagagtgagtgcaggaagcagatctccaggctcttgtgtgatgctccaccagggcagcctgctgggaacatttttgtagcatctgtttgcacaggctgtcaccaacagaattagcctagatttgaatccttgctgtcccatgcactggctgtgtgacctgccgcacctctctgggcctcagtctcctctgttaaatgactttgtgctggcacctactttgcagagttgtcatgacgattaaatgggatagtgtttggcgcctaagaagtgctcaataaatgacgatgttattaattactattgttactgtgactgtcttcaagggacatccactcctgaaactcatcttcctctcttggaaactgggcaccatgatagcaagtgccttagtggaatggtaatccacttagtggccatgtgaccttgtgcacatgacgtcacctctctgtgccttggactcctcatgggaaaaaatggggctaatattagtacctgcttacagggctgttatatgaattaaataaatcatggtaagtcctgaggagagttcctggcacgtagtaaactctcaataaatgtcaaataaataattattattatgtatttgtaatattatgttgcaatagttcgttatattaatataatatgttataataacatagattatattatattgcaacatcataataataagtattattattcggtagtagtagtttagattgaccatctgcaatctgaaaatctgaaatgcaaaatactccaaaatctgaaactttttgagtgctgacatgcggctcaagggcagtgctcacgggagcattttggattttggattttcagattcagagtgctcaactgctgagtgtatatataatgcaaatattccaaagtctgaaaaagtctgaaatcctaaacacttccagtcccatgcatttgggataagggctggtcagcctatagtatgttattaacaaggaggggttaatgatgacatttaaaaaaagccttattaggccaggtgcagtggttcacgcctataatcccagcacttgggaggcctaggcaggcagatcgcctgaggccaggagttcaagaccatcctggttaacatggcaaaaccctgcctgtactaaaaatacaaaaattagctgggtgtggtggcacacgcttgtagtcccagctactcggaaggctgacgcaggaaaatcgcttgaacccgggaggcagaggttgcagtgggccaacatcacgccatggccctccagcttgggtgacagagcaagaatccgtctcaataaaaataaatgaataaatagcccttattaaatggctgttctcagaatcatcatcattatccattagacacttagagggaaaatgactgcatttgggtttggggataaaagggccaccatttcctcccacaaaggcaggtgtctttctctcagaacacgtggttattaaatattgctgttattaatattgtgaaacgacatcagactcaaacccttctcccagcagaacaggagaaggaggctggctcccctcccctgatctgtttctcctaggctgaccggaggggtgtcccgtcccccgctttccctcgacggttctgtaactccccagaaggccatcccagctggcactttagttttgcgattcggggatttcttttctgcctcatgcctggaataatttgtggctccatttacaagagcagagcccttgtgttcaagcccgctcgggtcccagaagcagtgatgcctggaaagcagtttggaaaggtcagctcggggcgcagtccaaagtgattttaagtgccccagctaagtgccggccagaatggggagcgcttttaatctataagccttgccctgtgaagaaagagacaacactgctctgaagcagtttgactgcaaagtaataaatccctttgtgtatataaaaagtacagacgtatctagctcacatttcagaagaaaaaaaaatctctgcagttagggcattggagttgaactcatgtacatgaatctatgggaggaacttcatcgagaaaaaggagtttataatcgtcatacatttttaatttacaaggatttgttctgagactgcctgagatcacagtttcctaagctgtgtgtccttgagccagttgcttcacttctctgtgtctcatctgtatagtgggaagagtgagtactcacttttgggttgttgtaaaaattaaatgaattactagctgtaatgcatttaggatagtgcctggaacagtgtacacacttaataagggttagttactattatcttatagtacagatttttgttttaggattggcggcgattttctgcctggcacacaggaaagccagtctacagagtggccctgttgtttgcaacagaaacctataattgtctgtttctccttggttttctgggttgagagtccaatgcacacatttcatcatgccttgatttttttttttttttttttgtcctttttaaatccaacctttcaggacgtacttccagcaaggcaatttggaattcttgaattccagagagacctttccggccacattagctaacagaggaacttttcaaaaccaagagaagcttgcaaaccactggttagaaaatcaactcattcattcattcattctacaaatatttcttgtgggcttactatttgccaggtctgcgtgccaggctcaggggtttcaaagagagcatggcatattaaaggtgtatcctatggggagccaggccctgatttaagagctgtgtatacatcaatccactcaccacaatcctatgagatcgatcttatcttatccccattgcacagacgcagaaactgaggcaaagagaggttaagtatccctaaggacacacagctggtaaataaagtccagattcaaatcgaggcagctcagctccaaaatttgtactcttctctttttctccccagctctttaatttggaaaatttcaaacctacagaaaatgtaccagtatggcacagtgaacatcatatatttgtgccattgacgtagtcattgtttaaagcttcccacattttctttaccctttcctttctctgtaaatttttgtgaaaccatgagagttacttgcaaacatgatgattcttcaccccaaaatacttcagcatgtgcagtagtatctattactgcataacaagttaccccaaactttaatagataaaaaaacaagtatttattatatcatatctgtaggtcaggaatctgggagcagctgagctggtcctccactcagggtctctcatgaggctataatcaaagtgtgagctggggctgccttcacatcaggcatggtggagctcatgcatgtagctgttgattggaggcctcagttcctccccacataggcctcttcatggggctggggctgctcatgacacattggctgacttccctgaaagcaagtggagagagagagaggaagagaggaagagagggagcaagaagcctggatggatgccacagtgttttatgtcagtgtttatgtcagagtgacataccatcacttctgccatattctattggtcacacagaccaacccaggtactgtgtgggaggggactacacgggggtgtgaagaccagggaggcagagaccactggagtatcttggatgctggtgaccacagtgtgtttctctgaatgatgaggacattctcctacaaaacaaccgtactatgaccacacattaatactgtactactacctaacattcactctgtattcaaattctcccagatgtctcaataatgtcttttttaatcagtctagatccattccactttcttgacataagaacaggttgattgcccttttgggaaacactccttccccactctcagtccacctagttcaggaggggccaattctgatgccccagccatgggtaggcttatggctcagatccagctagtgaacactcagcattgccctggtgacagcgattggttcagggatcagcatgtgaccgaagctgggccaatcagaataattcctgaattttagctgggactgttaaggaaaaggcaccatctcaccactagggttgcagagctggtagggtcagattaaagacactgggagccatcttttctagcagcttgcaggagaggcttcctgagaatgaactcaaggtggtagaaagcaaacctgagtgatagagatggggggaggggagacaaagagagataatgactttatttttatttttttattttttttcaaaaatcccttgatcaagctatgtctgaagctaactacccctaggggttccagttatgtgagtcaataagttcccctttttatttaagccaatttgagctaaagttcttgttatttgcaacagaaagggtcctgactaatacatgcatcttccagggaaagaaaatgacttactgtaaatccttaacacagaaactaatttgcagtagaagtgtgctatgaggaagcaggactgatattcttagaaattagagttgttttgtctcctctatttgtaagagtctaacagatgacacagcaaaatctccagccctcctaccttccataacgggtttgctcatccatggaagttcatgaagttccagttatgccacttattactgctgtgaccttggctaagtcatttaacctctctaagcctcagtttactcatctatgaaacagatatattattaagacataaaataaggggagagtaaaataagatagggcatgttaagcatagggacagtactgagcatatagtaagtgctcaataaaatgtagccattcatagcagttctaagatgaaaaacctactacgtgcgaggatcttgcaaagatacacaagaaatataataggcctacctgaggatgtcagaaatcttcatggaggaagaaaggctcaatctggcccttccaggattcactcaaatttaaaaacataagcagatgaatagaggtgggcttcctacaaagaatgtgcaggaacacaagtcaataataagaacagctgagatgtattgagcacttactgtgtgccaggcatagctgtaagtgcttttcacacatcaactcacataatagttgaggtcctcccagcccttgaggtggggattgtgatggacagttttgcagacaaggacacagaagcccagagaggtcaaatcatttgctcaaggtaactctggtcctgtgtggagagccaggattcagaccccaggtgcctgaattcagagcccgcatccttaactgctctgccaacgctactgttgcttataaaacgtaagtgataacaacgacggcagttacagaggccacatatctatgccacagatacaaaacccaaatgatatggatatcaaagaaaaggcacaaaggccacccatgcagccaggaccaaggcccaggtctgtgggcctcttgtccctgaggggttaaatgttctgttctgtgagagtggccaggaccaagcacagcgctccgggagggaaggtgacaggccagctcagggcggtggccaaagctccaggcagctggtggcatcgggggctatggccagctgtctcctgctgaccaggcctgagcacccccaggcctctcaccagcaagacctccacagctgtcagaggggaacagtgcttgccatccacgggcaacccgcagaacggggccagtgaccccggggtgaaaggtttgcctgccgggcccctagcctcctgactccatctgtctcgccacctgcaagcaccatttctgactttttcctttggtataaatggggaggcaactatgaaatcaacagtgggaaaggtgcaagaggccccatcttcccagagcccgagcctgctggctgttgagacgtataggctgagaaggctggacaggggacgctgactaggggacccccgtgctggatggtgccatgggtagggctgtcttggaatcccacagacccacattcaaatcctggctttgcccctaagagctgcctgagctcaggtgagccatgcaccctatcacatctctcctctgtaaaatgggcacagcccacctcacagaggagctggaaggatgtaatgaggtgccttcagtttccctcaaggtctaggagggtgttaagtccaccggaagtagaacgaaactcctaagtcgattcccggctcttctgctcctcagctgtgtggcctttcatagcctccttcatctttctggggctcagtttcaaaatccgcaaactaaggggcatgatatccatctgacagggttactgtgagaaattcaatgcatttctatgtgtaaagtgcctggacttcagtaaacactattaaaagaagcagtaacagagtggttaaaggctctgacatttacctgctgtgtgatgttgagcaagttaccttccctctctgtgcctcagtttcctcacatgtatcatggagatactcatgcccttatcttaaaggcttgtcctgagggttagatgagacattataaaggcctttggagcttagcaggtggcgggtacatgatagacatgggttcttttttcttttttttttcttgagacaaagtctcactctgtgatccaggctggagtgcagtggtgccattatagctcactgtagcctcaaactcctgggctcaaggaactctccaacctcagcctcctgagcagctgagactacaggcacatgccaccacctagctaatttttaaatttttttgcagagatgggatctcactatgtcgcccagctggtctcaaactcctgggttcaagtgatccttttgcctcagcctcccaaagtgttgaggtcacacacgtgagcccctgtgcctggcctagacgtgggttctgaattttacaaaagtgcttggcaacgaatgttactgagttcttattagtaacatgttttctgttactagccctcctcaccaaggagtgggtggtggacaacctaaggaaagatacctttttattttattttattttattttttactttttttctttagacaaagtctcactctgtcacccaggctggagtgcagttgtacaattacagctcactgcagccttgacctcctgggcttaagtgatcttcccacctcagcctcctgagtagttgggactacaagtgtgcaccaccacccctagctaatttttgtattttttgtaaagacagggtattgctgtgttgtaccatttttagggggggaaaactctcttagagaaaagatggggaatggggcaagaggtctcctcacatttagagacatttttgtgtagttgtgtagtgtgggtgccatcctaaaagggaacacctcaaaagcctccaaagagagttatgcagatgtgacttacccacatggcccagctttcgagggatcacacagctgggctctggagtggatctgtgtcccttctctgactctcctgtgtgacttgggcaaggccagccacttaacctcaccaagccaggtcccatcatctatgaaatgaggacactgacagacctgcctcattgggagggttctctgttttgttttttgtttgtttatttgtttgttttgacagggagtcttgctgtcgcctaggctggagtgcaatggcacgatctcggctcactacaacctcctcctccccggttcaagcgattctcctgtctcagcctcctgagttgctaggattacagacacgtgctaccacgtctggctaatttttgtatttttagtagagacggagtttcaccatgttggccaggctgctctcaaactcctgacctcaagtgatctgcccgcctcggcctcccaaagtgctgggattatgggcgtgagcctgcgctcccggctggttctctgaattaatcggtgcagagcagtgattcccaaccaggagtgactctgcccccgaggggacatttgacagcatctgtagacatttggctgtcacatctagaggggaggcgtgctgcgggcgcctagtgggtagaggtcagggttgctgccaaacatcctacgatgcacaggacatcccccaccccgcccccagcactcaccaacaacaaaggaccatccactctgaatgtcagtaatgtcgatagacatcctcacgtagagtattggcttcagcatagtgccagtaaaaggaagtgcttgtgtttgttgaatgactaaatgaacttgctcactgcaagtctcagcttctcctggcatggagaaaatgtatctctctcccagagttgttgtgagatcaatgagaaatacgccagcctgagggcctctctggggccctgggaactgctgttggatgttgaatgaatatcatagcaagggaacattcggagtctcagatctgggatttgggcaggagggttcacccaggaggccagcttgcctgtgtgtagcatgtagttcttccagctgaaactgtttctccctgaaggatttcaagcacgacatatacccaaactaaagaggatggcagcaaaacgtgcagaaggaagctaggttggattcagcctccgtgctcccgccttgctcatctccaaagctgtaagaatttaagggaaacttaccccatgttttgttgcctcatttgtgcataattcatcaaaatgctgttctgtaaaagaacttctctgtggcttgaaaccctttgcacacttgtatcttttcctgcgctctctttttcttttatatctctccctctctctccccctttctttctcattaaaaagatgccttttctctcaagtgcaagaagctgacttgtgccaaaaacaagcagggtggatgctgaaagttcccagggttagcctggagcctcccaaccctagaccttgagcaacctcccagcttaagtaaaatcctcctccctgctctgctccccctggatggctctggggagtcccaggaatggccaggacagagggagccaggtgagggcctggctgctcccaggaaagagaggatgtcatggtcctgttttggccaagcaggtcctgttttggccaaccagtgctcccgtgcgcagatccctgtggtgatgggagacaattgcaagggtcagggttcgagacaagatactcaaaagtcccttccagtggtgggcacctgactccagggcgggttcgtaagggctgcggtagcttcggggcaggtgcagcctcggtctcctcacctgggcagtgggaataaaggggtctattcagattgttcggatgagcagtcagtgaggaggaggatgtgaggtgtgtgggtgctgggcactacaccaagcactcagggcatgcaagccaccagtgtccctgcatcttcagggcactttctgaacctcagcaccttcctctccaaaatgagaaaaacagcacccgctccatagtgttgttgagaggattcaacaagctccttgctacaaagcccccagtaggacctggcatataattcctgttttgaaaatgtttgtgtatgtctcacatcttacctaattcatgcccctgcctgctcataccaagaacaggtatccagtaaaaagggagaagagtgtaaaaggtgaagatgctacatttattttttcctggcaattcatttgattttttaaaaagaggccacatgttggtggctcattcctacaatcccagcactttgtgaggccgaggcgggcggatctcttgagcccagtagtttgagaccagcctgggcaacatggcaaaaccccgtctctacaaaaaatacaaaaattagccaggcgcggtggtgcctgcgtgtagtcctagctactcaggaggctggagcaggaggatcacgtgagcctgggaggtagaggttgcagtgagcctagatcaagccactccactccagcctgagtgacagtctgggtgacagagtgagaccttgtctggaaaaaaaaaaaaggttgcagttcgcaataggaaggtcctttctttatttgggtagccttagcctcgctggacctcagtttcctcatctgtaaaatggggataattataatacctgcatagcagaggtattgtggattaaatgagagcttttgtataaagtacttaggacagtgcctggcagttcgtaagtgctgttttaagagttcgccacattcagccagagtggacagtagactgaccgatttttagaaagcccaaattccctgtgtttaaccagctctaaaacatctcaggaacctaagcagcctctcttgtacctcaggtgtttctgtcctgtgaaaaaggaatgaatttgctggccgcctatggagttcccacagttgcgctgcttagtgtttgctaagccctcagagccctgcggaaatgcaggctgctacaaatgctattaccagaatccacattccccagagctctttggagatttgggaagcttgggtttgtttggacttttcatgactcgactctggtcatcgttagggcgtttgatgatcttagacggaatctgcctttcacctctgtggcctgctgggcccttctgggcgtgttacaggaagggaatgcatcattgctcctatctgcctagtcagcttttgtaacaagctcttgatatgatgattttgtgcttgggtaagcttttcagaccttctgcggctctttgctgcagaaggtggaggtactgggacaatcaaatcaagccatcagctgttgacagtgggcctggcaaggtctcacggtgcagaagacactgagctgtctcacgctggcttgcagtttggtatgtgggatccggtgtgcctgggatgagagcacactcgcaacccaagagggtctgaaaccctaagcactcttcgagggtcttgagaataagtactgacctcaggatctgggtccctttcccagtgggggttagagtctcagtggccttggttgtcctcctccagtgcctgtttatatttgaacttcttcctcctctggacctcacccattggatccctgcaggattgctggaccctctgccaagactggccatcagcgggagggctgcttccctccctacttctaagctcaaagccctaggaggtcttgcccgtggagacgaggtacatggctttgtgttttattgccatttattgttcttgttattttaacatttatggagcacgttttagctgtgaactcatttcttgagcatcactgcggtcaaaatctccccagggtgcagggccaagggttactttgattctttttttggctgttgccctatttactttattaaaaatatcattgtgcgaggggctccctttgttctaagaacttttctggacatgaccctgggtccaccctaagcccctgattaccatcatttgaacatgagcctgggtatgagtaaggccatataggccagcggtcagcaaacattttctgtaaaggaccatgtcataaatatttttggctttgggggcctctgctgtaactactcaactctgctcttatcacataaaagccgccatagacagtatataactgaataaaactttatatacaaaaccagacagcagccagaatttggcccatgggccatagtttactgactgccccctccccacccacccaacgtagatgatggggctttgttctacgaactcccttttagttcttccatagatctaaagagtcagttcttcttactgcagttttggcctgtttctacttctttgtttgatcccctagagcgtgagttggcaaactgaggccaacagctcaaacctggccagttgcctgttttgtaaataaagttttattggaaagcagccacacccattcattctgtgttatctatggctgctttcccactacaacagcagagctgagaagtggcgtcagagacctcttggcccccaaagcctaaaatatttcccatctagctcttcacagaaaagcttgctgacctctactctaaagagttgaggaatggctggctgagaagcagacttttttttgcatgtacatgaagagcattactaaccctcccaaactcatcttagaacttttctcccaggttctcttgtctagtctttcaaatattttagatgttattctctggaatctaagtttttttttttttccaaagttccagaccactgtttttaaacaactttggactgtgatcctcataaaggacatattttatatgtcacccctgtaatgacatacaataaactgcatacacacagatgtccccaccacacacacaaaccacacaaaacacatacagaaatgaaagttttaagaaacaatgcttgccttactatatgtgataagctctcgtattttctatgaacaccagtcaggatcagcttgatgatgctgtggtaacaagtaaccccaaatctgagtgccttaaatcaacagacatttatttattgctcctgctccacgtttgccctggatcactggggatcctgaaggagcagaacatcacacactgatctccaagtgtctgacaagagtggtactcaccatttctttgaatatttctttggtcaaagcagctcacatgaccataactttcaatagagtgaagaagtgcagccctactgtggacccagaaggtgaatctgagatatttggtcaacagcattaagataactaccatatggctgggcatggtgtctcctgcctataatcccagcacttttagaggccaaggtgggaggatctcttaaagctaggagttccagaccagcttaggcaacatagtgagacctcatgtctacaaaaagttttaaaactagccttgcatggtggtgcatgcctgtagtcccagccactcaggaggctgatgtgggaggatcgcttgagcccaggaggtcaaggccatggtgagctatgatctgcactccagcctgggcagcagagtgagaccttgtctcaaaaaaaaaaaaaagaaaaagaaaaaagaaaacaaaagaaaaaaattactaccatattagtctatcccaggagttggcaaactttttctggaaagggccaaatgctaactatttttggctttgcgggccataccatctctgtcacaactattcagtgcagcagttgtcacgtaaaaacagtcagagacaacatgtaaacaaatgggcttatctgtgttccagtaaaacattatttataaaagcaggcggtgggctgggtttggctcataggctgtgggttgccaaccctggtctactctatttcttttttgaaaaacactggtcacagctcactaaactgattttattaacccatctatgggtgagactctatagtttgaaaaccccaagtgacgataagctgcataagatgagggactaatatttcttatcagctgtatcctcggtgcccagtacagggttagtgctgagtaaacattgttgaaagaagccactgaaaatcctctccaactgtttttctggtgataaatactctgttcaagatgcatacgttattgtgtttctctcgtaaggttgcctggaaaaaaacaaaataaaataaagctgcacacattattgtttaattcgtaaaaggttgaccctactttcaaggtaactgtcagttccaaacttagagacacaagtattatgttcacttctctaagagcactgttcttcattcaagcttgagatgatcgctccataaatgtagtgttgaaatctatacttgtggaaacccaggtcattgtatatctgttttcttcatatatatttattatttattgtgtcagggaaaatacatgcactatctcatttaattttctcaaaaattgcaggaggtgggtgctaatgttactcgcattgtacagatgaggaaactgcagctcagaggaatatgcccagtgtcttggagctcaagactggtagagatgggattggagcagagtctctgactccagaatatggggtgtttgatcatttggctatggtgtctctgggacatgccaccacataccaagacctactcaagtgcaaggtctttaaatgctattggcagttgaggccatgttttaagtcctcttagaaagacactatattgtgcttcataagatgatacaaaacatacatgagccggttccttttatgggaaaatctgaagttaacagtgagattggggagtggggagggtttaacactttaacagctgtcctgctaagtgtgagagtaagtcaggccaaacctagtctcacagtcaagactttcaggtaaaagtaatagagaactcaagtcaaactggttcagcaagtaaagagaatttaggggatcaaggaactgagagtccagggtcagagctcagttcaggtatagctggatcagggttgctgatgcagtcaggatttcagttgttttctgactcttgacttgttttgttcttctccacgttttgggtttaacctcagcctgcacatggagctagatggtggggtaactgagccacaccctctaaggcacatagtaggtgctcaccaaatatttattgaatggatggactgctcaagattggcttaaaagcttgatacttttatgtagctgttaggttggtatgcattttaagatttgtgtgtatctgtctgtgtgtagcccagaggttaagagtggaagcacattgctttggttgcaacccttggctgtgccacttacccactgtgtgacttttggcaagggtcccaaccccagttctgcacctgcaactgccctatgaagtaggtagtatcattttgcatctatgatgcacaaggatagcatgacacaaagaggctgaggtgcttgcacaaggtgatttatggagctgggtgtgcaccttggcattctggttccatagcctgtgtttttctccactgtgcatgcaaagtgctcaacacagtgcctggcacagagtaagctcccagtaatcaaaagagccatcaatccaggctcgtttaaaggtggtggtggacagggcaagggtttctcccaggataacatgtagtgaagcatggagttgagtgatataaaaaataatcactttcctagagtctgggagaactgaattattatttcccagctgccactaatctgcagggggaccttgcagcgatgttcccctctcagacagagactcaattttcacaaccataaaataatctaaggagtctcaagtacccttctagccctgatattctaagagtctgtgacttgatgatgcctgtgagtttggaggtctcatggctgggcactgagtttccaagattgcacatggtttggggtgctggagctgtggggaaatcatgaggagtcactctgcagcatctgttccctgctcctccttctgggtgctcctccaccaaggggcaggaaagcccaaactcccttgcagctaggtttctaggagtaatggaacattaagcaggcacatgcgcttccttgaaattcagaaggcggaggtcgtactcaaattgcctctgccgtgttggttgtttctgtcactgtgcagagtctggagtagtttggcttgctgcacagctttagcagaggccccagcgagcaggcactagctttatgtgtgttgagaggcatggtgtctttgtgtgggttcccaagaagctgacctcaagatcagggctccagtgccaatagttcatttaagaggtgactccaagaaacaccagaatgggaataaagaaggaaggcatgaagcgaaggaaagtaacagagggtgtgtgatccagcaggttactccctgagcatctaaggctacaccctgatgggaaagggcttataacacgtgccgctgagtaatccctccttaggggtgagggagctggggtctttataccccacatatgccagaaagagccttcaggtaaaacattgcacttgctgccgtttggaagttggatggttttcatggaaatggtatttgccgaagggatttaggcaaggtagtgacagcatcagccacgcagggcacagggcatccttgttgcttgtaaggattctggcaagtgtgataaggtcatgaggctggcacattagtggaatggtttcctgatagagatatccacaaggtgcctatcatggagggattttttctgtaaccagcagctttctggtcacagcacatgtagcagtaaccagttgtctggtgtcgctttggcattccctaaagcttatcctagcgtctgtgcccccaacctccccagaaattctctaagtcgtttgctagcctgaattaaccccttcctgcttaagctagctgtagtgggttctaccctctgcaactaaactctggttgataccagttataacctacatcctgggtctgctggacaagcagaagagtgccagtcactgaggattagaacaaagttcccacaacagccctgaagggcaaccgggctatgcacttctacatcatgggccaccagggagctgagtaataaaaccactctcaggcgtcagaggactcagattcttgtcccagctcccccactaacctgctgtgggaccttatacaggtaattttcgtcatctgaacttcaagtgactaatctgtggcccaggcaggagaggatgggggcgagagtgtggatttcaggatcagatgggccaagttcaacctctcagagcctaagttccttcatttgtgaaacagggataacagggttcccagagaaatattcagaagcatcagagcctctctgaagaattctgccacctcctgacattgtcagtttccctctctccctcttccttcctctctcttaacaaatatttattatgctcctacttataccaggcatgactattggtgttgaaagcccacaagtctctctttctgtgaatcatagtttctggagggtagagacagacaagaaacagacaaaggcacgtgtgtaatgaatgtgtccgggggtgagaaatgcaatggagaagaactccgccgagcaatggggcaggagtagtgagggaccctccttaaggtagggtggtcagggaggtctctctggcagaggcctgagaggggcagggagagccgtgggcatgtctgaaaggagagcatgcttggtgggggatggggcttgagggaccaccactaggaggccagtgtgagagatggagggtggcgggatctgagctccagaagtcaggggcgggatcagacagggcctcatgggttgcgcttggctctttagattttactctgagcaagccagaagctggcctcatttaacctccttttagaaatcggtgtgatgaatcaatagctttggccgtttgttcatcagtcattcattcattcaacaaggatttgttgagcacctcctttgtgcagctctgtgcttttctagttcctctgctgaacagtgaagggcagagcaagcacccaccggaataaggagggagttgggcattttgctagagctcctgtttggtccagaggccgcacacaatggaaaagtaaagcctggtcccctccgcaggccaccccgcacctggaggcatcacctggagctcttcctggcaggctgaggcctgcgagttcagccccactggcttccccggggcaggggttgcccacgcttgctgaaataagaacctcataccagatcagccccgcatcccaagcagggcaccctaaggatgcttttatgtaagaggttgcattcccaattatcttaagatgcaaagtgaaggtgttttgcccagggaaactctctatcaggagtcgttgcacatctaaacacatgaaaaatgagacttcctgaaacattcctatttcaccctgtgacagttttgcacagctcatagagttcaattttcaaatgtcatcccactctgagagacccaatatttgaagtcgtggaaatctatctttaaaaatacttttaacagcattattcctaatattaaaacttggaaaacacgaaagggagatacttgagttgtgatcatagcaaatgttcctataatatttagtgtgtgtcactgatgctttacatattctaattcgtttcatcttcatgactaccctctgaggcagatgtactgttaaccccactttacacatggggatgctggggtctgagggcttgagaactccgcgggttaacccaagagttatgggacctggttatggaacctcagtgctaaggaaagtgacaccatcataggtagtgttagaacaaaatcttggggaatggttatgttttcctgttcggtggaaaggaagcatcaacatagaagattaggtaggagctcatgtacactaaaaatgaaagtagattagaatgagccgggttggaagtgggagaaatgtccccaaacacaggtttagagttggccttgagaacatcagcggtatggacagatgtacggacactggggcctgataattcttccttatggcgctgtcctgtgccttgtaggatggttagcagtattcctggcctctccctccccagttcctctccctccccagttatgacaaccagaagtgtctctggacattgccaactgtccactgggaagtaaaatcactgccattcagaaccaccagcacagatgctaagatcatgggtggcatttttctttcctttttcttttctgtggtttccaactttccttgaataggcatagatcgcgtgaataagtaggagcaaaggagctctcgttgggatgaccatgccactctcctgttcagaaccttccagcaaattcccaatacacttagcttccccagggcctacaaggccctgtgtgagctggcccttggctacttcttggacatgttcttctctccctgtgaccctttctcatcatgttccaaccacacgattcttctttctgacattcagacacatccagctcatttccatcccagggcctttgcatgtgctgctctgtcctgttgctctttcctacctcctcttcacatcacttgctcatccacttcaggggtctgctcaaatatcacctcctccgagaggccttccctgatcaccctgtcatgaatatttaagcgcctcctgtttattgtaggtcacccctactagagcatcatctccagggggactgagacattgtttaatttgctgttccatgcctcactcctagaacaacgatcggcacatagtaaaagttcaataaatatttgtggaagaagggaaacagacagggaggaaggaaggggggcaaataagaaaaataaaatcggtaaatttaggagcttacagtaaagaagcaatgtctcaacccacacagctgtgtttctctctaaattccaactcattttgacttgtggtttgtggacaaaagatttgcgtagcacgcagtctcctggcagctcgctctctttgagggaacacactaatacagtttttatgccacctctctccacaaataccatgccgatgagtggccagtgtcaaaacagcagcaacaacataaacagatgctccttcctttcagccgagcaagtgaagaaaccctgtgcgtcattcctcaaacaccaggagatgccaccgatagccacctctcctcacagtttcgttctgctcgagactgtgagttcatgtcaaccctgagctgcgtccccagggaaataggttctgctaacagtcagttcttactacgaggcattctcagagccaaggggaagctgggttggtggtctgcagctgaaaatctttggcagaaaatttactcgaggtttttcatgtgtgtcatttgccttgattttgggagtagggaagaagcactatcagtatctttggccattcgtaaggtcaaaatggatgtcggcacgtcctgcaggccttttctcagcctgagttgatttcctggtgcttgatgggtgagcagaggaaggcaggttttcattctcttctctcttctttttcattcttttgctgcattattcatttccttccacactcgttcatgcagtcatttttttttttttttgagatggagtttcactcttgttgcccaggctggagtgcaatggcgcgatctcggctcaccgcagcctccgcctcctgggttcaagcaattcccctgcctcagcctgtagctgggattacaggcgtgagccaccaggcccaccgggcccagctgtcattatttatttaatgagcacctactgtgtgtcagccaggcctcacacctggcacttagagaatctgaataaatataaggaccacttttatactcaagaacaaaggccacctcaccagaaacctctacacactttggggttcaggtttcttgtgactttcttttccttttttggtttcatttttaattacaaaagtaattaacatgcttatcatagagcaataaaatgatgctgaagtatataaagtaaaaatagatcttttctgacataacccctgttaattgttgggtatatacccttgcagacatgttttaataaatataaaaatcatccacaaattcatagagttttctttttacaaaaagaggatcagattttacacaccacaatttgctagtctccactttcataatctcgacattttttcactgttagtacatctagatcttatctgctttgttactaatagtagttcatgttgcttatatgttacaatcttaatctttcctatgttgatcactgagtacaggcattggcaaactttttctgtaaagggccagatagtaaatatttatagctttgcaggccatgcaatctccatttcaactactcagttctgtcatcataacatgaaagcagccctagacaatatgtaagcaaagtgggtgtgtctgtgttccaataaaactttatttacaaaatcaggaagtgcaccagatttggccttcaggctataacttgccaacccctgacctttttgtcttccacatttttcttcatacttttgtgttcctaaacagatgtattcaggtttggtgtttagtttggtttaggttttttgtgggagcaggtggcaggaagaatcactgattgttttttaaaaataatacattacacctgcttagcatctgattttttgcccatcagtgatattcatggaattgcttccaaagcaatgggtataacccctacttattgtttttaacagctgcataaaattccatcgaatggatagaggatctgtattggttaaggtaatgtcagctgctgtaacaaataaaccctatattctcagggcttaacacagtcacaatggatctctcacctaaggaccagtaacagtgttcctggtagatgggtgtcctccatgtggtcaaccaagggcccaggtcctttccattgcataggtctttctccctatagtgtctcagaggcaagtccaatcagcaggtagatgagaaaagagagggaagggtctggtatccaaggtcttaatggccagccctacacattgcacacatctcttctgctcatggtccattagccggaactcagtcactggctggacctaactgcaaggagactgagaaatgcagcgtagatctgtgttcaggaggaagaatatctggatttggtgggcacataagcatccctgcctgtattagtctgttctcacgctgctaataaagacatgcctgagactggataacttataaagaaaaagaggtttagtggactcacaggcctcagaatcatgaaaggcaaaaggcatgtcttacatggcagcaggcaaaagagagcatgtgcagggaaactctgctttataaaaccatcagatcttgtgagacttattcactatcacaagaacagcatgggaaaaacccaaccctatgatttaattacctcccactgggtccctcccatgatatggggtgggagagatttgggtggggacacagagccaaaccatatcactttctctaaaattaaatgacttacttgaggtaaagcagttacaacagggcctggtatgtaggaagcactcaataaatgcacctctgctattgcaagcttgtattttttaagtattctatgatactgtcatgtccttgggacctctggtcagctctttacccctgcgggttactgtaccccttcctccttctttactgcttctaatagcctatcaatggcaagcctatcaattatacacacttgctaaaatttcactctaaaaactagtcaataccaggctgaataagatatcaggaagatgtcaggttcttatcactggaaactgtacatgtcaccttatgtggcaaaaatactttgcagatgggattcagttaaggatcttgagatgggggattatcttggattatccaggttggccccaaatgagatcacagttgttcttataggagagaggcagaaggagatttcacacacacacacacacacacacacacacacacacacacacacacacacgaagacaatgtgaagacaggacagagatttgaagatgttggccttgaagcttggagtgatgcagccacaaatcaaggtttgctggtggacaccagaggctgaaatggattctcacctggagcctctggatggaatatggccctgtagacacctggattgtggcccagcaatactgagtttggacttctgtccttcagaactgcaagaggataaatttctgttgtaagccaccaagtttgtgcttctttcttacagcagccacaagaaatgcatccactgagggttctagggctctcttgtgaataaaatgtataagcttctcaacttgcaatttgtcccaaactacattccctgctctccctaccaactgccttcccagtggtcatgagctctaccatccactcagagttcactctgaaagcctggaagacttgctggcctcttcccaatccctcccctgctgtatcaaagttgatcgctaagacttatcaccatggctccgaaatagctcttgatccactggaacactttattctcaccatcacaccctcgcttgcagtgatggcattttttgcttaagctagaactcgagtctggtaaatgggttcagctgcgcctgtgtctccctctctgcctcctgccacgctgctgcctggggacagttttccaaagttgttcctgtgcccagcattccccacaggctctcctgctcctttgagagagaatctaaactttaaccaaaccttgaaaatgccctcatttctcgccaactgagccatgatggggatgacttaggcagggagacaaaatgagcctggttgcaataaagtttggtgattttttaaatgaatctgagctcacgtgtaattatgaaaaaaaaacatgaacatgttatatagtttttcactgatggctggtatgaagatagtagcattatggaaatgagagacaacttgtccatgaggaaccctcatttttttaaactgttaagttcaggggtacgtgtgcaggttcgttctataggcaaacttgcgtcatggaggtttgtagtacagattatttcgttacccataaagtacccgttagttatttttcctgagcctctcccacctcccaccaccaccctccaataggctccagtgtctgctgtccccctctgtgtgtccatgtattctcatcacttagctcgcacctattaagtgagaacatgcagtacttggttttctgttcccgtgatagtttgctaagggtaatggcctcaagctccatccatgtccctgcaaaggacgtgatctcgttctttattatggttgcatagtattccatggtggatacgtaccacattttctttatccagtatatcattgatgggcatttaggttgattctgtgtctttgctatggtgaatagtgttgcagtgaacatacacgtgtatgtgcctttataataggatgatttccattcctttgggtatatacccagtaatgggattgtgagtcaaatgttatttctgtctttaggactttgaggaatcgccacactgtctgaggaaccttcatttgttggaaaccacccaacacagagtagatgctcaggaaataaatatgcagtggatgagtaatatgtgcagaatgacctgactgagtcacaaagacctttctggttgcatttgcatctgtcattgtgtacatagagcccttccccttagttcagagtctctccccttggcactgtggagatttgggactggaccattcctttgttgggggtgggggctgatgctgtgcattgtagcattagtttagcagtatccctggcctctaccctctggaattgtgacaatcaaaaaggtttccagacattgccaagtgttctctgtggcaggggtgtggagtgaagggcagaatctcctctgttactgctttagctgatcgcagtgaggccctgtccctttgcagaactttattccattcccgcctcccacggcatcctcctcagcttcctcctgcatcactctgccgttggcatccccccaacacatacgcacacaaacgtgcacacatgcacgcacacgcacgcacacgcacgcacgtactttccttcaattgctccccatctggcttatgaaactgacagagaataaagcttctctcttaccctctcccaacccccacgtcgttgtcctgcacctggctggccatccagggctcatctcttttctctgaaattctccaagcatccctgtcattgtcctgcacctggccggccagccagggctcatcttttctctctgaaactctccaagtagccactgaagtcagcaggaactcccaaagcagagacatgccgtggggggaatatgggaatctgtcgcctgatttttcatggccttctgaaatcacgagaaggggttgcatggaaacggttgaaagaaaatgattttttaagtgcccctctggccacactggccagattcaggctaggtctggcagccagagctcagggcaccacgtcatgcctgaattttgttttatttttctatccattattcgaaggaatcatgctgactttggctattaagtgagcacttactatgcaccaacaaagcactcggcatgtattcactcatttcacgccactgcaacctaggagatggacacggacactattattatccccattttacagtggaggaaatgaaggcttagagagacactttacccacgggacacatctagtaggaggagcagccaggatttgatctcaggactgtctgatgccagatagtaataataaaaacagctaagtttactgatgtatttactgagtgccgggtgctgcctggggggctttacatgaattgatttacttaatcatcccagcagcgctatggactagaaacctttgtgattcccattggtggatgaggaaaccgaggcacagcaaggttctatgacttgcccaaggtcgtgtggctgggctcccgtcgtccagctcttaaaccctctgctctagtgcaggggaggaggcaaaccatgtctcataggccaaatccaatccactgcctatttttgtaaataaagtcttattagaacacagtcatcccattcatttatatgcagctgctttcacagttcaatcgcaaagttcggtagttcagcagagacagcgtgacccacaaagcctgaaatcttcaccgtctggccgtttacagtaaatcttttcaacccctgccctaggaccttccctaactaccatcctgccatccaagctgtggggccccttccctgctggagcagcagcacatcaaagaacgtaaacgagtgggcatttctgcagcccccagaaagcaagccggcatcccaggaggtgcctgggaggctctctgagaaggctgactccccacctccaccatgtttcctggaggtttggctgataattaggccagtcctattatcaaaaagaccaaaataaggccgagcacagtggctcatgcctgtaatcccagcactctgggaggccgaggcaggcgggtcacctgaagttaggaattcgagaccagcctgcccaacacagtgaaaccccgtctctactaaaaatacaaaaattagccgggcgtggtggtgcgtgccagctatttgggagactgaggtaggagaatcacttaaacccaggagacggaggttacagtgagccaagatcatgccactgcactccagcctgggcaacagagcgagactctgtctcaaataaataaataaataaatttattttaaaaaatagaaataaaataacaaatgctggcaaggatgctgagaaaggggaactcttacaccctgttggtgggaatgtaaattagcactattgtggaaaacaatgtggaggtttctcaagaaaactaaaaatatagctaccatatgatccagcgatcccactactgggtattatccaaaggaaaggaaatcaatgttgaggacatatctgcactctcatgttcattgcaacgctattcacaatagcccagatatggaatcaacctaagtgtccatcagcaatgaatggaaaaagaaaatgtggtaggtacatatacacaatggagtactattcagccataaaaaggaacaaatcctgccattctcagcaacatgaatgagcttgagggacattgtgttaagtaaaataagcgaggagcagaaagataaataccacatgttctcactcatagttggaagctaaaaaagttaatctcatggaagcagaaagcagactggtggttactagaggctgagaatggtgcaggggtgaaccagaggctgcttaacagatatgaaattacagcaagagaggaggaataagttccagtgatctataccataataggatgactacaactaacaacaattgactatgtattttcaaatagctagaaaagcagattttctttctttctttcttttctttttctttttaagacaggatctcactgtttgtccagtctggagtgcagtagcacgatcaaggctcaccacagcctcaacctcctgggcttaagtgatcctcccacctcagcctcctgagtagctgggactataggcacatgccaccacacctggctaattttttatttttgtagagatggggtcttgctatgttgcccaggctggtcttgaactcttggtctcaagcgatcctcctttctctgcctcccaaagttttggaattacaggcatgagcgaccgtgcccagtcagagcagattttgaatgtccccaacataaagaaatgataaatgtttgaggtgataggtatgctaattaccccaatacattgtatacctgtatcaaaatatcacactgtaccctataaatatatacaattattatgtgtcaattaaaagttttttttttaaagattgggccattccacataggcccaggtgcctgcctcagccctggagaaagagaggggcataaagaaatctaagttgctttctcctcagtctacttaatccctgacaaaacctggtacatcttccacagtgagatcatatgtcgcctcttccatgaagccttccctgattccttcaggcagagtgggtgaggatttcctctgggctcctcattgccttgactaccttgtcgcatcctaccacgtaacagcaaagtctgattttccctttacatgcctgaagcagacactctcagggccttgcccacatccccactcttactgcttcagtgcacagctggactgtgggtttctagctgccaacacctgtgtacctttacccatgggccttctctcaccaccagagagcctgctttgcctgcctgcgtggcaagtccaaagcaccagagtgaatgcctctgttccctggcaccagccttcagccagtgcctcacaggagtgggtgtataaataccactgctccctcgctctacccctccaccccgtgggatgacggcaagtggcgttttctacactgactcgcacagtgcctcagcaggactaagccccagttgcccatggtggtaacttgcttgatgacacaccctgtatcggctccttctgtttctcttatcgcatccccagtcccctactggtgtttctcaggatcatctcccaaataaactgcttgccctggaatccttgtctcagtgtctgctcctagggagccctcatcaagtcagcatcctctcttatccctcctgcaggcaaaagctgggtctgtctctgaacccaccacagggcctgctgtagagcagatgctcacatcagtcagtcgtcaaaaaagaaatgtactgagtagctgctgtgtgccaggcaccgtgccaagccctggggacacagcagcagacagaaccgacaaggtccctgccctggtgagctgagattctaggacaatcaaacacaaataaatacatgagctaactttagatggtctcagtgctctggaggaaataaaacagggtcatgtgcaagacctaggggtcttccatactcactggggattgtttttaatgacaatgtccaggccttatccccagaaatgtctgattcatttggtctgaagtggagcctgagcattgatatttaacaaaaaaaacacctcccaaggtggttctgatgtgcaaagaacacctgaaggtgggccgggggtggtggtgaggacaggcagctggcctccctgaggaggtagccttcggctaagccaggcgaacaagcaggaaaagtgctctaggcagaagcagctgcacatgcgaagtcccagtggcaagaggtactatggtgcaggatgttcagcatgatgggaacacgggctgccaggaggagacagagagagatgaggcccacaggcttcgggtccttggtcttagagctcttgagccattgtggctcagactgcagatcttaacacatcagcgggttatgaaatcaatttggtgagccacagccagcatcgcaggaagaaaagtaatagaatcgaaaataccagagtgtgttgcacatgaggtcagtgtggttttttgaaacttttatttgaagttttataaaggtgtacactgcactgcattgcaaaacaggtttcttactgtgagtcttggttgaagaattcgaaagccactgtttttagtccctgtgaaagtttggaatttagcccaaggggcagtggggagcaattaaagaggttttagtggggggcatgacaaggtcagatgtatgtttaaaaatctcactccaggagtgtggagaacagatttggaggaggtgggcagtggaggctgggaggcgtcttggcaggctgttggaggcagtcactggggtgtgacaaagagaaccaagtagcacctggcacacagaggtccgcaggtggctgttgaagggatgcacgtgtctgcaacatgggaggatcctgggaggttgaaaggcaacatttcaagctttgcctccaacccctccctgggatgaccacctacttgtcacctgtcctgtgacgcaggtatcccaggcatggcagataatagactctgattttaacacttcctgtttgccagacactctgctaaatgctttcaaaactcatgtaatgccctcagaacaaccccattggtaagtactgttaggattcccgtttcacagatgaggaaactgagaccaagaaaggatgttacttgcccaaggtcacagcgatcatcaagctgtgtagctggcactccagccgggcagtgcggctctagagtctgtgtgccccagcatctgctgcagtcatgtgggagccaagctgcttgggtttgaatttaggggataatacactgagtactctcgtgaggatttagtaagggacggtcagtgagtaatacattcagggcagtaagggcctggagcttaggacgtgctagataaatgagagtgagttgtgccactagacgcccaacttgtagagttggattcaaattcacgtaacttgtgaacagacggtggaactgccagggttcgaatccgcctctgacacttaactgcctgcatcgcaggagtgtggtaccagcgctggctcttgtaattaggtgctctatgtccagtacttagaactgagcccgaccttggtgaaccctaagcatgagccattgatcccactgctcaaggtcatacaggaatacaagggccaaggctggagttcaaacccacagccagcttgctactgagcaactacagcccagtgtaaaaagggctttaaacagtcaagttaggtttttctctggctcttcgaatccttaatcccttctctccatgtctgcccaccagcagtgttcccaagttagagcttccagcccaggcaggccgccagagtcaccaggcaccccagggcacagagacccatccacagccttgggcaaaggtggggggttggagggaagcctctgagagagctggaaggtcccagccccgcagtggccaccaggtgccagggcctgggcctcacgcctcatagctcctgagtctgacctaagcgtgccttcttcccagcgtgcagaactgtttgcctgggcgtaggttggagacaggtgaccccacctggttggttcaggcccacgcttgttcagcctcctagacgctctgagtcttggcctcctgactcctctggggttggcgcagccttgcttgccttggctcccgtccgccgggctgttccctgcacgtacgagtggccctttagaatgtgtttgtctggtcaaggttgacaaacttcctgagcccacgtctgttgacttttgtgggaccttctggctacctggctgtcgcggatgcttcgctcaagccctgtcttctctcttggggtgtggagtcagctaagagggcagcagagctggctgtgttcacggaatccagtgtctggagagaaagctggtgcccatggcggctgggactggcaagtgaaaacttgaaattccatgaatgtagcacctggtgattctttggagaactttaaaatgcagcatgagtataaactgttcttaacaaccaggatatgaacgaggcaacctcttacagtctttttttctttttcttttttgggatgggatatccctctgttactcaggctggagtgcagtggtggcatcatagccttgagctcctgggttcacgtgatcctgccgcctccgcatcccaaagtgctgggattacagggatgagccactgtgcccagcataccgttcattcatttgttaattcagcaaaatactattcatcacatattctgtggcaggtgctgttctaagcacagggatagagcaggaacaatctagctacagcctctgttctcatggagcatgttaaggtctccagcaacactgtccgagaaaaatataacatgctttaccagtgtgagccacatatgtaactgcaaattttctagtagccttgttaaaaaaaatatgtaaaacagcaggcctggcgcggtggctcacacctgtaatcccagtactttgggaggccgaggtgggcggatcacgaggtcaggacatcgagaccgtcctggctaacacggtgaaaccctgtctctactcaaaatacaaaaaaaattagccgggcatggtggtgggtgcctgtagtcccagctacttaggaggctgaggcaggagaatggtgtcaacctgggaggcggaccttgcagtgagtcggtatcatattgtgccactgcactccagcctgggcgacagagcgagactccatctcaaaaaaaaaaactgtgaaacagtacattttatttaactcaagatgtcaaaaaatattatcatttcaatacatcatccatacttttaagattactaatgcattattttactttttttgtatcaagtctttgagatctggtgtgtgtttggacacatctcaatttgttttttgtttgtttgtgtttgtttttgttttggggacagagtcttactctgtcacccatgctggagtgcagtgacgaaatctcagctcactgcaacgtccacctcccaaggttcaagtgattctcgtgcctcagacacccaagtagctgggactacaggcacacaccaccacatccagctaatttttgttttgttttgtttttagttgagatggggtttcaccatgttggtcaggctggtctcgaactgctgacctcaagtgatccgcccacctcggcctcccgaagtgttgggattacaagctggagccactgcacctggcccacatctcaatttaaactagccacatttcaagtcacctgtggctcatggctactgattagagtctaaagagagagataagcattatacaattaaatactcagctgttaattccaatggtagtaaatgtcatgattgacaagttcagagtgcagtggaaattaatccagtcagggaggatggtgatagcagtaatggtatcagggaaggcttcctggaagcagtgactttgtgatttttatgcagaaacctaaagtggggtgaaggggaaggatgagcattcaggacagagggaacagctgtgagcagaccccaaggtgccaaggagcttgctgcttttaagggataccaggtaaaatgctggtatcaccagagagttgagtaggaagggatgcaacaggagaggttagcaggagccaggccatgtgaagcagctcacatggctcctggtgcacagcagtgctgcactcacaatgacaattggcacttggagagacagctgctgcttgcagttacatcacagatcgggatgattggcttgaccttgtgtattggaggcctccaggacaacccctggtggtggcatagacagcagccatcatccctccttgcaggccaacagaagctcgatcttatctggctgaccatgggctctgcccaaggagatgaagggtggttagaccaagccccttgtgattggtctggatgagatatgggggatggctgctggaggatgctgatggagatattcctctgagataaaatgaaggcgccacatgaatggagcctcttttcccactttcttccttcctgcttagagtagggccatgtccagttgtgtttcttagaaatgtggcttctgatgtcctgtgaccctagggggaggacaagagacaggcgaaggtgcccatctagggccctgatcttgttaacccacctgaaccgccatcaccagacatcttagcaattgtgatcattcatatctgcaccttttactgtaacatgcattgtgtgggatgaacccaagaatggcaaacatttacctggcacttactgtgctccaggtgttcctcaaagccctttgtctcacgtcatcctcacagcaactctctgaggttggcgcctttcttatccccattgtacagatgagcagggactcacgcccaagggttgcggctgtatcttttaaccgtcaccctatactgccccctccgtgtttaaacatgttggtttggaaagctcattcccctccccttcaccaccccccagaacatcattcctctaaaacaggtttctcatgctcagcacttttgacattttgggttggatgattgttgtggagctgtcctgtgtgttacgggattttagtagcattcctgacttctacccaccggatgccaatagcaccctccccattggtgataaccaaaaatatatccagacattgccaggtgtcctctgggcagcaaaatcccaccccgccgcgccccccaccgaccccactaagaacctctacgctaaaagatgttttcctgccagtcacctgggtcgctctgtgtccttgttcaggttaacgtttctgaacctctctttcctcttctgtaaaatgaggggacagtattacgtatctcatgggttattttaaggattaaatcaaccagtgtatggaaagcagctaacagtgctgagtgcataatgagcacttgctcggtgtgatgatttgacctacacggctctttcttgtctgttttcagctaacaggaactgctagctgggattttttttaccagcaaaagagaattccttgatccaaggtgaaatctaccagggtgttagctctgggagtcagaggctccatctgtcttcctccgctactggattgccaggaatttttttttgttttttgtgttttgtttttggttttttttttgtttgtttgtttttttgacacttagtcacccagactggagtgcagtgatgcaatcttggctcactgcaacctccgcctcctgggctcaagccatcctcctgcctcagcctcccaaagtgctgggattacaggcatgagccaccgtgcccggccgattgccaggaattaaatcagtgctggcacatagtaggttctctgtagtatttgttgactgaataagtgacttaaatccctttgattagctatataacttttttatagatttctcttgtttctttcattcttccctgccttcctctgtctttgtttctcctcttttgtttttgtttgtttacttatgtgtcttgttgttgttgttttttatttgtttttactatggctttggtttcactacccaagaaatcccagacttcagcactggaagctaaagctgaactaagctaactcaggagcctcaaatctattttaggagttaattcccttggcttggttcagccccacaatgcactctttgggggttcatttaatttttcttagcaggttctggctggatgttaaacctgggcaagggaatgtgcttcaggctgttgagtttaggctttacttagaatctgaagtccctccaccatttgtgtacaaacatcattataatataatttactattaaatgtaagggggtgaaggggcatgcagaggtcacacatgttccctgaaacataatcctataattaaaagtgtgctagaccataaaacttacgatgttcccatctctaaggctacttttataaaatgcatctcatgttcttccgtcggatcttctgacctgaggcataatattaaaacatagatcaactcaaagggtctttgatttatatggtacatttgcagacaccgactgcagttcttggtgaagaatcagttctcagattgccatagttaagcgcgactgaagcgcggtgaaagtacttcctaaaatccagagcgaatgtgaattcatctttttctcaaatagccaccattttgaaaatttctctgtttccatttcactactgtcctctgctatagaaattagggttttctgcttgtttaagtgtatataaaaatagaggagaggttctcaaccagggttgatgttgaccccaggggacattttgcaatgtttggagacatttttagttgttacaactcggggagagggcagctactggtaactggtgaggacaggggccagagatgctgctaaacagcctgcaattccctgtacaacaaagaatcacccagcccaaaaacctcaatagtgccaaggctgagaatttctgagatagagagacgttcgtttcatcattgattaaaatagggtaaaaaaacccaaactgtgaataacctggatgtacattggtggggggatggttaaataataaactctgctacattatttcagtggaatactatgcagacattgaagaagaagcaggcggctccatgtgtactgatgtcgaaaactgtccaggatgtatttttaaatggaaataaaaacaaacacaacagagtttttgttaaaccattatgtttttggtgatattaaggaattttgtgccttaatgttaaggaatattgtggctatgttttcaaaaaaagggtctttttttagagagagacttacacggaaatattgacaaatgaaatgatattatggggtttgcttcaaaatactatgacgggggaaatagatggagtggaaatggggcaggactggccatgagtgctggggctgtgtgatgagtttaggaaagctcattagatgagtctgagtatttttgcagtgtttttgaaattctccataaagttgctacacacacacacacacacacacacacatgcacacacacgtaaatgcactgaagaagatctggtgggagataagagatggtgagtagatagaaaaatacagacagatgtagatttggctctgtgtaacaaagagcttaaataacagtggcataaataacctaggagtttatttctctctcatctaagagtctgagcagcagctctgctctgcaaagtcatcagcagcccagattcctttcaacttgtttcctcatccttaaggtgctgctcttttcctcattgtccaagatggcactccatcacatgacgttctatccaataggaatgggaaaaagaggaaggtccaccccattcctttaaggacctaacctacatgttacttgcatcacttttgattccaccctagtgactgcgcttagtcacatgaccacagcctaactgcaagggaacctgggaaatgtagtctttattctgggtagctgagtgccctgctaagaatcagttgtttgtagaagagagaagagaaagaatattggggatcacctaacaatctctaccacggtgtactcaaactgtgaatgataattagcacagatcagtgggactatggggaacttatcttttcacattatatgttgctctgactgttttaccattagcatgtgtattttctcttttgtaaagagaattaaatataaaaaatgttctgataagtggtgcatgcatgatccttgtatgtaacactgtgaggctgtagtgtcatttttcaatattcatttcgctggtactcattgcctgactgtttagtgctgattacaattactttattagatgctaaggacacaggagtgacaagacagacaaagcccccagcctctgacagtgaacagagaaatatgcagtatattttaagatagtgatcagaattaagaaggcaaataaaacacaatcatgggataggaagcagggggtgattagggggatgtaggaagagtttaacaatatgatcaagaaaggaatctctgaggaggtgacgtttgagaaaacaccacaggtggaagaggatttgttgcagaaggaacagcaagtgcaaaacctataaagtgggaaccaacacactaggtttaaataacagcaaaaaggataatgtccctgcaggagaagctataagaacagaacttccagaaggtgcgattagagggtgggaagggttttggattaagtgttatattaggtcatttgggtattaattactccaagtcattatgaccaaaaggtagttttcctaattatttgcaatcattttcaaaataattaggaaacatggaatgtggaaaaacactccattggcacagtgtcatgtggtgaaatgagatctgcaccttgttccggctctgcctgtcattagctgtgggacctgaggaaacttacttgatttcttggcctcccagtttcttcacttttaaggatggagaagagcacttactctgtatcctattctgctctcagaactacacaagtagtaagtcattttatccccacagcagccccaggaggtggggaccctttttatccccacctggcaagtgagaaagttgaagcagagaagtcaaggaagatcccacaccattagcaagtggcagagccaggatttgaactcaggcacctgggcacctgaggtagctgcttagtcaccactgtaccaggttcctgccggctctgcctacctcacagtctggttgggagtgtgcaatgaggaaagaattttgacagcaactttcaagaatgtcaatgctgaacaaatgtattaacattattggaatattctggaatatctctcttctttccaaataaatattttaaagtttctaaactcctaatgaaagaattgattcaggccacaaacattagtggatgaaaccatcagatcggaggttaatggggaactttataatggaggaagcaggtggtgctacctgaacacaagggccctcgtggtgtcactaggagggacacacctgggactcctgatgagatgcaatggtgagagcccagcacaaattccagagcattgctgccctcccccaaattactctgaacctaatcacatttcaagctaatttatgggaaatacaatgaaaagagaaatgcattaacaacaccgtgaacaggcagacagacaaatacagaacgtgagatattctacaacacaactaacctagtttctccaacacatcaagagtctgtataaaaaggagggggaggctattctagattaaataaatgtaggcgatacaataagcaaatctactgtgcagacttcgtttagattccgtatcttacaatccacccttacaaaggcatgttgagacaattggggaagattgaatgtggactgtgttcacgatgacacaaggagtgagtgtgaattttgttagatgtgataatagaaaatctccatagttttaaatgaggtgtggtggagagaagagacttcaagtttgaatttgttttaaacacttcagcaaagagaaaagtaaacaaaccaaaattctgagaagagacacatttggaaaaaccgtgaacattgttgagtctaagtaatgggtgcacagaagttcattccactattctgtctgcttttgtatatgttggaaatttttcattaaaaaaacttctagccccactatgaagccgtctgaccaaaagagaaggaggaaaaaaaaaaaaccctcatcgtatgaaattgcataaaattcagccaacctcaaaacaagaataaaaacatttttaaaaaaactcatgaatcgctgcatggctctttcaatttcggggtaatgatgtaattagaggagctcagtcattagaaaagattaattttaagacatctgctgctgtcagtggcagatggcagaagagtggaacattgaaagcacggggctctcaatccatctctgctacttaccgttgattttaggcaaatgtcttcaatttctgtcctcactttccttatcagtaaaatgggattaaagttctataggggctattgggaagattaaggggactcaaatatgaaaggcacttaaaacaatgtctggctcatagacagtgcttagtctacgtgaactactattattttcactttcatggtggtcagagcttcatgggggcacaaataatttggaccaagtgaagatattctcatatttggtttccaatattcagtttctcttacccattttccaacatttctctcctgcctgtttctcttcccccagtaaaaatgcccttgctctgtagactcagaacaaagctcaccacagttttagtggtctcacttgggtccaggtcattgcaatgggctatggttgggatgaaggaaaggaagaggtaaacagtgaagggtaatgttgctggtgtggtatctgaaagcaaaatgcctctgcaacctgaggattctctttcctccctggatctcttgcctgcctcttggtaggataccaggactccaggattccaggactcccccagtggcctcaagcacttcgtgttgtccagccatccttggcaggaaggactcttcccttacaggaagagtccttggtgttttgctttgtgccttgttttggtggttgtgggttggggtgtgggtttggtttggcttttctttttttctttttaatggctctgcatgagacatattttataaagttctacattttgctccagggccctgctgaacccaaccaggaatcaagcagaacatgtgtggtcctgtccgagtctgtcactgcacgttgggtgcctttttgaaggttgccttttgtgggcctagagaatattggaacacgcatcgtaaaatgcagacatctgaacttgcatcatgtgtttttctaaaaagctgatctcaagaggttgcatactgcgtgattccatttatataacattttcaaaatgacattttagagatggagaacaggttagtggttgccaggagttaagggttttgggtcgggtgggtctggggtgggtgtgcctatgaaggagcagcacagggagatctttgtggtgatggaatcgttctctagattgccgtggtggttacgcagagctgcatgtgtgataaaatgacacagagctacacacacactgcaccaacctcagtttcctggctttgacattgtactatggttatgtaagatgtaatcacagggtggaagacattgggtgaagggtactcaggacctttctgtactatgttttgcaactttttgtgaatctaaaactatctcaaaataaaaagttttggccgggcacagtggcttatgcctataatcccagcactttgggaggccaaagcaggaggattgctggagcccaggagttcaggaccagcctgggcaacacagtgaaatccagtctcttaaaaaataaaatacataaaatcaaataaaatgaaaaaagtttttaaaaataccagggacagcaaaattgggttgattgaccaaatgatgggcccttgttttacatgcgatcaagaatgagggaaacaggctgggcaaggtggctcatgcctgtaatcctagcactttgggaggctgaggcgggtggatcacctgaggtcaggtgttcgagactagcctggccaacatggcaaaaccccatctctactgaaaatacaaaaattagccgggcgtggttctgtgcacctgtaatcccagctactcgggaggctgagtcaggagaatcacttgaacccaggaggaagtagagtaaaagctttcccaccagctgtttttattttttattgtatgccaagctcatatgaatgagaattcatcaagcatagttgagagaatttagtctggaattgagattcaagactcaagctggtttccttttgtcataggactccctaggactcagtccgcttggctgaaggatggtgctctgaataggctgctggggaggcatattgcttatgcaattgcttatgtaagctgagtgcggcggctcatgcctgtaatccctgcacctcgggaggccgaagtaggaggatcacttgaacccaggagttggagaccagcctgggcaacaaagtgagatgcctgtctccacaaaaaaataaaaatgaaaacactaggcaggtgtgatggtgcacacctgtagccctagctactcaggaggccgaggtgggaggattgcttgagcccaggaggtggacaccaggattttgctaggcaacacaacaaggccctgtatctataaaaatagaataactgtttatgtcttcctaagagagtttttgggttttgttttgtttgaaatggagtctcactctgtcacccaggctagagtgcagtggtgcgatctaggctcactgcaaactccgcctcccgggttcacgccattctcctgcctcagcctcccgagtagctgggactacaggtgcccgccaccacgcctggctaattttttatatttttagtagagacggggtttcaccgtgttagccaggatggtctcgatctcatgacctcgtgatccacccaccgtggcctcccaaagtgttgggattacaggcgtgagccaccatgcccggaccctaagagagtttttggataaagctttccaatcagggagtaaaaacagcacaagggatgaagacatgggacattccgtggggaatatagattggactcaccgctctgaggagcgacatgcaaacgggtttttcagttttaaactggggggcccagcagtttttccttggggtatcacttctagagaactccaggcacgtgcacccaagaagacctgctccagtcatgtggaattcgttctcataacaacaacatggaacccctgaggactggacaggtgaactgtggaatagacatacctgcagataccatgcagcagtgagaaagaataaactagatttctgtgtcatggcatggaatgaacaccaaggtattttattattagagtgaaaaaacatcctggaacaagatgtacaagatcaatagcgataacaacacattcacaaaacacatttgtaaaaacagtactgtatattttaatgaaggtgtgtgggtgtttgtgtttataagctatttatcctattaattgtggatacatctggtaggaggtagtgccccaatgtggctgtaatcttatctgaaattttaaaatgtatttacaaatatttttagatgttatttgggtaaccaaaattctattttaaaagaaaaagggccatgcagttcttatctcagcaggaggaggcacaggtggactagttggggtcacctgttgaggaattcctactaagtctggatagcaaatcccactctgaaatgccaacttcaggagagcaggaacttgtctgtctggttggacactgtatcctcaatgtctgagacagtccctggttctttgaaggcccttaaaggacaggggaaggggaggaaagatgaaatcaattagtgaaggagtagcagctttgctctttggtgtgctatgtaaacagcatcggtgattctaaatgatgggcagcctgactcaatgaatgaatcagtgaatggctttagtgtcagctgtgttcctgatccatttatctgccttctagcctttgcaaaggaaactgaatttgccttatttatctggggagatgattcccaacacattgcagccctgccccacaacttctattcaatgacacttccccatgttaagggagacagggtaggggaggatggaggtgtggacaggaggagggatttgtgatcacttccttgtggcttgtggagttcttccccaaagttgttgaagtgacaacagcacctgaatttcactggctggacccacagctgattcctactctaatttttcacactgaacacctggggcgtgatatacctgtatcaaaacaaaaggcagtctgcagtcccgcaggcaagggtctgcccacggctccaggtaggcatcttccagggcttgtgtgcagcaggagagaacgtctcttctccagcagttcatcttgggcctcccgttggccccaggtggctcacgtgaccaccaccctggagccaatcactgtagaccgaggaatgggagatgctaattgccaggctcagagcttgttagtagggtcagtcccagccaagccacgtggactgagagtcatggggagacctagggaaattaaataactcacaaacacctgtaaaaactgttacagtgactggtgtgtgtgatagagggccatgggcctgtgaaagctgcaggagggaaatcgcttactcagggagagcctggggaaatcctgccggaactgaggcctctgcagggtgagcaggagggactggagttccaggcagagggaacagcatgtacaaaggccctgtggcaagagggagtgtggagcgagagaaaggccagcgtgctggaatcagatattggacaaggagaagccagatcaaggctgtgttcggaactctttgctttatcttaagagcaatggaaagccgtcagaggttataagcaaggatgaggtgaggcgggcaggttcagatttatgctgtcatttgctgcacagagaacaaactggagggaggccccggtggccccagggaggtgggcaggggggctgccgtggtcttcctgggcagagaggatggtggcttggacctgggcgatggccatggaggtgaactttataaggcctggagatggattggacgtgagcattgaaggagagggagaagtaagagcaatcctgagcttttggtttgagcaactgcccccgaaatgggggaagccaagatggtttgtgattcacagatgtattttgaatggaaattgaatgaggctggtggaggctgtcagagacgtccaggtttgggccacagctgctgtctgtccagaagcctgtgattgaagtcagcaggctttgatttctcagcccgtgaaggatgctgggagtgaccctctccaaagtccccttagccgactggccatctgtcctctgcatctgacagacagggccaccatcctcagccaaggtagctggtgtactcacgggggtgtggaaaggtgagcggcccacccgcctgggaccctccatctgcttttgatccctcccagcctttgaagctgcccctgcccccaccctccagctgtcatctctcgggctcccccacttcttcccagtccccagggacaggggtggtgacaagggtaacaaatggcacaagccgcaggcagcagcaggccaagggggccagagggagggtgttcctgaatgcctctttcttcccgctccttcaggctgtcttctgaagtagccaggctatcagggttttgcaacaatgcaacaaagaaagaattttttttttttgtaaatgaattccatgcttttccttcctttcccttccctgccttcgtgaaagggaagctaagtctttctcctaccccagattccttgaaggctgtctgagttctctcttccttcccctgcatagagaataagctggtctccaatttcaggtaattgtgaggtggggaagagtggggagaatgtgaaggaagccttccccaccaaagtgcagcagagctcaactctgcccctcaaaccacaataggaaccagtggtttccgggtgatcctgatgacagtttccagtgtctacctggaatgaaacgaatggtgtgtttcaagcctttgtctgtgtgcatgcaaataatctcagctgccctttgttgaatacccactcactcgtgccttctctgactcatttttctcagaataacctggcggggagggtattattttctccatcttatagaactgaggctcagataagtgaaataacttgcccaaggttacaccgctgataacgacatagctgggatttgaacccctggagcagataacacgtctggtgctctgactgggtagcttagtagactttagagctggatgggccctgagttgaaattgtgatccagagctatttgcaagctgtggttaagagcacagatctggagccagatcacctggttgagaatcctgactctaccactgactagccaggtcagtctctgaacctgtctccttatctctacctacttcataggatgaaacgagccagtgcatgcagagagatttaagcctcagcgtaaatgctctgtaactgtgagctgtttttatttctagtatctgtaaactaagcaatataattagggccaggttaagacctttagcagcctcaaacaccagagactggcctctctcctccattgtctcctccaatacaataataaaacggtgtggttcgtaagacaaaaaactcgctgtgctgaaattttttttacaattttgtttagttttgttttttattgatacataatagatggacatattttcagggtgcatgtgactgtttgatacgttcatataatgtatacagatcaaatcagcataattgggatttcatccccttagatatgtatcttttctttatgttagcatcattcaaattactctatactctggctattttgaatgtgtgataaactattgttaattatagtcaccgtactgttctattgaacactagctcttattccttctaactgtatatttgtacccattaatcaacctctcttcatcctccccaccacccttcctggccttcagtaatcacagtctactctctatcttcatgagatctacttttttagctcccacatgtgattgagaacatgccatatttgtctttctgtccttggcttgtttcacttaacataacgacctccagttccatccatgttgctgcaaatgacaggatttcattgttttttatggctgaataatattctagtgtatatgcataccacattttctttatccatccatcaattggtggagtgcgctgacatttgaaaagcttctttttagatcctcatggcagaacaggataagttcaccaaacaggaatgatttcacgttttcttggtgtctagactttgctcagacttaaatctgtgtttagtcggcctttgaggaaatacaggacagatccttctatctcccagcgtggttgagagaattaaaagagatcatgtaaatgtgatcaggaaaattgcctggtgtataataggtgcttgggaaatgagaaccatgactagaatttttggaagggttttactaactctggaaactgagttgccttgagttgcttgttcacattcctatactctgtggctaatagtttgcttctgcaagtcaccagtgcctgtagctgtagctgacagcaggaaagaacaattgtcaggttctcaagtcagggtcatgtttactttgtgaagattaatatttctgtagctttggctttattagtgctgttcatttatttgcctccaaaggatggtgtgttttgattgctataggtattttaattgctataggtattttagattttgcagatctaattctaggtctaacagagccctagaatcagtcaagtccctttcttcatgcacattaattttggaaaaaataaacttttaaattatcatatattggtggattattttatcattattgtatgtccctgtaaatctctaataatggtttttattttaaaatctatttggggtattgtgttgtattcatattattgaatccttgctttgaatcttggtatgtctttatatttaaaaggggtctcttgtaataagcatgtagttaggtttttaaagtcagtctggtgatctttgtctttcaagtgttgtatttattctgtttgcatttactgtaactaatgtaatataaacatacatgaaatgtttacatttattattattctttaagtggttatcctaaatattataggatacattcttgatatatctaaaagtttactataaattagtacttttaccatttccaagaaaatgcaaggtccttaaaacatgttaattgtatttatctatcctcctgctcacatatttacccttttatgttgttctttatctttgctgaattttcgtgtttccagaatattcttttttagtgcaggtttactgatgggaaacaatcttaattttggtttgtttcattttgattttgtcttcattttgaagtatttttttgctggcatagaattccacagtggcagatgaaattccattgttttgtggtttccatcaattctgctgagaagctgcttctcagtcttattataccttctttaaagattgtcttttattccccctctgactgcttttaagattaatttgtgcacatgtgcagtttaaccatcacatacccaggaatgcttttctctgtatttatctttgggattcacagaacttcttgattccatgacttgatatctgtcatccatctggcaaggtcttctgtcagtttctctttaaatattgtttctgacttgctctctctctcctctccttctgtggctcctattacatgtgtgctagatcttttaccatgtaccatgtttcttttatgctcttttaaacctgtttttcaaccttattcctgagatctgtttactgacttaccttccagtttgctaattctttcatctgctacatccagtctgtagttcaactgatctattgagttcttaattttaattatttcatttctcagttctgtaatttcctttttttttttttttgagatagagttttgcttgtgtcacccaggctggagtgcaatggtgcaatctcggctcactgcaacctccgcctcctgggttcaagcaattctcctgcctcagcctgccaagtagctgagattacaggcacctgccaccacacctggctaatttttgtatttttagtagaggtggggtttcaccatgttggccaggctggtctcaaactcctgcttcaggtgatccacctgccttggactcccaaagtgctgggattacagatgtgagccaccacacctgaccagtaatttccatttttaaagagcctagatttttttagcagcattctcatcttaaatcaatttttttattatattatcacagttgctagggactccgtgtttgacaacttcaatagcagaatctcgtgaggtttttgtttttgttttttgtcttggtttttgatcatttggttttgtctttttgcatgcctggtaatttttttattgtgtataaaacattgtggagactctggaagatgacatctcctccaaaagaaaagtttttctgctggctattgatgatagtagaggcaaatcactttggtcaaatatgagattgagatgactcaaggcaggatctattttgtttgctgttactccaaggaagtaatcctttagggtcccagttaaaagttttgagtgtttctcaaggctcctcatccttattggccatgaattccaatttttgccttcctgtaattaggcaactgcaaaaaagctctgcttaatttcttgcctttatagctaccccctttttgcttggtttctctgcctctcaccgcacccagcttggatatcagcaaatgcctcaaggctaataactttcaacaatatgagactcatacctctgtggttctcatatttctacaatctttgctcctgtgtcctaactactttagtaatcctgaactccagtttttttctccccagccccataagactggaaaactctaagctgttgctttttttcttctttgcttataaactggcaagtgtcttgaggggaaaattgatagaggtcaaacttggtctgtttttcatctctctgggatcttgttccctcaggacctgccttggttgacttccaatcccttaagacaatattttatagctgttatttttgatcatgatagtgaggttgactaaaaatacaagctatcccgtcgtagctgggaggtgcactcagttggacagtttaatacatattaggaaaaatggcttatttttgttttcttcaatatggagaaaaattaaactttaaaccacataaaaaggcagactctaaatgaattgaagacttaaatatgaaaggtaaaattctaagtgaatagtttaacatgtagacaaattttaaaatcccaagaatagagaaaggatttttacacctacaaaaagaaattattaggtaaatatgtaaggattttttgttctacaaaagataatagaaataaagaaaacagacaaatgaaagactaagagaagaaatttacagcattcgaaaaacacattgaatacctagactctgtaatgcactccagcaaatcagtaagaaaaaaaaaaaatagaaaacccagtagaaaaatgggcaagcataaaagatctgaacagacaatttccaaacattcatatggcccacaattatgtgaatatatgctcaaactcactagtaatcctagaaatgaaaatcaaaataactatgagttattgctttccatgcatcagtttggcaaaaagtagaaagtggggccgtgccaagtgttagcaggaaattgtgaaactggaacccttatgtacttctggtggaatctagaatggcacaggagttatgaagaacagtctgctagtacttgttcaagttcagttcacatatactccataacacagaaatcctccaccttggctataaatacattttaggaatgtgtgtgtatacatatatatagggagagatactgcattttaaaaaatgaagatgaatggagatgttcattgcagcattgtttataaggtggctgagagataaaggctacctagctgttcaccaccagggcaatgcataaattcaatagagtgggtgtgcagtatagaattatagctacaagctagatatgcatccagtaacatacacatgtttaaatcagtgcagactgaaaataaacagccttctaaacagagtgagatattgtgcacattattcattaaattaaaacacatgccacacataaaacaacatggcatcatttataaggaaacatttacatatttaatatgtcagagtcattgtctagggcatggtggaaaataaggataaatgggaacttttaaaaatcttgttggaagaaggtgatggctcaaataagatttccttcctccctgtctctctctccctctgccccttctttcctcccttcctccaacagatgctaactggatgatggaatgaacaagattctgtgttaagtgctgtggaggaaataaagatgatttccccattggcttggccttcaagaaccttaggcaagggcctaaggtgaatacaccagaagccttagtagcaatactctgtcccagagttcagactcataaacacattcctgctctgcttaaaatcaacaaatgctgttttggatgtgtaagagctcttaaggatgacagcaacactcagtaaagtaaataagctacgtgactgaggccagaagtgtcacactgccgtctctttccttagcaggcttttctgataatacatatgacatagctctcaaatgcaaatgcctatagggaccaggaggaaataccaatggaaaaagagggtcaaatttaagagagtagggagtggtggggactgtgacaaaatggagcccatatgccttgacttaattgggccgccactgttcagtgccagctggttgctgccatgcaagaataaggcaatactcttgtattttcaagaaaagccaaaaatctagatttttatgtgaaattgtctcatttttaaatattggcaactacctcaaatatttttaaaccctagggagtggggaaaacaattcattttgtttttaaccacatttggtcagttggctaacaatttgctgcttctaatactctcatagcatctggatatctggaaactagtgatattttttaacctcattgtttatttttttaacctttcattatttgcacataccgaaaagaatgaagggaatgagtttagataagatgcaaatttctggcacctgtagccagataaaagatacaatgtctaccatttgctaagcaccatacaatatgctttgatgtattagagggagcaagacacctaggcctctatcctggagtgcctgtggcatttgagaaacaagaaaacaggcacccaggatgcatgtatacgtggggacattttaggactcaacatttatataaacactggagatatatatataatatatctctatatatctaatgtatatattatatattatatataatatctctatatatctaatgtatatatatacacattagatatattatatattatgtattatatatcgatatataatatatagatctatataatatctatatatataatatataatatatctaatgtgtatatatatacattagatatatagagatatatatatctctctccaatataaagatataaacaatagagctgatttgtgtattagcccattttgcgttgctgtaaaggaatacctgatactgagtaatttatttcaaaaagagatttatttggctcacggttctgcaggtggtactagcatggcatcagtatctgttccgcttctggtgaggccttgggaagcttttactcatagtggaaggtggagggccagcaggcacatcccacggtaacagaaggcgcaagagagatgcccgactcttttaaacaactagttcttctgtgaactaatagaacaagaactcactcataccatggagaggacaccaagccattcatgagggatccatccctatgacccaaacctctcccactagccccacaacactggggatcacgtcacattttaacatgagagttgaaggggacaaagtccaaaccatatcagggtgggattctgtcatcagatcaaaaagtccatgtacagaaagtacttcctatgtgcaagcctgagataagggctttcttatttaaaaattattaagtgtttcaggcatacaaagatgggtaaaacatacaaaagtagggtacccagcatcctgcttaactgatacaggggttggcaaacttttgctgccagatactaaataccttcggctctgcaggccacacacggtctctgttgaaactactccgcttaacactgtggtgtgaaagtaaccacagacaggatagtaaaccagtgagcagggcagtgttccaataaaactttacctatggacactgaaatatgaatttcgtgtcattttcacatattatgaaatagtatccttcttttgattattttgcaaccatttaaaaatgtgaaagccgttccagacttgggtcacacaaaaacagctgtgggctggatttggcttacgggccataggtagtgtcagcccctgaattaaagcactacatagtctgagccccccaggtgccacttccaaaattacatcccctcctacccccagagttagccattctcttgaaaacagtgttgatcattcctgagtgtaattttgtttttgtggaatgcatctgtgtccattaacagtacagttggttccaattcaaggattcagttaactacagatcaaaaatattcggggagtggggcaagcacagtggctcacacccgtaatcccaacactttgggaggctgaggcaggcagatcacctgaggccaggagttcaaggccagcctggccaacatggcaaaaccccgtctctactaaaaatataaaaattagctgggtgtggtggtgtgcacctgtaatctcagctactcgggaggctgaggtaggagaatcacttgaacctgggaggcagaggttgcagtgagccaagattgcaccactgtactccagcctggaagacagagtaagtctctctctctctctctctctctctctctctctctctctctctctctctatatatatatatatatatatatatatatatatggggcaaaaaaaaaatacagaataaaaataatatatgttttaaaacaatgcatataacaactgtttacatagtgtttacattgcgttggacattataagtaatctagagatgatttaaagtatatgggaggatgtatgtgggttatatgcaaatactctaccattttttataaggtacttgagcacttgccaattttggtgtccatggcggggggcgggggtgggtcctggaaacagccctcctgggatactgaggggcagctgtatttttgaactttatgttgaataagcatttaagttgctattaaaatagtgcttttttttacatgaatcatctttttaaatcttcaccgtgaccattttccagatgagaaaacttttgacttagagcagtttggtaacttgctcaaagtagtgggtagcacactgggatgtgaatttgcaacctttttacaatgggatctgagtttataagcaccacaccagcgatcgctacgttgtgtttcattaaccaagtaataactgatcttgccaaggatgaccttatgataacgacgtgctcacaataaatttagcctttctctgaagacaactgcaggttaaatgttactggttgtagttcagaccttggaaaattgctacgccatgtacagtggtgtgtgcgttaaccagaaaccttattttctaaacccagtgggtgggaatttattaatatttattttgagacagggtctcactctgtcacagaggctggaaggcagtggcacgattagagctcactgcaccttccatctaccctggctcaggtgatcctcccacctcagcctcttgagtagctgggactacaggcatgtgccaccatgcccagctaactttgttgtatttttttgtagagatggggttttgccatgttgcctaggctggtcttgaactcctgggctcaagtgatctgcctgcctcagcctcccaaagtgctggaactgaaggtgtgagccaccatgcctggccagaatttagaaggagtgactaccaacatggtgcaagaattagaaatgttttcaattaaaaaatgagaaagaccaaaggagacctcatccctactctcccctgcccgccccccataacatattataaaaatcatgggtgattcaggagccagtatgttctctcttggtcaggtccacagtgatgagctgttgagtgttgccacctagagagttgttaatgacacttacgccttttgagcttttctccgtccatgcaagtagtaccgtgtttgtttgtttggagatggagtctcattctgtcgcgaggctggagtgcagtggcgcagtctcgactcactgcaacctctgcctcccgggttcaagcgattctcctgcctcagcctcccgagtagctgggactacaggcatacgccaccacgcccagctaatttttatatttttgttagtagagacggcatttcaccatgttggccaggatggtctcgatctcttgacctcgtgatccacccgcctcagcgtcccaaagtgctgggattacaggcatgtgccaccacacccggcctgtttttctctcttaaccacagtcaactccacgttctccccaagcctctggcttttggaaatctaaatccaaacgctccctctctgcctgtctgtctctttctcagctgggaagttgccctagtttgctctggctcatttatatgacattgaagagagaccaaaatataatttttctaatggcaaaatacagcaagaaggaggggaatgttttaatcaactgggtgtattctccagcggggagcaagaacttcattttaatttctcatttccctttgatgaaaagttgagtgaatttttatcatgtagaatttataagaagtctgggtttaggtaatcagttgtaatatttatactcttagggaaagaaataggaatcattagcaagcatgcataattaatgaataaattatatttccctttgttttctttcaggtacaaggaaatggtagaactagtgatctcacccagcctcactgtaaacagcgattgtctggataaactgaagtttaaccgtgctgacgctgctgtgtggactctgagtgacagacaaggtaggcttcctgctgtgagtttgggtcaacaggtgtggtggtcctaggtcaccctgagaatatcgtaagcaacagacacgcatcctttccaaagtactgtccttaggacaatttctccccctgccatttaaatgcttgcctctgaaccaaaactttggcatacatctctaacaactctgtctcatcgttagaggtaaaaatgtgctcattcgtgtcttgaacttcctttcttggtctccaattccaagaaatgctgacaccaccacggatgatagtcactttggggcgtgtcccaggcccagcccttggatgtgttttgcagtgtctgtttctggctctgagctctgtcctctctactctgctctgccatccccttgtccaagcaggcgtcttgcttacaggggtttgacattagggcaagaactcgtctgcctcttgctttcaggtcgggttggagtcaaggaagcagagaagaattaaagttgtttaaaaaactattggcaaatgatgcagtcgaactagttttcactagaacaattccagctattgtttgttctgtttcagatctgtcagccttcctggtagagcttggagttagcaaaaggcattaagctattatgtttaaccattgggcttaaccctttctttggccagctttgggatttgctgctgttgtcctgagaccccctcgttgtttttccttcattatctgtttgacaccagctcatgggacacaaatgctatgtaactgtcgtggaaaaccaaagtgacacgtatctagtggaatataacatcacaaggaattggctttgaagccaatccaggcttccatgagtaattattgctgtcagcaagacaatgacatttctccttgcatgctggttacagagctggaactgcgctgatgaaagtaccaccagtggcttgggctctcatgccaaaactggatggtgaagaacataccctcattcttcctggcactttggaccattcgtgtaaactgcccaggggcctttgagagtttgagaaaatttactgagccccgttcaaagacattcatcattttctttccaaatagagacacaagtcaacttaagtagagacgcaagtcaactgtcttcatttgagagcccgtagtaacaggaaaggacataggctgctcaggggggaatcccagcccactgcttctcagccaaatgatctcaggcaaactgtttaacttttctgagcctcagttttctcacctgtcaaatgggggcataatggcgtacttcatagggtgctgattgcaagaaggaagtgaggtgatgggatgtaaagtgtctggcacaccttgggggcatggtgcatggttaaatgtaccattccattgtcactctcctctgaaccaaataaccacagtaaattcaaaaccatggttgcacacagggcagcccacagccacatctggccctgaagtttgtctttgtttggtttacactatgttttaagtaaaagtgaatttgtaaaaattgggagcattcacataaaaatctggagttctggtttatcttaaaagactgaaggctggctgggagcggtggctcacacctgtaatcccagcactttgggaggccaaggcaggcggatcacgaggtcaggagttcaagaccagcctaaccaacatggtgaaacctcgtctctattaaaaatgcaaaaattagacaggcgtggtggcacacacctgtaatcccagctacttgggaagctgaggcaggagaattgcttgaacctgagaggtggagtttgcagtgagccgagatcgtaccattgcactccagcctgggcgacagacgtgagactccgtctcaaaaaaaaaaaaaaaaaacgctgaaagctttagcaaccctgggcccccacattccccgctggctgccaccagtaggagctgagaggctgctgtcctgtagatgaatccccgcctctcccttttgtccttaattgttatgagcacatactttctgccaggcactattcaaagcaacataaatctagattcattctcctcctccctccctgtcaccatcagaacaaacactcggcacttgtcgtgtcccagcattgctctattaactcatttaatcttcacaactctaaaaagtgggtactgttattatccccattttacagacgaggaaaccaaaatgcagagaggttaagcagcttgattgagatggcacaggtgatagcccagatttgaacctagatagtctgacttcagagtttattctcctgatcagtactctgtactatttctcatttaattattatacaactggtaggctatgagcccattttacagacatggaagttggggcatggaggagttacgtaaccaggttaaagtcacaccagaatcaaacccaggcactctggttccagagttcccacttgtaaaccacttctaactcactttctgccaagctgtaagagtctccagaccctggatcttcaattctcccacagtggtgaaatccacagacacactcctttttgtgacttggagctgtcagtgccctttctactgccctggaacaatctggctgccatggtgaaggctttgagggtggaagcgatgaggcagagagaggttgctcccaaattcagaacaggtagcgccagtgaggtcaggttacacacacacactttctttctcatggggcaggtggtgagctccagagactctgcaggggacattccaccctggagcatgacccccaagtgctggattatgcctctccccctgcctggcctactgttctccctcctcctgggccattccttctattacagagtctttactaggtggcttcaaaggtcctactcaaaggaggacccccaagagtcatgagtcacaggacctgcactcagggggattctggagggagcatggagccaagaagccccccagtggcttccattgcattcccacctctgcttcttaccagctgtgggaccctggctagtggcctaacctccttgagacccatttgccccatctgtttaatgggagtaattattccaccgacctcacagactcaatgtgaggatgaaatgagttgaaacagggagtggacttagtgtgcttaaaaagtatagaacaagatctgaattccttatccttggccaccaggccccacttgtctatccctggaagcctcccaaactcatctccgtccctattgcctttgctccttgggcccagcccctggccccttttcctttgctttaactgagaagcatgattctgccctccgagcctttgcatctgctgtttcctctgtctggaccagtcttcacccaggctctgcaggaccagccctccctcagttctcatcagagaggtctttcctaatgaaaggaactgccccttccttcattcatttgttcattcatttattgaacaaatgtttaatcagccatgtgcttggcatggttttaagtactagggagacagcatagaaaaccctatcctcatggagcccacgctagggtgctgacaaagcaaaaagctgacaatgacgataaagaagcaaagtatttagcacgttgcatagtgatgcttgctgtgaaggaaaaaggcaggggaggagcatgaggaatgcaagagtggagggttgcagtttttgttagggtggctagaaaagaggtccctgagaagataacacttaagacctgtaggaggtaagggagggtgccacatggctacacagaacaagagccgtatgcacagagaagacagcaagtgcaaaggccctgaggcagcagtgtgctcaaaaaactttacatatattaatacaaacatatgtacatatgcatatttaaatttctgttcctgtttagcatgcaacttagtgcctggctcatggtagatccttaaaaaattatttctgggtgagtgaaggggtaggtggatgaagacagaatggtgctgaggaacccagataactttagggagatattggttctgaatccttagtaaagtttccttcacttccccctgcctcattttctacatttgcatcgtactgatgacaataatttccttactgcgttgttgtggagaataaagagatcatgctcatgcagtccttgccacagtaaccctggtttgtttgtaggaaccacttgagaaatattacctattattccttatgattcaagggaaaaatggatttgaattgattgtatcctgtctctgggaaggggtggtggggagttcccctgaatagaggaaaatttttcttttaaaatgcacatgcatttttcagaaactgatgctctaatctcattgtttccaaggagaggtgaaaccaccaccctacgctacaagctgggctgtcagctgctctcacttcctgcacctcctctgccctgggcatgacaagacctcattttcagtttcagtctcaccggttccaacccggggctgacgggttttgattcatttcatccaaaccaggctgagctgcccagagctttgcccaggtgctggcctggggaaccacatgtcagcttcatccttctcacctttaaggcttttgtagccgttcacacccagaacaacctctacctgtgcagaacagaaatcccgctttgtgggaggaaatggtgctattaatcccatcgtggcctccacaggtaaagagcttccactgatggcagtagctcacaaatgtcatagtctcgagccactttctggcgtatattcagaccacctctactgccacttggtactaatttgttcttttttttttttgagaccgagtttcgctcttgcgaaccaggctggagcgcagtggcacgatctcggctcactgcaacctctgcctcccaggttcaagcaattctcctgcctcagcctccggagtagctgggattacaagtgcccaccaccacacccagctaatttttgtatttttagtagaggcagggtttcaccatgttggccaggctggtcttgaactcccgacctcaggtgatgcactcgcctaagcctcccaaagtgctgggattagaggcatgagccaccgtgcctggcctgttgtttctttaaaacaactcctttgaaataaattcattttaaaaggatgacttaagccagttccagaaatgaaacgttatgactttgatggtcttgttgtgattctaatgtacataaaattaatttgcaacgatttcaatcaaagagggagtatttatagactccctaaaatcatcgcagtctgggacttgcagcctcattcctttctgtcctcagtggcacctcccgcaagagacaaagggcttgctcatggtcacagagcctctcagtgacagtcagaattggggcacccacttctggatgcctagtgtggtgtctttccagctgtccctgtccctagtatgggagtgatttaaatcacccacacaaggaagatgaactgatacagtttacagacatttacctttatagcagagacctgcctggagacatctcgctggcactacaaattgtctcatctcactgggggatcccttagaagccggcccctggggtccaattaggcaacataacagccgttgctgctttcagaatcattagcttcttaatcctcccagtgagaggtgaaaaaagtgtgaacattcaaattgtgctcatggatttaagtggcttaaccaagggcccccaggagagtggaagctaataatagctcctctgtgctgagcacttaaccatttgccaggtacctgccccatctgcatatgtgcaagatattgccccaatttgcagatgagaaaactgagactcagagggaagaggtgaaggacacaaggtctcatggctgtattgcagcacagccaagatttaaatttggatctgaccccttaagcctatctgttttctttggaaagaacatcaacaaattatgagaatgggttgtagatttggcctacggtaggtgcatgataaacacttgttgactgcgtgaatgaatgaaacatggtgtgtatcctcgggtaagttgcttcacacagtcactcacatacacaattgcacataagtatgcactcagtatgcacagactgaagctttaatttcctctcttaaaactggatcttttgctttgcacatttatattgtctttgtggccccaatatgcacttgagtttgtgtcttctggaatggagatttctttttatgaaccccaaattgtgataatgcttagtgatgtgtagttttgtattagccagtggtctaaactcttactcctcaaagtgtggtttgtgaacctgcagcgtcagcatcacctggaggcttccttgaccaacaatcagaacctgtgttttaacaagatccccaggtgaatcctggttccaggtgcactggtctcaaatgtccattgcttcctttgcacctcgttataattgcagttaagtactcatttgtgtgattgtttgtcatccatctcactcactagacaggaggcttcgggtccataaagacagggaccctgactgccttggctcactgtattagtccgttctcgcactgccataaaaaaatacctgaaactgggtaattttaaagaaaagagatttaattggcttacagttctgcaggctgtacaggaagcctggctcaggaggcctcaggaaacttacagtcatggtggaaggcgaaggggaagcaggcacattttccatggctggagcaggaggaagagaggggggtggcaagtgcgaaactcggtctcaaaaaaaaaaaagaacaaattagtaccaagtggcagtagaggtggtctgaatatacgccagaaagtggctcgagactatgacatttgtgagctactgccatcagtggaagctctttacctgtggaggccacgatgggattaatagcaccctttccccccacaaagcgggatttctgttccgcacaggtagaggttgttctgggtgtgaacggctacaaaagccttaaaggtgagaaggatgaagctgacatgtggttccccaggccagcacctgggcaaaggtctgggcagctcagcccagagaactcactaacgtgagaacatgataaaacttactcactatcatgagaacaggatagaacttactatcatgagaacatgaagccaggggaaaatacacccccatgcttcagtcacctcccaccaggcccctcctccaacactggggattacactcactgttgtaacccagttctgaactcatgcctggcaatgaatgaatgagctcagctgatccctctctcctcacccataggaagcttgggaagtagaggaggctcagagtttacaattcagaaggaaatagaggaggcactctaccctccctacttggcagccagctggcccgttatgcatcagccacagccccttcatcctgtgggttcattctcaagccctgggggaggatgaagaaggggcaaagctcagagtaaacagatttggttctgttgggcgccaggtcattagagctgctttcactaccagcaaagtggacctaagttgccatcaatgactcctccattgaccttgacctcatagcctacatggtccaatatgaatccatcacggcaagttcaagggcagcaacaaggttgagaacagaaagctatgatcagtgggaagtccacctccatctgccagacaccagatcccaaagagggcattgctgccttcatcaccctagagatgcttggagctcatctgaagaatggcatcaaaggggcatcattctgtcccttgtgctgatggtctgtgtttgagatgagggtgacctactccctttagatttccagcatgccatctgcttgttcccccagaagggtctatgacaaccatggcatcataaaagtactcatgaccactgcctgtgccctctctgcccatctggcaagctgtggtgcgatggccatgggactgttcagagtgtattcagtggcactgccaaggctgtggcaaggtcattcctgagctgaacaggaagcttgctgacacagcctcctatgtccccaccctcagtgtgtctgtccaggatctgacctgccatctagaaaaagctgttgagcacagtgacatcaagaaaatgtgatgcgggcacctggggggtcattgaaagaaattccgggctacactgaagaccacgttgtcgcttgcaactgtaacagtgatgcccacttctccacctgtcacactggggctggcattgcccacaaccaccagttggtcaagcctacttcctggtactgtgatgatgtttggctacaacaactgcagggtggacttcctggtccacatgacctctgaggactaagggctctggaccaccagcaagtgcataagaagaagaaaggcgttctctgctcttgggcagtccctgcccacctctgtgccaaagcagagaatctccacccttgacagtgtcccatccaaggctcccagaggagggaaggagcttagagagccctgccttatcatgtgtgtttatgataaggattatcaatgaagtccacaccaccctaaccatggagaaaggaagcagaaagggaggcagaagatcactctacatagagtttaatacactcactctccagtttctcaattcctccaggtgtcctgggatgaaaaggttaaatgcgattgataccagcagaaaacagaaaaaagcctgtgttttttcaaaaatcacacaattgccaaaggaaaatctctttgcacttacaaatgcctgtttctcgcttgcacagtcttcctgaggttgctggggtgggaaagggagagtatttacaggtctgcgtagtgggggaggggaacctgtctgctggggaaggcaggttgctcaattcagaggaactgggtggaagcttgaaaaggagctgggtgaggcaaacatgcaaatcatgccatggagattggcagaaaagacgcttgcctccaatttatggaatgccaagttaattcgagcccataggaatgttgttcccatagatttagatttttatgaatatatacatatttatgaaagaaaacatttaaagtgtttaattcagtaacttatgcagtactaaatgcactcaagtcatgggcttttacgaggaatgagattgtggctgcttcagaatgagacagttcattcttgagccctgtgggaggatgaagaaggagtgatggggtacaggacaccccgcctaggagcaaacccagggtagggaaatcagcattgagtgagcacctactgtgtgccaggggctttccttgacattcggctactgttgttccatccttttctttgaatgtgatacatgatgcgaaatatatttctgcattgttgaatgcacgtgcatgcacacacaacacattctcacacctggacctgcaacaaaagggttacacaattccttcttactatgggcaatacctgctgccatcgtatatcataaaataggcaattctccttttcttaattccagttatgactctctaaatgaacttcaagaccaccacccccgccccaaccccagtggtttgggacttgaacagaatttggctcagccagggggagggcattaagagtgttgaccttggactcacacagcttttgggttcaagtcccagttcccttgcccacggttgtgtgacttgaacaaggcacttgaccttcggagccccggtttcttcatctgtacaacggggttaatggcatcgcgtgctcagagcgctgttgtgaggactcaatgagagcctgtctataagcagttaacaagggcctggcacatagtcaacctctaagtgaatgccagctgctcttatgacaatgactgtcatcgtcagctgtagtgtcatggttgagaagacagactctggagccagaccacctgggttcagatcacagatccacaccgtacttcctgtgtggccctgggtgagttacttaagctctctgtgcctacagctgttcatctgaggatgagaatagaacctttctcacagggtacttatgaggattaaaataattaatccaggtaaagaatttagaagagagcttggcacgtaataagcactgggtaaatgatggctatcagcatcatctcatttaatcctttcctgtccttgcaagataagtattttcatcctcattgcacaggggggagccctgaggcccagagatctaggaacttgcctgaagtctcataactaggaagtggcagagttgcaagtgcacgttggtctcctgagcctccagcgcagaggctgaggcaggctcagagctccacagccttaggttgtgatgatgacgcagccactgccctacagaacagggagtgggcattggcaggttgacgctgttcccatcagtagacacattatctagaatttgtccaggactctgcagtgaggacattgagttgcattgttcaagatgacggagcacaaaagtacttcccagtgaactgtccctatgtaaaattatccccgggcaaacgtctctcccagcttaactctgtcaccttttcgtcaccccctgcatatcgcctcccatcaatgattggacattgtgtgctgagtgattgggtgttaggtacttgcatcaggagcccaggtgtcatccatctctctgctccaccaccctagatggagcttaggagatgatcgaagtggttccttcccctaaagtgttggggccagctgcacctgcactccatggactggaagtgaggaggcaggggaggaacatcaaagccatgtcattagaagaagggaaatggaggttggatgagcaaagccagcctgtgtctgccattctggggttcttggggattgcttttgaggcagggaagggagcggttttccatccaggagtggaaatggcaccagcttgattcacttcctagttgtgctgctgcctggtcatgtgacttggctcaagcacattctttctgtctctttggcctcagtttctccatctgtacaatggatggagaaatggactctactctgatgtttcaaggtgctatggattctttagatgtcatttttccttaactgcacagagacgaagtgcacccagaaagggctccgaactcctcaagaagaagagtgctgagatgtggcgcctcagataagcatctgtggtggagaaagccgcgggcagcacccctccaagtctgctcctgcttaagtggtgtctgaagtcaccacctctgcagaacatcaccctaatcgctaaaactcttccaatttttctttttctcctgcaggcatcaccaaatcggcccccctgagagtgtcccagctcttctccaggtgagtgccattcacttgtctcctgctcacatgcccaccttttcttctttcttggaaggtagaggttaagagagagggccctggagccagattccctggataggaatcccagccgtagcacttcctagctgagtgagcttgagcaagtcactccacctccctgggcctgagccctcccatctgggagcgggggacagtcatgctgcctgcccccacgaaaccagcaaaagcaggtaaaacacacttagaatggggcctggagcagagtgtcctcagagtcttagctattattttcttctttcttctcttcattcttttttttttttttattcttttctttctccccttcctctgctttcccatgcatagggaatttcttaatttttccctccctttttgccactgtctttctttctcctttcctcattcctttcctttcccttcttttcaatctcccttctattttttttttctccgagacagagtcttgctctgtcacccaggctggagtgcagtggcgtgatctcagctcactgcaacctctgcctcccaggttcaagtaattctgcctcagcctcccaagtagctgggattacaggctcccttctttctatccttatttttctctccctttttctctttcccttcctctcttccctcccctttcgtcccccatccttttctctccacctctctctcccttttcccctccctcctttcatcatttctttactttattttaagttccagtatacacatgcagaacatgcaggtttgttacataggtaaacatgtgccatggtggtttgctgcacctgtcaacccatcacctaggtattaaattcgacatgcattagctattcttcctgatgctctccctctcccctacccttccctaacaggccacagtgtgtgttgtacccctccctgtgtccatgtgttctcattgttcagctctcacttgtaagtgagaacatgcagtgtttggttttctgttcctgcattagtttgctgaggataagggtttccagcttcatctgtatccctgcaaaggacatgatcttgttcctttttatggctgcatagtattctatggtgtatctgtaccacaatttctttacccagtctatcattgatgggcatttgggatgattccatgtcttggctgttgtaaattgtgctgcaatgaacatatgcgtgcatgcatcctttcttcctcctctaccattcacacatcactcctcagtacctaaccccacactgagccctagaaactcagagatggatgagatgcagtctctgcccccggagagctagtccatattgatggatgagacaccttccaggactggggctgacatctccagctcaaatgagtttcttatgcattttgcagcaggttcccccaaataaccctttatcgtggcagtagtctaaaagaaagaagggcatagggacatctgtttataattccataaacttttgcattcacctgctgtgaggcctcaggtggaagaggaactctggaagcaaacaggctttagcaaaagtgatgtaaccaaaatggaatcagatacagattggggaatctcatcaacatttacctgtacgcttaacccagttgtgacagttagaaacatgatagttgtggtgtctgggggagggtggcatagtggaggggttgagggtgtggcctctggagccagggttcaaattctctatctgctgtatgcttgtggcgtgttattaagtctctctctgcctctgttttcttacctgtaaaatggggatagaaacaaaaattacctccaaggcttatcacagttgtggtggagtttaaatgagccaattcacatgaagtaaataggacagtgcctggcacgtaggcatgagaattgactacctttaccactaagggaagtggcccttgtaggcattgttgcagacaggatgtgattcggtctcaagaggtggctgctgctcaaatccagctgatagcaccacacaggcgtgcagacccaggtacgctgaagcacctgcttttcaggagaaggaagacaaagcgagtgtgtttatgtgcatgcctgcatgtgtgtgtgtatctgtgcacgtaacctcctggttttcaaattttaacaacaatttcaaattaggaaaaaaaataacttcactggtcaaagaaattatatccatggatctgtggattggatgtggcccctgggccaccattttgctccctttgtgttagaacaactgaccttgactttatttattgctatctgcagggctggatgaatcctagtcctgtgaggaatagcagattcatggttccaagcatgggctctggagtcagactccttcatttaagctctatatttaccactttgtagctgtgttttcagctctctgagttttggtttcctcatctctaaaccaggagagataagagcctccaccccagagatttgataagagcatccatgagatataatgtacataccaggtgcatgtgacacaattcccaacccttagtaaaaaacacaatgcttggcagcacccatagtataaatatcttaagtaaggagccctgtacatcctagcccattatagaacctgttgttctccatggagtagagaagtcatttgtggtctttggttgcaagcaacagaaatcaactctggctgatataagtctaaaagcatttttgggggaatatctggaatagctcacaacataaatgaaataatcaggcctcgagagagattaagaatgggacagattcaggattcaagcaatatggaggatttaaattcccagggcagagtctgattggatgatcttgcatcatgtccccaccccttagctaagagcaggacatcttgattgacagccctgttaaagctgcagtcaattgagaaggtatctaaattaggacaatcggggtaggataggctatgctacagtaatcagtaaacctcgacatctcagtggcttcacacaacaaaggtttgtttcttacataaagtccagtgtggatggggtgaaaccctgcaaggcagctctctctcctccacaagctgactcagggatccagggtgtttccgtatcatggctctgtcatctcaacctgtgccctccacagttgctatcaaaagaggagaaaggacaggagggttgcgggggatgtgttcattggccaggcctgcgagtggcttacagcatatctgcttacattctacggggctgaacccagtcacacggctgaatctgactgcacaggagacagaaaatgtaatcttcctgcttcccaggcagaggaaaataaaatgggatttggtgaacatgtatgttgtctctgctctggaaagagtagaaccccaaagaaaaatgggggtgttgatatcaagataaggaagaaggggtgccagactgggcctggagatttaatcttccctctttccacacagatcttgcccacgtgtcctcccccgccagccttccacagccatggcagcctacggccagacgcagtacagtgcggggatccagcaggctaccccctatacagcttacccacctccagcacaagcctatggaatcccttcctacagtgagtagtaaacaagtccttactctcctcctcaggtccccaaatcatggtctttgttctgcactattgtctcagctaaatgtggattaatagacacaaccaagctgattttggattagagataaagggaaaagagtaacactttaaatatggttcaaattctatagcctataatatcaagatcccttttgatggcaagaattggaaattgaacccaagctggtttagggaaaattgggactgaatgatttgcataccgagagatctgtggatacagctgtcatcaggtatgactggatctaggtgctaaagcgtcatcgtgaggtgtaagtctctttccatcttcagatgctcccagcaagttctccctgcatggcagcaaagatggtgcctgtccactcaaggtttgcatccttttatctctgcatgcccagtggaaagagagctcatctttcccagaagttccaacagaatcccatattggccctcattggcccaagttgggccatgtggcaatgcttatagcaaggcaaggagaacagggtgatggagataaggaagctgaagcctatggattatctttgaaggaggggtggttttcttaaaggaaaacagagtggtagtatcagaagaaggagaaatggatgtggtggaggacggggcagaaacaacagacctccagcccttgactgttcacatcttacagctaagaactgaagacttgcgaacctggctcaccatccatgcccacctgcccttgcctctggccttgagtcatgctattccctcgcctcctagctgatatcttaaccaaagcccttttagtagcaagtgacaaaaacccaagctaatcagctggaggaaacaggggaatttattgcctatgtagctggaaaaacctagggcactggcttcaggcaggcctgggtccaggtcctcaaggtataatatcaggactcagcctctgcttccctttctgtgggcctcaggctcaggcaggctctcccactgtggtggcaaagacagccctggcagtttcaggctgcagtgtcccccaaaaagagagcccctcctgtctaggacttcctgcagagtcccaggaatttctctactggactcccacatccatccaagaagataggtgctgtgggtggccatatttggccacatgtccacccgcaggaccaggggtcaggtcagcctcacccaaaacaactgatctgaaggtgaggcaggggtggttcacaaaggagaaggaggcaggaagaaactacagatagccactccacgtgactttacagcccacccaaatccgggctatccagtggaaaggacgtagcgttggtggcagggacctgcctgcctgacttcgctgcccctgacctctccaggcctcagtttcctcaattgtaaaattaatatgctcgtttcatcttcccacctagaggggtcctgcttgagttgagtgcagaggctgactcttacatttctttcctccctcctcttcctccatacctctgccctgtttgtttgttcattcattcattcatttattcattcattcaacattgagtcatgtgtggggcagacagtggtcaacaaagcagagcgggccctgtcttcatggagattactgcctaaaaccgatgatcaggcagcactagactcacagttttggtatcaggggtcagtggctctatgtggacaaaagccctgcagacatttccttttagctttagtttgccacagtcctcacccagcccacgttactcccttgaattatctgccttttccatgaagacacttgagtttgcaaactctggcctagagatagaaaaaaaagtttttttaattttctttttttgagacagcatctcactctgttgtccagccagagtgcagtggcaccatcgcagctcaccgcaagctcaacatcacaggctcaagtgatcctcccacctcagcctcccaaatagctcagactacaggcatacgctactgcgccctgctaattttttgtatttttttgtagagatgaggttttgccatgttggccaagcaggtctcaaattcctggcctcaagtgatctactgccttggcctcccaaggagctgagactacaagcgggagccactgtacctggccccagatttttaaatctgtatgtgtaatttcaaattaggatgcacggcataaaggaagcaaagacttgttttaggttctagggatgggaaaggccttttaaataaggagcgaaattcagctgagaactgagagatagccatgtgcaggcacagacaggagagcatccaggcagaggggcaggccctgggaatggggaggaacttggcaattctgagaagactaatggctggagcacaatgggagatgaggtgaatgaggtgggcggggcctccgaggcccaggaaagatttggggttctgttccacgtgagactggaagccactagagggtttataagcagtgggtaataggatgcaacttaggtgggttttttttaattttattcttatttttattatttttagagacagggtctggctctgtcttccaggctggagtgccatggtgcaatcatagctcactgcaccctccacctcccaggctcaagcaatcctcctccctcaccctcatgagtagctgggactacaggcacgcactacctcccctggctaatttttttttatttttttgtagagacggggggtggggggtctcactttgttgcccaggctggtcttgaacttcttacctcaagcaatcctcctatctctgcttcccaaagtgctacaatgacaggcatgagctaccatgcccagcctaggttttaaagatcacactggctgctgtggtgaggctggctcagaggggatcaggaggagaagcaggaaggcccgttgggagacggatgaagcctggagcaggaaatgttggaggcctggggcgaggccatggcagcggacagacacatgtagacagaatcaagagcaactctagaggcagaattgacaggtcctgtcgaggcatcagtccaggcttagtaatagtcaccatcgttgacttcctgtcactcacattggtttatttccactaattcctttaatccccacctcaaccctacgaggaaggtcatctcattatcctcccttgagcgataaagaaacagagactcagagaggttaaataacttacccaaggtcacccagctggttggtggcagaggtggaattaagcccaggcagcctggctctggaccccgagccctcacccacggggctccgacgcctggctgtgcattctgtaaatcccgggggattacctatgacagaccttggccaacaggtgtgggcatcttttctaacttttttcccctgctgtgctagaaggcttagaatacaatcacacataagttaccccgcttggctgacagccaagaaaaatgaagccatattctttttcacataaaagagaaaactagccctgttcccagacaaaacatggcatcagatggaaatcaatttggtgcaaagttattttactgtctcagttacttttggagcgtctgctcctggatgatacagagtagatgataagagcacatgtcctggaattctgctgcccagattcacatcccacccttgcctgttgcaggctgcaagaccctgagggagcagcctcccctccctaaacctctgttttcacattcatacaatgggagtaatactaagtctacccctctcatgattgctgggaggattaaatgagatcatctacaccaggggttggctatcttcttctgtaaaggcccaggtggtaaatactttctactttgtgatccatatggtctttattacaactactcagctctgccattgtggcgtgaaagtagccagactgaatgtaaacgaatgggtatgtctgtgttccaataaaactttatttacacaaacaggcagtggaccagatttggtccatgaccctgatctagatgaagggcttcctcaccagggcccaccccaagagaaatgctcaacaaatgtcacctgtcccagtagaagccaggctgccacacacacacgcgtgcacgcacacacacatacacacacacagaatgtccatgtcactgaacaataacaggtggatgaaaagccgtttccctttacatctgcctgtgcctgagcaagctgtgtttgctcatcgtctggacaaaccttgttgaatcttgtcaggaaactttttacattgctccttggcaaatagtgctatttactttgtttaaatacctgcaggaaataacacaattgagcaaactagagacaaggacagttagtgtattgagtatttttttctcaatttattatgcaatattaaagacatacataatagagtaatactatgacacctatgaactgaccattcaatttaaaaaataaagggaggtggctttcctttcctctcaaagattcctgtgcccccaagtttcatgtttatcattcccctgcatttttttatgtagaagagatcaacaaactttttctataaagagccacatagtaaatatttttgtcttagcagaccacacagtctctatctcaatcactcaactctgccattgtagcatgaaagcagccatagacaaagcataaacgaatgggctgtctatgtctcaaaaaactttatttacaaaaatgaacaacagatgacatttggcctatgggctggagtttgctgacctttaatgtagagtattttaagcatgttttaaaactttacctacattgcatcttttagtacacattcttttgcaacttgctttttccacccaacattgtgtctgtaaaatgtatccctgttcatacaagtagctgtagttcattcattttcactgctgtataatattccactacttgatggcaccataacttacttacccattctttagacagtcttttagggctttgtttgtttctcattacataggatgctgcaatcagcatctttgtgcatttctcaggggtggaaacctatgagaggaatttctgggtcatggggtatatgcattcttcactatcctggataatggcaaagaattttcattgtctctggctttgtaaaaagccactccagaacttagtggcttaaaataacactgacgtattatttctgtgggctggccagttgggcctgctgctggtctcccacagtccctctcatgctgctgtgctcgcagcaggtgggctggggctgcctagatggcaccagtggggcctctctctcatgtggcccttcctctgggtttcttcaggcatggtgggctcaggttccaggaggctgaagataaaagcttcaaagcctccgggtgctgagtctcaagaactactgggcgtggtggcacacacgtgctcccagctactagagaggctgaggtgggaggatcacttgagcctgggaggtcgaggctgcagtgaactgtgagcatgccactgcactccagcctgggtgacagagtgaaatcctgtctcaaaaaaaaaagtagttacatatttattttaatatgcatttatatctacatatatatatgtgtatgtgtacaaatataaatataatatatataaaatatggaacctgtgatttcttggtcattattgcttaaggcaagcaaatagttttaaaattgagttgattttttttttttttttgagatgtagtcttgctgtgtctcccaggttggagtgcagtggcatgatctcggctcactgcaacctctgcctcccacgttcaagtgattctcctgcttcagcctcctgaatagctgggattacatatgtgcaccaccacacccagctaattttttgtatttttagtagagacagggtttcaccatgtttcccaggctgatcttgaactcctggcctcaaatgatctgcctgcctcagcatcccaaagtgctgggattgcagacatgagccaccatgcctggcctgatgtttaaaaataacatgaaatgaatcattatatggatggtgctggggtatgggaaaaccaagcaagtggtgcacaacattgaagatggggaagcactaatttggtccaaaaccctcattgtagtcacgaggaaactgaggcttggaaagcagagggcacctgcctcagtgataccacagagccaggacaggaaacgagtactctgggctgtgccatgtgccatgggctgatccaaattcacatcacggagcacctgctcagggggctgttgatattttaaacttgaaccatctcctgtctctcctctgctcagatccctccagggcccctctcaggatcaaagccaaaggttttccactgcagtatctttgccctgtccccaccttgatgatctttctgacctcatcactcaccctctccccaacccttaccccactccagcctcactggcctccttgctgttagttcatccaacataccaagtacactcctgcctgatgacctttgcacatgccttccctctgcctggacaggtattccttcgggtgtccacaagtcttgctcctttgcttccttcaggtctttgttcaaatgtctcttcctccctgggacctcttcctcctcctccaagggacctttcaggatcactctgtttgaaatttcaaatcccaactccccttaaccaactttgctacctccttccctgcttcattcttctttttagcaccttaagactctaaatggagtccaaaaaatttaatcatgtttggagaattgtgttagtttgaggttcataagatagcagggaaaagtgtgtgccgctgagtgtgccagggagtcagggagccaatcatgttgtctcttgtgttacccaaaaagtattttgtatgcttctcctctgctgtgtgtttttacttgtttttctgctgtcattctcctcccactagcatataagctccaaccgctacagtatctgtagcatcaagatctgtatctcctgacctgttgcaggtgctgagctaatagttgtgaatgagtgaatgaatgcttattggctgtctgttgttgacaccctctctgaaatccacatgctcactttggtgcttccatgagtggaagccagtggaacttgcagatagttcacgagcaccttttcggaggcctctttctctttgctgtgaagatacttatcagagatgcctgcggagtagcaggtctgatgagatcagtctgtccccaggccaaaccgtgaccagatttcctttgaacataatctcttagagcagtgtttctctatctggtttaaaagaccagtttttgggtttttgctttttaattgccattccactgtggactaatattttagtaaaaatgaattaccagaaaaatcaaattaaaatttttatttacttatttatttgagatgaagtctcactctttagcccaggctggagtgcattggcatgatcttggctcactgcaacctccaccttctagtttcaagcaattctcatgcctcagcttcctgagtagctgggattagaggtgtgcaccaccacacccagttaatttttgtattttttgtagagacagggtttcgccatgttagccaggctgatctcgaactcctgacctcaagtgatccacccacctcagcctcccaaagtgctgggattacaggcgtgagccaccgtactgggccaaattaaaatgttttaaaaacatactaaatacaagtctggagaaatggccttagatgtcagaacaatgccaagttgctgcaaaagtttcaggatgtttacttctcagtgtctgactttctcattctgaacttgtaactgatgcatggaccacagtctggacaacagacttaggggacgaaggccctcgtgcgcctttgccattttcatattctcttctctttctcatggattagaattttatgatccaaccccttcagcaaacaaaagaagagatgaaaaactttattttcttttctttcatagtcattcatttaccagacaatttttgagcacctactatgtgcaagacagggagccacatatggggagactgcagggtacaagagggaaccagccccgccctcctggagcctccagcctaaacagagagcagaggttcaacagtgaatggggttgagtgccaggcaggagaactgcatgctactcggggctgacttaggtcatagaagacctttctagggaaacaacatttgcctgatagagaagagggaggtgtggattccaggcagaggaagcaacatatgcaaaggctttgagtccaaagacatggttgcagtttgtctgtatcatctatttaaaatggacaatgtaggtacccttagaggcagcaacttttgtcttgtatccaaccaagacaaacactctgacattgcttgaggaagtatgtacatttcatcttggattgtgatagtaaaaactggaatcaacctggagttcatcatcagggaactggctgaacaagcagtgatatttccgattctggctttccatcccgtcactaaaacagagtgtctgagcatatggcttgggcagagggagcgaaggagcccaggaaaggcagtgaggtcggaggggtgggcagagcccatgcagggccttgggggtcactgcagagtttagattttactttaggtgcacagtgaggcagactgtacccaatgcaacgttaacgactcctagtggactgagcaaaaagaaggtgctgtataaatattgcttgttgctgccatcattgttgttactaaagtctggcaccatcgatggcataaaaccccttcacacctgttattgagaagcatcaaggtaaggaaccttgacttcagagttatccgccaattgctagaccccagtccaatggattggcaatctcaattcccacatctttaaaatgaaggaagtaatatatagcctgttttgtgggattgatgtgaggataaaagagatgtgttctttaattacttcattcagagcctttatatgttcattctttcctcttactttaatttcctaacaacccatcatttcacaagaaaggaggcctccaacctggggttgcaggagaaactttccaggtcaccagtcaatgaagcaaaccatctaggactccagcccagatttcctgactcacaatctatctgtttttaccttactaagcattctcttattttacggggttgacaggataagaaggaggaaatttcaatacaaaaaccatcagcagaactagaaatgttcttgaaagaaatgaaattttaaacagcaatgagatactgttctatacccataagatagacagagataagcaatgtttgataacagttgatgtggttgtggagaagcaggactcactcagtgactggagagaatgtcacctacaatctagggagcaccattcagcaacatccaagaagatttaagatgttcttgccctggactcagtgattccagctactgggaatttacctaaaagatagacttgcacatgtgcacaaaatgtgtgtgtgtgtgtgtgtgtgtgtgtgtgtgtgtgtgtgtggtgtgatgactataagctgcagcaaatacatatgtatatgcatataggtacatctatatgttaaatatattttctgcatgtatatatgtgtgtatatatacacatttgttgcatgtgtgtgtgttatgtgtgtatttgctgcagcttaaattacagtcataaaatctcaaaaccacccaaaagttaatgaataggaaactggttaaatgatgaggaaaccacacattagaatgtcacacagccatcaatacagaataaggaagaactttataagctcatgaagaataatcattaccacatattgtgaagcagtaaaagaaaaagaagaaaatgaagaacagaatttatagaatactcctgtttatattttaaaagatggaatagatatatacgttacatatatatattatatacataagtttgcatatgcacagaacctgtctggaagtgaactgtgttccataaagctggtaatcgtggttgcctataggcagaagagctggggtttgaggtcagggataggaagagactctttgctttatgccttttgtactattggaattttctacaatgcattcattacattttcagtaaaaattaagtgaatgagctgatgatggttagcctctcctcctcaacacagtccctttctcagccagttgttcatggaattagtacctatgctttaggtaagcatgccgagttttgctgaagcagaaggcagatttgtaactgtggccttgggattagcaggtccccccgtgagattggagagtgtcttacagttaagtgatatcatctttgcagaggaagggtggttcatttcacacctttgcccaaaatcctaatggacatttaagccatacacagcactactcagtggagtagtgggctgcaggcttgcatacctaccaagctggcaggtagcatgaagctcacggtggcatgtacaaaatatgagaccttcatacctaccaagctggcaggtagcatgaagctggtggcatgtacaaaatatgagaccttcttggcctgcctttcccttccccacttttgatagggtcctaggatgtaccaaaacaaatcacaactgcaatgagaaaatagcacgttaaaaccagcctcaaagtcctgcagatggaatggaatctatcatgacctgggaaacacctgaattgggagcccacaggggcagcttgtggtcacatgggttgcagacatggtgttactagaccatcttgtcattcaaaaagaagccgtaagtccagctttttgtatgaaatatcctgacttttaacaaaatcaactaattcagtttttcttaaaaatatgctggccaagtcaaatgtctataggctcactttggctgacaagccaccagtttgcaactcctcatttggaagctgataaaattgcatgctgtcttgacccagtagctcttttgtgggtgacaaggacgcatcctaatcatgtgtccttggtccttttttttccccctcttccttcaaaggcatcaagacagaagacagcttgaaccattcccctggccagagtggattcctcagctatggctccagcttcagcacctcacccactggacagagcccatacacctaccagatgcacggtcagtgtggcgctgtggccccttcctgcccatctctaaggaccacctaagttgggtgtccattcattcattcattcagcagattttttgagcacctactatgtgccaggctctatctcgaggagtggagaaaatagatacgagatctgcctttcatggtcgttacctggcagtggggagagactaacgataaagtcggcaaataagccagatgatttgggaaggggttgaatgtaataaggcaaataaacctggtctttgcataaagagtgatgagcacttgggaggtcaggaaaggtgagatttgtgactttagatcaaatcaccagggaaggctctttgaagagatgacattgggcagaatcccaaagggtgaggcagagcagccacatagacatcttagggaagagcattccaggcagagggaacagcctgtacaaactgtgcatgcagggaaatgtctggatgtattggaggcacagagctgagaccagtgagactggagcaaagtcagaaggcatgtaggaggagagaatcttggagaaagagcaaggcgcaatcacacatggccttgagggatatgggaaggagtttgcttgtattttaagtgtgatgggacaggcaagtctattgtagagactcagaaatgtcgggtggtggaaatattggacagtcgggtgaagaagctgttattccaggcaggaggatcaaggctctgcagccctagagggtggccttaaggaagaaagaactccattgtgtaaccctccacccacctgccataaggaactggcttactgggttctcccatgctcatctccactcttttaccatccaagaacccttctctgttctggtgcccccttgggagcatgctggagttgatgcatggagcagggggctggtggctgtaattatggggatccccattctgctgtttccctttatataagctgctaaaaattaccatcaagggtctgaaagggtaaaatgataagatggtgggctgatgtgtgattgtacttttttttgagatggagtcttgctatgttgcccagactgggctcaagtgattctgccacctcagcctcctgagtatctaggaccacagctgtgcgctgctgtacccagctttgatagtatttttcttttaaaagcaactacttggaagtactatcacttcatctttattattttaattttttattaaggaagtaataaaaatgattgtcaagggcagcatttcaggaaaaaaaaattgtgaaaggagaataaataatcttaggtatgtgtgtagggaaagcaggtgataagcattcatgcccagccctgagaatagcttcctggtaaggtctgtgtccaagtttgtcagtgatgccatgagccagccttgaccaaacatgctaggtgccaggtgatgctctgtgggttctctcatacaaccttcatgacgctctcaagcaacggtactgtattattcccatttcacagaagaggaaactgaggcatagaaggaatgactgatttgtccaacaccagggcaaggattttagattttattgtaagcataatggcaaagggactgtgtcagatgtcttgggggcctggtggaatcccaacccccagcctcactgcaaagcccatcgctgtaaccccggcactttcctgcctcctctgcttctgctctcacgtctgtgtccccagtcgggcctttctgaggcccactgaagggagtaaactcctgagacccatctctccaagtggggagtgaatgatggcaccggccctgataacaggaggtgtgtgaaggtactgaacttcaacttgtatttgagtccatctcaagccagtttttttccagctctttaaatagaaactggacttactgcctcagggcttctgaggccacagaggttgaaatggagacccggtccccgtatcccattttgacaccccctcagccacacaataagtgatctaagttatgtaggagaggcccccattcattcattcattcattcattccgtatgttgagcaccagcttgacacctggcacccttctaggcactgagggcacagcagcacacaaagacaatctcctcatggagaaagatggacagtaatcaattgacaagtagatagataattatagattttgataaagcctgtgacagacaaaaacatggtggcatgctggaccgtgagcagtggtatggaccaggagtggtgatcggcattcagcaggtggtcaggggcctcccgatggaaaggaggctgccacaggaggggccagagctgggccgggccgtacaggcagcgggaacgcaagagcaaaggccccgcggcaggaaaaggctcacagtgttcaaggactccagaggagcctcatcctatcctccccagagcaggatatgcagaataatattctttcttcttacagcaaccgcgtgaggtgggcaccataagccctgctttcatagatggtgaaagtgaggctcagagagggcaagtgacttgcctgaaaccgcagagccaataagtgttcagagctgggattcagactccagtttctctggtgccacttcctctaaatgatgagatttcctggactccttcaggactccaggaactgtcctaatgtctgcacataaacatgcggcttaatctccccagtagccccgtgacatgagcactgccactgccctcatcttacaggtggagaaactgaggcataaaatgtttcagtcacttacccaaggtcacacggccatggcagtgggaaatgagccaggcagtcgcccaggcacataaccctcacgccatcctgcccttcacactctcttagatccatctagaaggtgattctcaggggtgagcctagggccccaccccccacctcaatccccaccagccaacgtctccagctctcttctcgccctaccatgggaatcgtccaggttattttcttatcctcctcacagcccagatgacagaagggcagcggcagcagctgggcttcgtcccaattaactgccttcagtctgatgctaatggctataaactgctcttgagacagcccaggcattttgcaagcctgacatattcctccttaagtatttttttcaaacacaaacacacagaacgctcacacaccatgcccatgtgcttcctattaactttttttttttctgagttgttccagaggagaaataaactctcgaactactgagagcatttcagaatggaagacattggttgagcttagtttctcagaggaagaagaaaataaagaagattgaggcttatgaacttttaggcctgaaaatgctgattttgtgaaattggcccatggtgagaagctagcatgagtctttttcctttctaagaatttaaaccataattttggcccataatcccagcactttgggagaccaaggcaggtatatttattgcttgagtccaggagttcaagaccagcctgggaaacctggtgaaacccatctctacaaaaaaaaaaaaaattatctgggcatggtgatgcatgcctgtagtcccagctactcaatatgttgaggtaggaggatcacttttcagcctgggaggtcaatgctgcagtaagccgtgatcatgccactgcactccagcctgagcaatagagcaagaccctatctttaaaaaaaaaaaaaaaatgctgggcatggtggtgtgcacctgtagttccagctactcaggaagctgaggtggaaggattgcttgagcccaggagttcaaggttgcagtgagctatgatcaccccactgcactccagcctgggcaatacagcatgaccctgtctcaaaaaaagaaaaaatatataatttttagaagcaaaaaaggatgctcttggggctcacctcatcattttacagatgagtaaactgaggcactgcaacagagtgtcttacggaagatcacagagcaagctttagacaagccaggatgcctcccactaggtcttctagctaatctcataaacttccaaaaactttagcacagccatcaccccgtaaggccctggtttgagatctgtatctgtttggataacactgcccctccatggaatatacaataaatgtaaaagaaaaaagttcacagctcttgttcagcctttgcagagttgtttattttctttattttaagttcaccctggggtttttatagctgaagtgtgtttcttatgggtttgattttttttctttttggcttcttctggtaaaacactgctattcacagaaataaccacaaagattaaaaagagggggaaaaaaatctccagagtgtgttataagaagtttctggtgccacagagttgttaagagttctggacctggcctgtggtcagtcctggcagtaccccacacacaatggcatgagttggggaagcacatggacttctctgtgcctcagtttcctcacctgtgaaactggtatcatagtgagagaggtgacaacatgaggctttgggagactaaataacatgattcatgggcaccacagatgagatccataaaggctagattttctttttattatctctgttattccttccttagcatggtagttaaaaacaactaaaagcagggactctgaagtcaggttgagttaacctccaaatacggctgcaaaccagccctgtgaccttgagctcagttacttctcagtcctccagtttccttccctatgaaatggggacactaagagtactttactcgtggggtgctatgatgactaaatgagttaatgtatgtgaagtgtttagagcgcacctggcacaaactaacgctctctaaacgttaattatcgttattatgattgacattgttagcctcacttcaggtttgatgggccatgttctttccaagttcgcttctatttcctgaactctcaattttagtaagtggtcagggtaagagaaaagaggaatactaatctgagactgtgggactgtctgcatccacataaactccccttccagtgaactctgtgttgtagggagacttaaaaacaggccaagtgcagtggctcatacctataatcccagccctttgggaggctgaggcgggcggatcatctgagctcaggagttcaagaccagcctggccaacatggcaaaaccccatctctacttaaaatacaaaaattagccgggtgtggtggcacacacctgcaattccagctacttgggaggctgaggcaggagaatcgcttgaacccgggtagtggaggttgcagtgagccgagatcacgccactgcactccagtctaggcgacaaagcgagactccatctcaaaaaaaaaaaaaaaaaaggcaagaaaacagtgggatccctatccagtggaaactctttttgcatttatgaagggccagggaacataaagactgaagcttagaacccctccagcagccactcaggagcaacatagaatcgtgcaattcagggatgtgtaggaaattaaaagttcagtaaaagcacttgttactcagtgatctcagctcgagacctccgagactggattgtgttggatttagaaagtctctgtgtcagattcatgaaatctaccaccagtaaactgtgtgaccttggacaagtcacaaagccttcatgatctgtgttccacagttctagtgctaacaagagttccaggaaaaaataaaggggttggggcgggtcatggtcatacataccaaatacgtttagtcaatagtgcatgccacaaagttaaaatagacatctttgctacaggacttttcagagcctttgcaggctgttgtgccttgtacttctccaggaatagaattcaggaggcaattttcccaggcagatgggatgagggcccctccgtccaaactcgttctgtggtcactgagaagccctggatgtcatgatcttttaggacccttcctttatgaacgttctttgaatttctattgttttaaacaatgaacatgtatgtttttctttttcctgtgttttaattaaattgtttcttgttgagatggagtctcactttgtcgtccaggctggagtacaatggcatgatctcggcttactgcaacctccgcctcctggattcaagcaattctctagcctcagtctcccaagtagctgggattacaggcgcctgccaccacacctggctaatttttgtatttttagtagagatggggtttcaccacgttggtcaggctggtctcgaactccttacctcaagtgatccgcccacctcagccccccagagtgctgggattacaggcatgagccactgtgctcagccttaatttttaactgagatataactcacatcctaaacttcaccttttttttttttttttttttgaggcagggtctctgtcacccgggctggagtgcagtggtgcgatgacagctcactgcaacctctgcctcctgggctcaagtgattctcccgcctcagccttccgagtagctgggactagcaggtgcctgccaccatgcccagctaattttgtttattttttgtagagacggggtttcattgtgttgcataggctggtaaacttcacctttttaaagtgttcagtttagtgtttttagtatattcactaaaattgtgcaaccatcaccactatctaatgccacagcatttttgtcaccccgcaaagaaaccccatgtccattagcgtcactccttagttcccctccctccgatatattccttttgtaataaaaaaaaaagacacatgaattttttaaacaggttacacatttacctagttcgggcatctgtggaaatctttcttctaccctcatgctacatccaccccgtttccaaacccctaacaattaaccactgtaataatttcgtgggaacccacccagaacatctttttgcaaacataagtaaaatataagcagtctattatattgtatgttactattacaagaattagttcagacgtgattcataaataagaaaactatgttagtataactcggaagttgcattgtttcatttgcttctaagggtttctctatcactgttgttgttgttacgtgccttgatgtagttttctttatgattctcgtgctctgtgttcattgagactcttagatctgtggatttatcatttccatcaaatttggaaatttttcagccaatatttcttcaaatttttgtctgatgttccacaccactacctcccactccaagttcataaatcttttcttctgtagtatctgatctgctgctaattacatccatgtcatttttcatcccatacatcattttcatctccagaagtttgattttgggtgttttttttttttttttttttttgaagacagagccttgctctgtcacccaggctggagtgcagtggcgtaatctcggctcattgcaacctctgcctccagggttcaagcgattcttatgcctcagccacctgagtagctgggcttacaggtgctcaccaccactcctggctaatttttgtatattaagtggagatggggttttgccatgttggccaggctggtctcaagctcctgagctcaggcagtctgcccacctcagcctcccaaagtgctagtacaggcatgagccaccatgcccagcctgggtctttttctgataacttccatgtctctacttaacatgtccaatctttcttctggcttcttgaacagatagaatccagttgtagtaaacgttttaatgtccgtgtctaattctatcattcctgtcatttctgggttcattttcattgatttttctccatgtcgaaaatcatatttttctgcttccctgcatgcctgataagtttcaattggatgccaaacataaattttaccttgtcagatgctggatatttttatattcctataaatacttttgagctttgttctgggatgcagttaggttacttagaaactgttgaatgcttttgagtcttgctttcagccttgccagttgggatcagagcagtgtttggtccaggagaaatttttcccactactgaggcaaacccttctgagtattctacccaatgccccatgaattgtgaggttctgcaattctggcaggtgggaacaggaactattcccagctccattatgagctctgaagcttgttgcttctgatcttttccagtggttctctctcagccctgggtagtttccttacacccatgtgctcatcagttctcaggtggccactcaaggggaactgtgagcaaacctccagagcgctcccagcacaactttctttttctgggagttctgctctgccaattccagccacattagcctccgctgacttgcagctccatctccccagctcagagagaccacgggcctccacctgggttttcccttcttggaaactctatcctggggcaatcatacagctcaccatctgtttctcctcttgcaaggatcactgtccatgcctaaggcccaatgtcttggaaacctagttttcaaactgtttcagctgggagggtaaatccagaccttgttactcagtcttggccagaagtgaaaattccactgcattggttcatttgtaatttttccagagcatgggctaacagcagctgaatgtaaaataccaaacacaagcaaatgcagcaagcctggtatgagtacagttctgctcagaatgccctatcttcttcctcttcctcagtttggttacatgttctattttgggagaactaattttgcaattcctgccaatttttatgcattttgcccttgtttccataattcagcacctccatcatctcttcatcacctccatcaagatactttcacttccttttaaaagcaaagatctctatttaatgtaatgcttctcagtttattatttacatttttattttttcaccatgctatcatttttactgggattgtcactgctttggttaatgctctggttacaaagtggcattgctgtggggcagtcagctgtaaccctacttcttcccataagctctctgattttagtgcacaggtttgcataactcatggcctttcaagaaagcattatcacatgatggcagaaacacttgtctatattcttttcacagataacatcctatgcacactcttctgcacttcgttttcctcatttagctatataccttggaaagaacttgctaagtcaatatatagaaagagcttcttcattctttttcatagatgcctattattgcattgaatgatgtgctataaatgattgagccagttccttactgggggccatttggcctgtttctactcttttgcaactgcctccgaaatggtcatgaaaacccctatatgtatattattttttataagtatatctgaagggcaaatttccaaaaagtaggagttggggtcaaggggcaagtctatatttaaatttggtagatatcttcaagttaccctccatagggattctacccatttacactccccccagcagtgtctgggagtagtacctgttttcacaaaaactcatcgacccagtgtcatcttacggttgaagtttttgccaatctgatgcgtgaagaaatggtgtctcagggcagtagtaatttctaagtcttgtcccacaagtgaggttgagcatcttttcagacccttgactgatttgtatttcctttcctgtgaaccaggagatttgacttttaaaagtttgcaaaagaaaagcaattaagtactaggcataccaatatttaagcatatcataaagcttcaataatcaaagcaacatgcttctagtgtgaatacactcaccgatcaatagaggagaacaaatggtctcagagagagacccacacatttagtacgtggagaaggtgatgtcttgagtcagtgggaaaatatgaactattgaatgaatggcattggaacagctagttagccatctggagaaaagtatccattcctactaccagaaaacaaatccaaatggattgacggtttaaatgttaaaaataaaaccataaaaatactagaacgagaataagcacaattttttataaccttggagtggaaaaggcttttctaaccaggactcagaaatccaaaatccataaatgaaaagattgacaggttcaactacagaattttttttttcttttttggcacggcaaagaacaccagaagtcaaaacaacaaaacaaatgacaaaaaacaagcaaacaaacaaaaaaaaagaaaacaaaatgacaaactgaaaagaaatatttacatctgaaatcacaaagaaatgttactttttcaaaaatgattctactagtctatggattgaacctgctccaggatgtggttcttctcaatcaggatttcagactcaaatagtacagggccgagcagtaatgtaaaagagagacatgagctagatatagggttatagggagtggtgggaactgtagcaaattagagactaaaccccccaccaacgctggggatagtggggtgttacttggcttcagcccattgctgcccctctagaatggatcccaaggagaccacatctttccatttttcaaagtgatccctaaaactctatttaatgtgaaatctccttattctttttcaatatggacaattgatatacactctctttgaaacaccttgtgaagcatacaaacacgtataaggctggcttcatgcccacatcttgcagtcttgctccatattttaactgaaccacaggtcccgagatgtctagatggggcaaatcacaagctaagtggtgacttggggaaccacacagatcacctcctttgggttcccccacctctggcttatttcatcagtgaggtatgtttcagagaacttgagtgataggtgtggccatagttgagagtggagcccagtggcctcctcatggtgaaatggagtcatttccctatttctctccggtgatggcatctttcaggctgtcccagcccagccagttttgagcagtctaaatcttcctgatctcactgcatcggtcaagacaggagccagtcttggcatcctatgggttgttggactgaggccgagttccctaatgtgaatcagcaactcttctgcacacaatgaagtgggtgaagtttccccatgcatgtcagcattctcgcccctgtgcaacacctccagcctggggggtcactctcccctccccttcatgtgtgctggcaggcttgctgccttttgcttgagctaaagtcttctgaatttagaacgtatagagtttaaatggagggtctttcctctagttacataacaagttagatttggtcacccctatctccaaaagccactggaggtaacaggcggaaacagctggagagattgagaatgagtttgggatcaggagggagtttagttcaacagcaatttgctaaggcagtgctgtccaacagacccttctgtgatgatggaaatcctctgagtggctgtgcaacgtgatagcccctagccacaggtggctactgagcactgaaatgtggttagtgcaactgaggaattgaatttttaattttgtttaattttaattaattgtaaatgcacctactctattgggcagcacaggtctaagcaatgtttcaaagctaactcttaagttgtgttatggactgaattgtttcccgcccctaaaattcatatgttgaagctgttacctccaatgtgatgggttttggtgatgaggcctttgggaggtgttagggttaaatgaggtcatgagggtggggtcttcagaatgggattgctgttcttataaaaagaaagagagagagagatctcgacctccttgtctctccctgaatgcacatactgaggacaggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagacagtaggtttttcctagacatgcaaaagcagaaatggaaaagctaatatcctgagcattttgtttgtttctcttttgaagatgcttcaccttcttctcttcttgcccccactatcagacggattttcaaagcaaagcaggtctacgtgtggcatcaggagctggtgagtgacagaagctggtgccttcatatagccgtcatcccagtagatattaagggagcatctcctctgtgccaggcactgtgccaggtgctgagaaagcagaggtgagcaagacaaatacagtccctgcccccctggagttcacaccagggatgagagatggacaataatccaatgatggcacaacacatgtaaaattgtacctgtaaagctctaggacacagggccaagacagagtctgcaactgtctggctccaagcctgtgctcttcactctgccactggtcacagatccagatgcctcatgagccagcccacaaggtcagtgtgtgaagatggctgggtggccctgtggcaaactaaggagccccagccctatataccggggtagccccaccccattaaagctggttattgcgatgccatagattattcaaaatttaaattaaaaaaaaacaaatgccagaaatcttttataagaaatttcccaattaaaaagacttaaattggtagcaacaaatttttaaaataaaataaaacttactgtgcaagccaaagcacatgtacagattggattcagcccacaggctgccattttgctaactgtgttctctatcatgaccatggagagaactgatgtgaaggcaggggactctgagctcagaaggggaagaaatgggggttagcatattcaggacagggtgtaagaaggcagaagggccacaggttatggatgtgtcctgtctcagccacatcagctggaagaataatgatggcgtggtttctagaattaagagttgaagttgaacaagggctcagcccatagaaggagcttatcgaagacatgctgtggcaactttgcctggccaccctgtagctcgccagttactttgatgggcagccatggcttttatccatattttcagggcagaagacaggtggaaccagaatgatgccataatggttgtaaccagtgggtggccaatttggggttgacataactgtatctgcaggggaagcatgatcaggtccttcttcatatttaaggcttacctactccttttaccccttcctctataagtagcactgctgtctcttacatccttttcctcatacctcccattcattctgtctacaaggttactaacttccttattctctatacttaacacatctttacattttgcccatatcacccaagctccttgcctactcactaagtttttataacacttcttccaagtttcattcaccccatctctttttcttttttctacaacacataattgaacatcgttaaatattcaattaagaattattgaacacagtacagttacaattgaacatattacaatagcattcttacaaagttctatgtatgttaaagccctgaaaaaaaattctgcttgtaaaatggactgatgtgttggaacagaggtgagcaaactttctgtaaaagagccagagagtaaatattttagattttgagggtcataggtctctgtcccaattactcgtaactctgtcattgtagattgaaaacagccatagtcaatacgacaacgaatgggcaaggctgtcttccaagacagtgttatttacaaaagcaggtggtgggttggatttggctgagctctgtgttctagggtcatattattaaaaccagatcttatctgcctgaatgtttggttggatatttgaaagtcaggtgggacctgggaatggtcttccttttgctggactctccacacattgcagaatgtctgcacctctgtcacctgcccactaaatgccactagttcctccaataaaagtgtccccatgaatttccaggcaccccctaggggtactgcagccacccaaccactggtttacacagtggcaggttcaggcatggggagaggtggctgtggtgtaggaatgaacatctgtcattcactcagcaaacattcaccagcgtaggctctgttgcaggcagcatgctaagcatgggccacacagccccaggctgacagtcaagccacaccttcatggaatttatatcccagggaggatacaggcggtgcatgagtctagttaacctgccataacaaaataccatggtcttggtggcctagacaacagaactttattttctcacagctctgggagctagaagtcccagatggaggtgccagcagattctcttccttgtgagggcttgcttgtatatgctcgctctgtgaacacatggcctctcctctttgggttcacagagagagaaatctccggtgtctcctttttttgaaagacagggtcttgctctatagcccagactgtagtgcagtggtgcaatcgtagtcactataacctcgaatgcctggactcaagcgatcctctcgtctcagcctcctgagtagctgagactacaggtgcacaccaggctgctgctgcttataaagacaccagttattaccttgtaactcttatgacctcatttaatcttcattactactctggaggccctgtttccaaatacagtcacaattgggggttacagcttcaacataacgaatctgggggccacaattcagttgcaacacgcagtgggtaaggaaatgagcaaatgacaagatgatgtcaactgtgatgagtgctccaaggagaataaacagggagatgtaacaaagagaaaccaggaaggacgccaggctctctgaggaagtgacagtggagctggcacttgcaaattcggaagagccagccatgggtcacaagtgtcgccagcagataggaggccaagtggctgaggagccaaggggagaggggtggggaatgagttggccggtgctcaggcaccgggaagccatggggttctaaaacagggcaggtgatctggtttgcatctcagaaagaccagttgactgctgggatgagtggactatggggggatggcaagggctgcaaggaggccaggagggagttctgtcctgagacagtgcctgacctgtccctagctctcccttcccctccgcttctctaggtcagacacagtgaagccagtattcacaagtgtacctgtgacaatgcctgccagatctcagtgaccccattcagaaaattctagaattattacaacttatccttttactcccagaggaatgaaggcccagagcacggctttgatgacgttgcttttgtgtcacttgtttcttatttcatttgtttatcatttttatttctgacgtttcgatgaaatgagaactgggcccacaaccagggtctgcacctgcacaatttgttgaaaagtcatagatgaaatctctctgccatctgatcattggcaggggcaggggtgggggaaggggagtggaatgagaaaaaggaaaaaaaatgcaccaaattttaaaaaccagtacaaacacacaaaaaatgcagagtcctatccaaggaacaagtccctgccctgctaattccttagagataaaaggagagcagcctgctcccagcccaggcagcccagccttctgttcaggaattgaaaggggtaattaaggggtaggggaaatacagcctcaggcagggagccatttattagagaggcacagacagacacacagaccctgcaactcctcagttcagagaggaggcacagccaggacagaagccaggctgtgggatgctcagtatgtacccttaaagcaaaccagatttttgctgctcctaaaagttcaggtggtaaagcggggaccagagtccagattccacccacctttgagttatgtgcttctttccctgggcccggggaacatgcagggaattcctgatttttgtattatttcccattcagtagctttacacatgtcccaggaaggcagcttagccccctagtcctgaatccacctgccttcttacactgctttttatttttcatacatttattttaaaccacatcagtgctattagtgtgtatctttccagaacattctctatgtatgcatttacgagcttatttttcttctcaccagtagaaaatcctgtttttttaaacacaagtaatatcttggtgtgcatcttgttttataagttgtcttttatatttttcgccaattaacatgtctcggagatctctcaaagtcggttcaaacaaacccactttagtctcttgtttggcctctgcagacgctgcagtactgcatcgagaaagccagatgctggggttgaatctccgcctctgcactcactggctgtgagacttgattttctcatctgtgaaatggggtttataggagtagcttttgtgaagcctgggacaaagtcaagtgcttccttgctttggctatcatggttagtgttatggatataccacggcatttagccattccccttgaaatggacaaaacttcccacatttcactgttttcacagagaagcctgcaatcttgaattttggttgctgcagccatttgctgtccccgtatgtgtctccctttgtggcaaccagggcccccttccaattcccgcagcaggcctcgccaggtctcgccacactttgcatctctgctactccagccctaaactgcagcctgtaagaactggcagctcaaaaagattgtgcaacccccaagaccatagctcagggccatcccagctgctgctgcaggtgagccctagccggctgcctgacctttaggtcagtggagtatttttgatcgcttaggagcaagagaagagagccaagaggaggcaaataccgaagcctactagagacaacccaggatcccagaagtgtatttctagaaggggtgatagagatcatctaggtcaggggtcagtccaaataggaaaaacttcaggctttgcaggctatacagtctctgttgcaactgctcaactctgccaatgcactgtgaacattgttatagatgacacataaacaaatggcatggctgtgttccaataaaactttatttacaaaaacaggtgaccagcccacagaccatagtttgccaactcctgatatgagttggtctaagtcaatccatcccggggcctgggtgagttgctatggctgcctttagtgctgttcctgacactgaatcatacacaatgacccagagtggcaggactgtatttcttgcccttcttgcaggcaaggtgtcggggagaggcagtcagctaattctagccactgaactgagagtggaaatgatcatgtcatgcctaggccagagcattcaatggccaatacaagactctgccagtgttcaaattgaaggctgctcctttaactggtgcccttgagtgactccagtgaacatagtccctgatgattctcaatggacatatagcatgaaagatagatcaactttgattgcattcaagccagtgggatattggggatgtttgttaccacatcataccataacctctcctgactaatttattggcacaagagattattttacatggaacatgaaagtggcactcaaagtcattgggtcacatagtgaggaagtcattcccctttctgtcatctttcagcccttctgattcagtgataaagggaggaaggaagtctctatttgatgctgatatatcttcaatgtgtctctaatccctgcaaatacttctttttaacaagatgagagcaaaccctaggtttaaggtctttggcagacaacagtatttggctagaattaaaaacatttgttccctatgtattttttgtgttttgtatttatcattaatggcaagtggtattgattttctatttacagtaataatataaagtcttctcagacaaatttatttaagtaaaaacagtgaatgattatacggatagggcttaggacacaggtaagtttcgcaaaaatgtgagtcaacattaagctgatataagggaaatattaaataaaagaataggccaggtagtttgaggatatttaaaaactgtgtgggggcagggagatgagtagagtctggatgcaggaatcttgttcaatatcttccttgcataagtgtgcaagtggaggcttagagaggggatgtgctttgctgtgggtgaaccagcttcccaggaccaaggcgaggagggatccccaactttgcaattcagaggccaggctatccttgtgcccgaggccctgtccccaccaaagttaaaaggaaaactgaggaatgccagtaagtcaacagaattgcctggatgtgtttcctaagactgtcataacaaagcaccacaatctgggtcactttgaagaatataagtttattgtctcacagttctggaggatagaagtctgaaatcaaggcattggcaaggttggtaccttctggaagctcagagggagactgtcccatgcctctctcctggcttctggtggtggcaggcattccttggcaatccttggcctatagatgcttcacaccaatctctgcccccatcaccacatggcattctctctgtgtgtctgggtccaaatttccttcttcttatgaagacaccctaatccattatgacctcatcttaatttgattacatctgcaaaagacactgtttccaaataagatcacatttacagctactgggccttaggagatgaacatagcctttcaagggacgcaactctacccacgacatcacccaaccagggtccctggctgagctgcaagaggcttggagccaagaactgcgtcctgtccctgagctggctgggcttagcaaaaattgaaaccaccctagtgaaagaggtcggtcaaggatcctgctgctcagctggcttgtattagtctcagtctgagacggtggcggcaaagatggtctaggccccagcaagtgaggcagcaagaggccaatgccagcaaaggtcagggctccctctttaagtataaatagaaccttcttcccagccaccccctcccatagccacacaatatctctttcaaagatctcaaaacactgaagcagaccgtaccaaattgactttattgttttaaaaccagccccttctgtctgccaccacccgccaccccttcccgaaggggaagaaaaaaatcataatagatgtctctccagcgtgcacctctgttctcctctctctaatggcagcttgggaccctgaggcagtgacgcttagtaatgtatcctaatagtcagtgtttgtctgacaaatacctagtgaccacaagcctaatcagggccgccatgaattaatggtcagtgtagtgatgggtgctgaatgatcataaaaatagctaatactgggccgggcttggtggctgatacctgtaactttgggaaacggaggcaggaggactccttgagactagaagttcgagaccagcctgagcaacatggcaaaaccccgtctctgaaaaaaaaaaagaaaaagggggccatgtgtggtggcgtgcacctgtggtcttagctacttgggaggctgaggtgggagaatcacttgagcctgggcagtcgaggctgcagtgagctgtgattgtgccactgcactccagcctgggtgacagagtaagaccctatttcaaaagaaagaaaaaacaatgctcacgctgaatgagggcttctggggaccacggaccaggctgagcacttggccagtattcactcccttggtcaccacttcagtgtttgcagcaagttgttgccatttgacagatgagaaaactgagactccaagggaggaagcgagaaagctgggaggtggcgtaaccgggatcagggccgggactagcatgaagtaagagaggcactggctccatgtgcaaaatgtaacagagtgccaggaaattcaatcatggataactattttaaggcactatttaaaatagccaaagttcgcgcaaaaactccctgatgaacaaagtatcaaattttgaaataaagacagactcctgctgtttgtttagtgacccagcaatattgtggaacaggaatggtcgtttccaatcagcccagggttctggtgcacacgggcattatggtcctgccgtggcagggctaggagggtaagcagacagatttggcaatacagggactgttataaagtcatgcttcttgataatagtgtttttaacttcttccacttgcttcgtaatattggaggatattttgggaaatgcatataagagcatgtatttttccttttgcctcaggcttcagtacagcttggttcagtgccaatcaggacacttctccaggcagccggaatccaaagttcttgctttatttatttccttccttccagtaggttctacagttttgcacacaccacctatgtcacctgcataaccaagtacaggggttcagaatgtggccactgaactcagatcgcctaaattcaaatcccagttctgccagttatcaactatgtgacaggcaaggggctttgtttttctggacctctgtttccacattggtaagatacaaatgatgggtgtattagtttgttttcacactgctataaataactgaccgagactgggtaatgtataaaggaaagagtttttattgactcatagtttaacatggctggggaggcttcaggaaacttacaatgatggtggaaggtaaaggggaagcaaagcaccttcttcataaggtggcaggaaggagaagtgccaagagaagcaaggaggagccctttataaaaccatcagatctcatgagaactcgctcactatcatgagaacagtatgggggaaaccacccccatggctcaattacctcctccaagtctctcccttgacacctggggattatggggattgaggattataattcaagatgagatttgggtggggacacaaagcctaaccatatcagtgggaattcccctactcatcagcaggttgttgtagtgattaaatgagtcaaaactcatgcaacactgagaatagacatggcgcaaaagaagcactccgtgttcattggcattattacgtgttgcattgttatgtgttgcattgtattattagttttccatgacttctataacaaattaccacaaacttcgtggcttaaaacaacatgaatttgttatcttaccattttggatgtcagaagtcttactgggctaaaatcaaggcatcagcagagcttctggagcctctaggggagcatctgttcccttgccttttccaacctcccaaggctgccactagtccttggcttgtagacccttcctcaagccagctacagtgggttgatcttctgtagtcccatctctctgactctttctgctgcctttctctgccacttttgaggaccctggtgattaaattaggccctctcaggtaatccaggatcacctcccgatcttaagctcagctgcttagcaaccttaattccatctgaaaccctaatttccctttgccacacatgtaacctaaatatccacaagtcctgggattcgtattggatatcttggtgggtaggggcatttgttctctctaccacacgtgttcatcattcaacaagtatttattcacagcatctgctgtgcagcagaattaggatttacagcagtgacaaaacagataaaaactgcccttgcagggtttacattctaacagggagaggtagatgtatatatatttttaattttaagtaaaattcatagtgtttctgatggtgatggattcatgtagaaaaaataatagagcaagggagagaattaggaagctgatgattttaggtaggggtggggcggtcagggaaaaaagtcaactactggctgggctcagtggctcatacctgtaatcccagcactttgggagaccaagctgggaggatcacttgaacccaggagttcgagaccagcctgggcaacatggcaagaccccgtctctacaaaaattagccaggcatggtggcatgtacctatagtcccagctactcaggaggctaaggtgggaggattgcttgagcccaggagattgaggctgcaatgaactgtaatcgcaccatggcactccagcctgggtgatagagtgagaccttgtctcaaataaataaaaatataaatataaactactgcttctgcccacaagggtgctctggggacaggtccacatagggcagaggaaaccctgaggggtctgtgtgtgtgtgtgcacgcacacatacacaatgttcattgtgatataaaatttaccatcttaaccatttttaattatacagtaaggagtgtgaactgtatgcaccactttgtgcaacagatttctggaacttttccatcttgccaaactgaaactatatccattgaacaactagtccccgttccccgcacgtagcccctggcagccaccgaggacttcctgtttctaagagtgtgagtactttagatacctcacgtaagtggaatcgtacagtatttgtctcctgaggggcttttgtgaagagagtaggggcttctcgaacaggagaaaaacaaacaaaaaaacattgatctttttcacagctactgggccttaggagatgaacttagccttttaggggatgcaactctacccacgacatcacccagcctgggtccctggctgagccgcaagaggcttggggccaagaactgtgtcctgtccctgaaatggctgggcttagcaaaaaaccagagcagatgtcgaaatcacacacacacacacacacacgcgcgcacaattctataatgtgagtttctaactattttgacctagaccaggtgtaggctaactaaaaccctcaggccaaatctgcctgctgtctgtttttgtaccacccatgagcttaaaatgggttttacattttcagatggttgaggaaaagaatcaaaagaagaataatatttcatggcacatgaaaatgatatgaaattcaaatttcagtgtctactaataaagttttattggcacacggccacatccattcattatgtctattgtctgtggctactttcctatcacaaaggcagaactgggtcattgcaaccagagaccatgtggccaaagtagaaaatatttaccgtctgtccctttacagaaaatgttttcccgtcccctgatctagacccacagaaagaaatgcgttttatattttaaccctgagctggcacttgggcatgcatatacctacaatggaaacaaagtatcaacaaaatcacaccctcactgcctgagatcagtgcagtattctcaattctcttttttctattcctgaggcggggcatcttgtagtgataaaagacacagattgtggagccagcctgcctgggttcaaatcctggttttgctgttaactgtgtgactgtgggatattttttcgtttctctgtttcccagcttcttcatctcatagggtcattgtgaagatcaaatactttttttttttttttttttttttgagatggagtcttgctccgtcacccaggctggagtgcaatggtgcgatctcagctcactgcaacctccgcctcccaggttcaagcggttctcctgcctcagcctcccgagtagctgggattacaggcgcccgccaccacacccagctaatttttgtgtttttagtagagacggggtttcaccatgttggccaggctggtctcgaactcctgacctcaggtgacccacccacctcggccacccaaagtgctgggattacaggcatgagccaccgcacctggcaaagatcaaatacttaatagaggcaatgtttagccatgcttggtgagactgcacccagtaagtgtttgccattttaagcacagaaggccatcttttctacagtattggttctatctgctaaattcatttcatacacactagcaggtcttacccagtttgcaaatactgttccataaagaagtgggaacggtcttggcagtctttgaagaatggtatgttccacttagagcctgtctccgtatctccctcaatgggggatcttgggcaagctccttccacagtctgagcctcagttttctggtctgtcgaaggggaattgctgtacctctcctgtaaagccaaactgaggactagtgagaaaacgccgagttggggctcagcacggggccagccctcagggacattcagcactgttttcattatttcctgttctgttacacgctctgctgttacacaaggaaaataacaaccatacagcagcaactgttctaatcacatcacacgcatagctcctttaatcacagccacacaacaggtagggactgaaacacagagacatcaagcaagttgcttgaggtcacacaggtaagaagcttgggtctcagctcagcctttctggctgaaagtcaatgctgttatcactgtaactacactagaacttgtcttgaactgtccctagaaatgggagtgtctgggggttaggggggaggttaaaaaaccaaaacctgtaaaccactgtgacttagggcttatgtagccagcatcttatcactggacagcacatgttctgagggcatgccaagggtttcacagaacacgtgaggctccactgtgtgctcacagctgcagggggccagaagcaccctgtggggtcccagcaggtaaggagcttaggcctggctggaggataaaccaccctccacagggaagttagataaccagcaggtgggtgcagcccccaggtccctgctcctcctgccagcccgctgaagcagtcccgcccctgcgagttagaattctacagaaaaatctgatttctgttctctagtgtttaaagaaccctctgatcctaaggaaatctaaaaactttggcaactggcaactccaacctgccagaaaagcctccctccccatgctctttcctttaatttatcttatgttattttgaatagtgaatacctgcacatagtacagaggtagcagttaagtctgcctcccacttttaacccatagccatccagatctcttccccagaagcagcccccatcaccagtttcttctgtgtccttcaagagatagtctgtgcacgactaagcatacatgtatattgaacacttttatacagatggtaaaaacctaaccctaaacctaccaggactcataagcttgtagcaactgccaacggtctgttctggtctgctctttttatcactgagttgcagtgccaggttctgaattctgtctgagagaactggaccaatcaaggaagccactggcaaatttcattcaatgaacatcttgttggactcggtaggaaggtgtgcagggatcaattagtgatgcctgccatgaccacgggaggggagttttaggataggtgctcagattgttctccctcagtctagtaaatgtttcctgtactttgaatatattatacatggctttgtcacatcaaaattccacctccactattatttgattttttttttaatttacagacttcttttggttcaaaagtaaattcattttaaaagccaaatttatagcactaccttaaatggaaagccagttttgtttgccataaatggaaggtttggtaagaataaattcactaaaaataaaattataaaataaatataaaataaaattggtaagaatatattcactaaaagttaaattatagccaagtatccaaatctgaagacacaaagagattagcgagtgtgaaagatgttctccttaacccaggaataattaatactaatgtaatactcagttccaggtgctccctcattaattgcttacaactaccatataaagtagaaattattatcacgtctattttatagaggaggaaactgaggcatggcaagggtcagtgataggtgcaatgtcactcagctaatgagtggtaaagccaggagttggacccaagccgtctaactccagactccaagctcttcacttctgagctaggctgcctattagatcgattaaaagaaattaaaagggaagtcatctaaaattatcttttgtatcatcactggtggtttctgtcacactttggcagccctagattggtagaaagagccaaactggacttaaggcttaagtctgggttctaaccctgtctttgttacaaattcatatatgaccctggtcattcagcctctgaccctccacttccccatctgtgaagtacaggagttaggctgtatttgagcttccagatggcgggaaccatcccttatctcaaagaacccacagcacctggcacgcattatcagttagagttcattcagccaccagcaacagagaaccgagtgtcccagcttccctctgtcggtctaccctgctatacttggacttagctttttcatccttatgcctcttatcacctcatggtcacaagacagctgcttcacctccagccgtcacctccacattacaggaaggcagaagagaaaagcaagaaggagcaatgccacaatcaggaaagccgaagttttcaggttttgctttaatggctggatttgtgttatatggccactcttggctgcaagggagatagagaagtgatcatttttacctgggtacattgccgctccagttggattttcttaacaagaaaggagaggaagcagatattgagtaggcacccattaggcgactgtaaatacttaaagaaggaaaggcgagagggaggaaggggaggattaatccttcagaccccttccagctctatagagctgtgataaaagaatgttcatcctgctgtcttacagagctctgggcccaaaagtatgaatgttatatttttccttaaaagggtttttctgtgaacttctgcatgttgaggccacttttgtttttattggcaaacttattccaggggaatgagagttcatcacagtacagatgtatatttaagtaggacaggaggcacaggcaggggacccacggaaagggaatgttttaaaagggagaggccaacattcaggctgggaagagtacacaggagtctcaggaaggaggtgtcaggtgccttccaacacagccaaggactggaagtagccctgaagccagtcctgcttctccctggctgcccgtggtcatgggtgcaggccgcattcttttgtgaggcctctcagcatcctttctgcagtgctgtcttcagaaggtggtgtttatcctttcatttatgacctggcctaactttgcactttttcctgtcactttctagctgggtagccttggacaagtttcttaacctctctgttccacagtatctttgtctataaaatgggctgatgataatacgcatttcatagaactgttgtgaggattaaataagttaatacgtataaagctcacagaaactttcctgacacataataagttctcaatcttaccacaccatcatcattattgccattatcatcattgtcctgtctgagtgggtcaatagaagctgacaccttcccaatcaatgttgagcagtttttgagtagttctttcacttttttagtgatcaagaggatattgataggatatagatattgatagttcaacattacgaggtgtttggatccaaacaaagttgtccaggttgtccagtaatagactatccttttaaccacagacttaaatctgtgtttttggagacagggcactaggaaagtgttcatagggcatgctggtatggacaaagttggatactgttaatcagcacagcccttcccactggagctctgcttttgattttacacaactccagggggcaccattcacatcaaagtcatcatagactcagtcatcagaccattttcaacatatggcgttaaggtgtcttgagaaagtgagaggcctttttctagcggggctgctttccatatgctctggtccacccttccaagaaccacagatagcccatgaacccttcttagacttactcattcattcagcatatgttgggtgacacccactgtgtgccaggcattgttccaggcactagagatgcatctgtggacaaagtagacaacagtcaatactcacagtgagaaagacagacaaaaatcaatatttgtaatagaataaataagtacattgtattgtagggtgagaaacgctatgaatgaggaacaaagtagagtctttcgggggggtgggggcaatagcaagttgcactgttcaaccaggtggtcaggctgggtctcactaagaagttggcgttgagcacatggttcattcagcgatcacatttttgtagaacgctgttcattttttaattccttcactcagcaaacatttattgagggcatgccaagtgcttaactaacattctctcatttcatctcacaaaaatcctatctataattactgatatttctcccattttgtaaatgagaaatttgagtcacagggaggcagagtgacttgctcaaggtcatacaatcggagaacagcagaacctagttctaaatccaggactgagacactgccaaggaagcataaatacactgcttctcactgtactcatctagagagagaaaacaatactaaacagatcatcatgtacctaattacatcattgcaattgtggtaattgctatgaaggaagagtacaaggggctttgaggaactgtaactgggcctggggaaatactaagcccagtgtatggactggtgattgctgtgtaacaaaacaccccaaaatgcagtggcttaaaacagcaataatggatcatttctcgtaatgtcttggattggctgggctcagctaggtggttttccactcttcctggtgatacttggggccacacataacagctgcattcagctgagatgcccaagaaagctatccccattcatctggcagctggtgctactataggctggggcaccttggttctcttccacatggactctcttcctccagatatccaaccagcttcctcatagcatagtactgggttctaaggaaaagaaggtggaaactgccagctattttaaggcccggactcagaagtcccagaacatcatttctgccacatgctgttggtcagagcaagtcacaaggccagcccatattcaaggagaggggaagatgtgggaacagtatacacatacagggatcagaagagttcttgacagccatatttgaaggtcagcctaccacatcctgtccttaaaatgtctcacaagtttctagagtaactggagcacagtgcttccatggatttgttaccttgaagacgttctgcctgaagctgcccctgtcttcttcctcaactcttttcatatccgtctacatgagcaatggaattgctatggaaccaagagaacttttgtcaggaatttgcaggggcctgtttttgagaatttttttcagcatcaatggtatatgcgggtttgggagtagtgttagggtatatttccagcttctataacaaagatcaaaactaacaatggtttgatgaagtagcggtttatttctctcttatgtaacagttgggtgttacagaggaggagacccagactcttctcatcttgctgttccacaagtctgtgttgctgtcctcttctatacgacagctaacatcttaaggctaacgtctaagtccatttgggctgctataacaaacagaatatcatagactgggtagcttataaacaacagacatttacttctaacagttctagggactgggaagtccaagatcagggtgccagcatggtcaggttcaggtggggactctcttcctggttcatagaccactaactatctttttgttgtgtccttacatggcagaaagaagagagctttctggggcttcttttataaggggcttcttttataatcaccttcatgagggctcgactttcatgaccaaatcacctcccaaaggtctcacctccaaatactttcatgttaggaattagctttcaacatgtgaattttggagggacacagctaaaacttgtgagcttgatcactgtgagacagaaggaaagaatggacattgtgggcagttaccagcctctaccactcatggctagtgggggaaccagcatgtagatacaccgaaggatgaaggtgtctgcatctctcatcatctctgcacagagcagtgtcagctgtgggctgcccaccagaattcccagccctcatcctaaaacaacagccctcccttggtacaaacatccagtgagtgagctttgatgggaggcttgtgtaggggggtgggctgggtccaagccctcctagccaagcgtgtatggatttcatgctaatctgcctttctggactagtccattcatctattcaaaatgtgtcgccaggtggctgcgaccacgaagggtccaaactagggccagttctggaccaggtttgacactgtaaaatatgactgttaaggtgagttcaagagttcagcagcttggtgaactcttgtgtatctatctgggaagggttctgacagatctcagctgcctcatggaacaagcacaactcttactgcagacagcttaccacttagctgggcaaccttagacatgttacttaacttctttaagcttcaatgtccttatttttaagattgtcaggctggggtatgatatctgtctcccctgggttattgtgaagacaaaaataagatcagattagggcaacttgctcattttctaaaatgtatcgtgtacatttctcaaagaatgattttttttctcttttcaaagtttaaatgttgtagtgcatccccatgaatatccacttacgctgtaggatcctgaaggtcgggggctgtgtcttattcccctctgcatccctcagtgagtaattctgggcctgggagtgagcagttccccattaaacgtgggcatgcatgaatgagtgcgtggatgatctgagactcctaggcgaggggcagcaaacacaaatgcccacaggagtagggcaggtcacgcagaggagtaaagtgggctaagcctaagaaaaaagatgagcaggcactgctttattttttgtctctctctctcttttttttgagacaaagtctcactccgtcacccgggttggagtgcagtggcgcgatctcagctcactgcaacctccgcctcccgggttcaagcgattctcccacctcagcctcccaagtagccagaattacaggcatgtgccaccacgcctggctaatttttgtatttttagtagagacggggtttcaccatgttggccaggctggtcttgaacacctgacctcagataatccacctgcctcagcctcccaaagtgctgggatttcaggtgtgagccaccgcgcccagcctgtctctcatttttgttagggacaaggatattgtcttgtgtcccactggtgctgtaacaaagtgccacacagttaatagcttaaaacaaaacaaatttatgaccttatcgttctggaaattagaattccgaaatcaaggtgttggcagggctgcttccttctgcaggctccatgggaggattcattttccctgctgcccgcattccttggcttgtagcctctttctccatccatctcgctcccagcctcccaaagtgctaggattacaggcatgagccaccgcgcccctgcctccctcttagtaagacaattgtgattatattgggctcactgataatccaggatcatctgcccatctcaaggccattaacataatcacatctgaaaagtcccttttgctgtataaactaactcgacttattcacaaattccgaggattaggacatgaacacgtttgaagaaccattattccgcctaccacagatacacagaaacatttttaactgtaagaaagctatcaggccaaggatgatggcatttttccccagtattaaggagacctcagggaggggaggagagtgtggccacgtggagaacacatgctccatctaaaaggggctgctactcacttttagagtatggttattacatatgagaaactgggcctgatttgccagaacttcccccacttttttgttcaaagggaagcccaaaatctgggttttcatgggaaattattacattttgtcagtttcaaaaatattatgcaggccgggtgcagtggcccatacctgtaattctagcagtttgggagaccaaggcaggtggatcacaaggtcaggagtttgagaccagcgtggctaacatggtgaaaccctgtctctactaaaaatacaaaaattagctgggcgtggtggcatgcaccttttaatcacagctactcgggaggctgaggcaggagaattgcttgaacctgggaggcagaggttgcagtgagccaagatcacgccattgcatgccagtctgggcgacaagagtgaaactctgtctcaagaaaataaataataaaatactgtgcagcagttccctggcagatattatgaaatgtgccaggctgggaggctcaagactctataaattgctgaatctgtgtcccctgcttcactcccagcaagagagaagtaacagaggtgagagtaagaagaagaatgatactagtagtgggtgacatttgttccagcatttctgagttccaacacgttatggtactcaacacattaaatgtattaattcatgtggttctcacaatggccctggaagatgggtgctatttgaagacccattttgcagatggagaaactgaggcacagaggcactaagtcacttgcacagggtcacatagccagtaaatagcagattcaaactcagtcagtccctattctgtttctttttaactttctattttaaattaagtttagacttacagaaaagttgcaaagatagtacagagttccctgaagcccttctcccgctttccctaatgtgaacctcttacataaccatcgggcagtgatcagaactagaaaaatgacataggtgcagtgcttttaactaaactacagactttatttggattttaccagtttttccagaaacatccattttctgttgcaggatccagtcaagggtccctgatatggtttgggtgtgtgtcctctccacattgttggaggtggggcctggtgggaggtgtttggatcatgggggcgaatcccttgtgaatggcttggggctctcctcgtgataatgaatgagttctctctgttaattcacctgcagatctggttgtttcaaagagtctgggacctccccctttccctctctcttgctctgtctcgtcgtgtgacaccccctgctccatgttgtcatgtgacacacctgttccagcttcgccttccgccatgagtaaaagctccctgaggcccccccagaagctgagcagatgctggcaccatgcttgtacagcctgcaggaccatgagccaattcaacctctttgctttaaaaattacccagcttcaggtgtttctttatagcatgcaaaatctgatgacaaacacagtcccactttgcatgtagctgtgcctctctctctaggctcccatctgtgacagaccccccccccaccgccaccagtctgtctttctctcatgattttgacacttttgatgaatactagctggacattttggcagttgtccctcaatatgggcgtgtctcctgtttcctggtgattagcttgaggttgtgcacttttgtcaaggagatcacataagtgacgttgcaccctcagtgcatctttccaggggctgcacgatgctgatgtcttattattggtgatgttaaccttgatcatcatgctcgagtgcctcgtaagatcacaaatcctgtatctgtctgtcccaatggggcaaggagtctcgtagaaatctgcatggttctcaggtatgcctgccggagagcttggctttctctcttgttaactttgatcatcagagtctgggtcctaaccccttggtttaaatgctttctgtatgtagcgagagggaaaaatataaaacaaacacaaaatattcagcaggacacatcagcagacctcacccatcccttgggctgacctagtaaatacgtatgaagtgctcagtaacagtgaataacctccaaattttaagaaggcttaaaaacacccactagtgatggcaggagtgggaaagaaaagcacccacattcggggactttggaaataattcaagcaatgaagattggaagagatgatcagggaaggggaaataaatccagcagagatgaaagccaaggtccgcagctgctcggaccatcaaacctttataagcaatgtgaggtttttaaggaaaggagtgaattatagctgttaggaccaaggacaaaaaggctttgatctaaaagtgggagacatcttaaaggaagctgtggcttttgcataaggtatttccacatcctcctggggtgcattagatgaacccatttggaatttacaggtctgcagaagggcccttattcctaagggtatacacttgaaacaagcggctttgcaggagtggagttgatatttggagagagaaagcgtagcgctccagcaggcatacctgagaaccttgcagcgttttacgaggctccttgccccgctgggacagacagatacaggatgtgtgatcttacgaggcattcgagcattgccatgggaggtcattttggtgagcccttgacctctccatttgaaaagtatcagtttggaaaaggttgtctttactgccaggaaactttagaacagaggctataacatggctttttggacagtcactctgtcgctaaccagatgttggcctctgtttgccctggggcgagaccctagcctatgccggactttccctctcgttgagcactggctgccaaggactcatcacagcacgttctgcatcgcttcgccattgcagtgtatgcacggtgcacgtggctggcatcgcagaacgccatcaaaacagccccataggcggccatctgctgtgaagaaatcagaagtatgtgcaccacatacatctaggtgcattgggaggaagaagtaggggggcggatttttagctgggttaagtcaaatacccaccgaaactatgaatgaaccttccagtaggaccaaaaattacagcagattggaaatgggagaaaactgagatgaagaacaagcccccgaggcagacactcctgggttctaatcccagttttgctcataatctgtgagttttaatttgcaagttgcttaacctcaaggatgaaagcttcagtttctcacctcctgcaagtctgtcctcagatgtggagccttctctgatgacccaacccggaccccagtgttcctgggtccccttccagcttagctggctccagcacctatgaccatgggacacattattttatatatttatgcaccctcagcccctcctgactcatgtcagctccacagaggcagggatttcatcagtatcctgcttaggacagactggcacacagtaggtgctcaggaaacatcagtgaaacgattgaaaggagtcaccgaccttgctctgttgttttcctttttggcagaggataagctaggataaccacagctcggggctcagcatagtgcccggcacagagcagatgcccagcaatcagtaactattgctaatgtcaactcattcacttttttcattcaatgaatagttatcaaacgtttgttgtgtgccaggttccagctggaaatagtgccgagaacaaaacagatactcctttttttccccccagaaattatttcttgagagcctaccacgtgcctcccactctcccatgaacaaaagacagcctctgctcccatggggctcatattccagtgggaatgtgataaacaataaaagcaaccctgaagaaatgagatgatttcagaggcgtgctactaaaagaaaaagctttagaaccagggtcatgtgcaaggtgtggctggagttggggggagcatgggggctgctttagctggagtggtcaggggaggtcacatgtgagctgagacccaaatgaggaggaggaggagaagccagcatgggaggggctggggcccccacctgtggtcctggcagcatcagcatcacgaggggcgtgttagaaatctcaggcctcatccagaaccttcagagtctgtgaacggattgctcagctactgctgggcatttaccccaagccgacctttgttactaaggaatgtttggggcttgagagtgccagtcctctgctgagatttgcagtgcccttttgtaaaccgctacaaggcaaaataggtcgttttaggagtcctgcttctttctttttatcttttttctttttttgagacagggtctcattctgttgcccaaactggagtgcagtggtgtgatcacagctcactgcagccttgacctctgggttcaagcaatcctcctgcctcagcccccaagtagctgggactgtcaccatacacgtgtcaccatacccggttattattctgtattttgtagagatgggatctcactatgttgcccaggctgatctcaaactcctggcctcaagcaatcctcctgtctcagcctcccaaacgggcttctatttcttttatccacattcacagtataagactgagacatgaaatatttccagccaccatctgggtaggacctggtgtcattgagtgtgtcccctatgtggtcctggaagtcaaggactgtgtctgggtcatcttcgtctccccagcccttaacctattgcctgtggagggcatagaattggccaccctccatggtgggccttacgtagtttctcgacctttttttcattattgtcccccacccccactcccacctcaaggatcctttttagacattttttcttctagatgaaattacaaagaataagggagaatggaaattggaggccacccagatctctctctctccacccttagagcccttattggttttgcaagtttctcagcaagaaagacttctttatgaaaagcgaatgccacggacatgctgtacatctgtttatgtgctgaaggtgtatctctacttcattcataaaaagagtaacattcggccgggtgcagcggctcatgcctgtaatcccagcactttgggaaaccaagatgagcagattgcttgaacccaggagttctcgaccagcctgggcaacatgacaaaactccgtctctactagaaatacaaaaaattagccgggtgtggtggcgcatgcctgtagtctcggctactcaggaggctgaggtgggagaaacaaccgagcccaggaagtcaagactgcagtgagctgagatcatgccactgcactccagcctgggggacaggagtgagaccttgtctcaaaaaaaaaaaaaaaaaaagagtaagattcttctatctcccaagaaccaatcatcacccaaggaggtgaatattggttcttgggagatagaagaatcttacttgcttacaggcagtctcaagggtgggggtgatattgcccccttgagaatacgtgggctaaaatttccacaaaggaggggctcagggttgtcaaggagaggcagtcaggttaggatccgagtagagtcgttagggtcatagactcaaggcggactgctgcagtcagcatcccagctcggaaccttactgagtgaccttgggcctcagtttccccatttgtaaaatggggatggtattgatgatgacactcaccttataatgtggtcatgaggattaaattaattaatacaattaactttcttagagaagtacctgtcacacagtaagaatttgataagtataagtgattattgtaattatgtttgagaaaacctaagttgtctgtaagacagaatggacggggtttgttcatggagattgtgaggcactgagcattgcaccccccacttctccaacttgaccctgatgccacccctggctgaggtgttcagtgaatatttgtggaataaatggcatctcattcacatctctgtctccactttgaatgaatgaatgacgctaaggaaatagatcacgtctcattcatcgcagtttcccctgaaattcatatactgtcagcgtagggctggtgatgaaaaaatatttgtcgaattcatgaatccgtcagtttcactgattccgttcagcagatcagcactgaatgtctaccctgcaccaggtgtttctgagcatgtgtggggggctgcttgagataagcaaggtgtactgagtaaaagcctcctcccctctcagatcctcttcactaatgcggatagacagaaaatgagcacattcacccctctttgcccagcacccaacacttgacacctgggcagcccaggacttgaccccaggacatcccatacagagttctttctgctgctctgccccacgtccctcagatgtgtgactccgggactcacttgggggacatgcagccagtctcctagctatgccaggccctgcttctgtctctctcttgctgttacctatgaacttttgattcagtttggactctcgcacacaagtaaaataaaacccagcctaaactgacttaatatttttacaggaatttattgtaaactgcagctattacgggctccagaaatagatggatccggagctcaaacatgtcagccagatttggttcctctttctgtctctctttttctgtgttctgcagctgtgctttgacagactgtgccctcgtggtggcgaagaggctgcagcagctccagcctctttaccatatgtcatcttgagattccctctcattggacctgcctgttagttcaggtgcacacccctaaagcagtcattgtggtcaggggactgtgatgcactgattggtccaggctcagtcacgtgatgcatccctgccaaattctcaccagggaagtgtaagccatctcgaacctcattgccctgcatgggactgtatcagtgaaaatctctctctgacgtgtataacttgtttcagaaactctggtctttatgggttaccattcccgaggagatcctctgcaggaagaataggtatttggtcttgggatccgctgtgatcccctgatctgtttccaccacactgggtgaaggcagatggtctgtccctccctatattgtatcagatcatgtcactcccctgtttaaaagcctttgtctctggagattcccactgaaatcagaaataaaccccaatgccttgctgcgaccgccttacctgggcccagcaccgtgcagttcctgatgacctctctgacctcctctcgcacacttgcccccttatcctctcctgaatttcactcgctcttgcttctttcagatccttacccctcagggtctttgcactttgctctttcccgtaacctagaatgttctgtccccacgtcttcatgatgtaactggctccttcctatgcatttagcaaatgccacctcctctaagaggtcttccaaatgtattgatcccctgtttaactgaaatcaacaaacataaatattcagtccagcatgtgctcagagtagccccactgtcctgcaactcaccttttttttcaccccgcactgcattttggacatctctccacaccagcacatgtggaccgacatgtgacagctttctcctctgcagcaggatggctcttcccgcccctgctgcccccgccacccctgctccttccatggcattatcccgacttgtgtggcagagacacagtgacagggcagcctatctgaaatggcgttctcaggcatgcggattgttttattaccagttaaatatgctttatgctacctgtgaatgaggccattgtgacatttagcaactgatttgattaaacacagatgtgggctagactccacgtggagcaaagatgcaggaagacaggctccgggtgtgggtttggagtttttaagacggtgagaaggacttgacgactcacagcagcaaggcagatgtggaccaggcgtcctgttggtctcagagctgagaacgcaacatgggtaccccaggaggctttgtctgctttgggttctgctgtttggtcctatccaaattgtttttttttttttaaccttccctggatgtttttattcctgtgaatttttttaaatgacaaattggtgaaatgctagcacttttgacatcttcagtggtgattatgaagacacaaaaaattatcaccgtagctcccgtttgttgaacatgtactcgatgctgggctctggcccttgtatcccacgtctcacagaaccaccacataagccagataaacaaactatgcttagctccactttacagatgaggaaactgaggcttagaaagttcaaccatgtgtccatagttatcagggaaaatcatgagttatatctgaattctctgttgtcttccagcccgttccaggctctgaaatccaaggagacaggaccctgctctttctcaaaatagaaatctcaggactgggcatggtggctcacacctataatcccagaaatttgggaggccgaggcgggcagattgcttgagcccagaagttcgagaccagcctaggcaagagagcaaaaccctgtctctataaaaagtaaaaaacttagctgggtgtggtggtgcacacctgtagtcccagctgcttgggaggctgaggtgggaggatcgcctgagcccggggaggttgaggctgcagtgagctaagatcacacgtctacactccagcctgggtgacagagtgaggcactgttgaaagaaagaaagggagaaagaagggagggagggagggaggaaggaagaaaggaaggagggagggagggagggaaggaagaagacaggaaggagggaggaaggaaggaaggaaggaaggaaggaaggaaggaaggaaggaatctcagcacgtactaggcactcaacaaagatgtgatggctgaaggaaaatgaatgagcagctgagtgaatgaaaggtttgcccaggaggtgaggggatggggcagggcttgccagctgcagccaggtctttgccttcaccactttgtattctgggtaaagaaaagaaacagagaaatagactatgaagcctgggatttgtccctttctggaacttgggctgtggtcagggtgcttgagtgggtgaattttgtaacaggctcacgcctctctacccacttgtggcttttccattctatacattatctgctgactactttttatatcaccccccccccccatctcatacctccagaccttttccacttgcagtcctggtaggttttcagcaattttattttcacatcaacatcagtaagactttattaagatggagaacacatgctttgaggtgtcactgtggaaccagtacagaggtccctttgctatggggaaagaaattgtaaggtggaaggggggatgtctgttcactgggattacccatgaggcctcctttgcactgccggggctggcatgtcagatccatgggtgaccatgagttcactgtaggttggcccaaaagaactaaggcaggcagtggcctgtgcaacttcccacaggtgtgtggaggcaggacggcctgctggctgggagtcaggctgacctgggcttgaaccctgctccaccccttcccaggagggcctgcttcctagggctgtggtggagattaaacaagataatgcatgcaaactgataagcgatgaggaagatagtaagtgctcaataaatggaggctattattactagttcattagtatttatccagctgctaatgccaacaactgaaagtcttccaagggcttggattaagttaataccgggtttggcccaggaaaaggaggaaggtttgcatggtaactgtcacctctccttaaaaagaggaggaaatccagaagacaacaagcccaaggagggatgtttagaatcatcggtcatcagagaaatgtagactaaagacaacgaatgagatgttagtcccataggctggcaaaaatagcaagtgggattatgccaagtgcctgtaggggtgtaggatgtgggaaccacctatggacggggcacccagccattcaggaaattaggtctgtgcaaccttgggacccagtggtcccactctatcccaggtcccactatatcctgaggaaactcacacacaggcccacaaggggatgggtgcgagggcgtttatggcagccttgctggtgatggcaggagagagaggccatactggtgctgaccctgggggagtcagtaggagagatgtgaaggacacacatggaaggccaggtgtggtagctcatgtttgtaatcccagtgctttgagaggtcaaggtgggaggatcacttgaggccaggagtttgagaccaacctgggcaatatagcaagatcccaatctctagaaaaataaatatccaggtatggtggtgcacacctgtagtccctgctacttgggaggctgtgggaggagaatcaattgagcccaggaattcagagctgtggtgagctatgatcgtgccactgcaccccagcctgggcaacagagcaagacctagtctcttaaaaaagaatgcaaatggtggaggaggagacatgcccacggcaacatgggtgggtcttaacaacttaatgctgggagaaaacagaaaccccacaaaacaatacacacagaatttacagaaacaaatgcctgctcccgaaacactagtgcatgttttgcactaatgcacaaacaagagaatatgcaacaggcacaccagaattagtgcctgtggagtgatggggaatgacaggaaacaaataaataacaggaggggtcttgggtgggctcataaggaaaatgtgcatgaaccaaattaactctgccttaacacccgaggtgcaggatggtgagcggggagggaccggcttctgaggctgtccacatagtttcccacgctgggagtgccacagttcctgggacataaagaatccctctgtcctttgtatagtaggtataaatctcagactacaggctcgaggggccagaaataaaactttattttcagcatgtcaatgtaatttctgtttattttgttgtttgtttgtgtgttgacatggagtctcactctgtctcccaggctggagtgcagtggcatgatcttggctcactgcaacttctgcctcctgggttcaattctcctgcctcagcctcccaagtagctaggattacaggtgcccgccaccacacccagctgatttttgtatttttagtagagacggggttttgccctgttggccaggctggtctcgaactcctgacctcgtgatccacctgccttggcctcccaaagtgctgggattataggcatgagccactgtacctggcccataatttctatttcaagccaccattcttctgggaaagtgagaaagtttcatcttagtcatttggggctttccccaaactctccagaattttggccatggttgtggaatcttactcagtgctagtctatttgtagtgctgaaggctcatccgattctccatcatcaggacccaggccactgtcttggtctaggaggcccctttgggtctggactcttcacatctgtgtctttgccacactgaggacccaggaacctttcactattctgtcttcctagagcagagatcacaacctggaagcccacagccccctctacactacaaacacagttttgtttattttgttttgtttttggttttattttttggtccaactaactcatatttgttacctgcatttaaaactcaggagattttacatacaaatccagaagccctggctacattagactcacattcttatggggcagaggttggctggagctgaatagtgttctatcagtgaggaatgcttttagctgcaagtaataacaagcccaactaatattggctaaactataatcacgttcattgtgtatttaacaagaactctctaccccaaggttcgtttggcatctcaattatataatcaaaaatcagattcattttatccttctcccattttggcctcagcatatgagccttttgcttctactctcatggcttcatggcccaacatggctgcagtcactccaggaacatcctcacatgactcgggaggaggtgtggggagtgaaacaaaagaatagtctttcccagaagcccccttggccaaaactagataatatgggccattctgaagaaggatccagcatcacatcctgcaagggaggccaggaatgcaagacttagtcttcatcagcctgggcagagggaagctatcaggggagcgaggaatcaggcatgcctgttgggaggccaagtggtatctgccacaaaccgctgctccctaaatacagcttggcattccagtttgccacagtccccaccatcccctgttgctccccagcactgaagccatctatcactgtgcctgcagcacctccttccctcactggtgttgcttgctacacctgtaaggtttggatgctgccggcctcggactcttcatgcacagaagtgaagggtccacagctgctcatcttcatcaatcgctctctctctcttttttttttttttttttttggaaatggggttttgctcttgttgcccaggctggagtgcaatggtgtgatcttggctcactgcaacctctgcctcccaggttcaagtgattctcctgcctcagcctcctgagtagctgggattacagcgcctgccaccatgcccagctaattttgtatttttagtagagatggggttttaccatgttggtcaggctggtctcaaactcctgacctcaagtgatccacccaccttggcctcccaaactgctgggattacagacatgagccaccgcacccagcccaacttcatctctttactctccttcttcccttgtctcttgtcctaccccatttccctagccttgaagaattgccctcctttaagaaaatcaggcctggcatgctggcttacgcctataatctcagcactttgggaggcctaggcaggaggatcccttgagtccaggagtttgacaccagcctcggcaatatagcaagaccccacctctacagaaaatacaagaaaacattagctgggcatggtgtcatgtgcccgtagtcccagctactcgggcggccaaggtgggaggatcgcttgagcccaggaagtcaaggctgcattgaactatgatggcaccactgcactcagccttggcgacagagggagaccctgtctcaactgaaaaaaaaaaatccctcttaattcatgtttcctgctaagccattttgcctacctcaatctaattcacagttggttcaccaacggcagccagtccacaaacagctgctggtctacagtaacaaatatggaactgagagaaaaagtgagacatgtttacagcaattagatacggccacagcatccaagcacatgatcctacgctcatctcattgcagagggtgtaggcgagtttgggactgttgcatcacagggccaattgcctgtggtgtgagttgcatgctaatcacacatcgtgaaccacgtcttagtccccaaagggttagacatttggaaacggattcttccccacagagctgagaaacacaggcgtacacctcaggtcctcccagactctcaggaggacttggaacctcaagagccaggataactcatttctgctgttccttctttccaccttgctatgccccagcttgggctccatgatccacgatgggactgtctgggaggaagaatcccaaggcagcgtctcaaaacatcaccctgacacatttgccttcctgcctgaatcctgggctcacttaccacttctcacacgtgatgacgtgatgaggaatacctggtgcatcctggacgtccaattgtccacctcggaccaccaccccaggagcacttcctcagcagagaagttgaggagaaatttccagaaaatgtacacatcctcagcattttcttgagtatctgtccattaaacatatccatctagatatgatttttaaatggtctaatccaccatgtaaaatgggatctggagttgaacaggcccctctggagtgcccccttggactgcacagctggggctgagttcgcagggaggtcaccccggtatcgcaggcaggcgctggctcttttatgcagttatctccagttattggggaaacaggaaggcatggcatcaggctccaggatcggtgcagaaaacatgttcgcttcccaaggtacatgtagcggctctcctggcagctgtaataagggaggatggctctttcgaactgaaaatattttgaagatcccaaatctcacccagattctgagcagctctggcacatgagctgttttgtgatctcagatctcgggttcgtgttacatgggagggccgggcccagcttgtcctccctctgtccagaagagccttctgcggtgaatctcagcagcctggttaacgttgagtcataatattgccaataaaaggaaagaaaaatatggaaagggggtatgcagttggtgccaaagggagagggatttgttccctcaactccggagtggggctgaaggcatctttgaacctcagatatagtctcttctctcgggcctcaaggtgtagggtgcccaggagtgtggcagaaggcgggggttctgatctttctgggcctttctgtgccctttcttttgctgccaaagcctgggagacaggccatgggggcagtgtggggaggtagtgggagcagttttgttttttaaattaaggtaaaattcccataacatagaattaaccattaaccattttaaagtgtacaactctgtggcgtttagtgcgttcacagtgttatgcagtcaccacctccaattccaacacattttcatcgccccaaaaggaaaccccataacctttaagcggtcatgtctaatactccatcccccagccctggcaatcacaagcctacttttttttgtctctgtagactatcttattctggatactttatatgaatacaaatccctcagtatgtggccttgtatgtctgacttattttatttggcataatgttttttgggtttatttgtgtgtgtgtgcgtgtgcgtgtgtgtgtgtgtgtgtgtgtgtgtgtgtgtgtgtgttttgagacagtgaggcaggagaatagggtctggaggcagagaacctaaggccaattcatgctgacttcctagaactgaatcaaaaggaaaaccccacctctgcacacccaagtaacaaaagaatcagaggctactccctttgcaactccctgccccttttccactttgttgcagatgaaaaggagaaagtacctctgattgtgggccaagtcttcatttgcataggttataactttgtaactttacttcagcctctggtccttccttgcaaccagactggccgtgggccaagtcttcatttacttaaggtgtaaccagataaccaatgggaaacctctagaggatatttaaaccccggaaaactctgtaaccaggactcctgagctgctcccaccactctgtggggtgtaatttggtttcaatacatctgtgcttttgttgcttcattctttcattgctttgcttttttgtgcattttgtccaatcctttgttcaaaatgtcaagaacctgggcgactaatagtcaaggccctccaccagtaacaacagggtctcactcccattgcccaggctggagtgcagtggcgccatctgggcttgctgcagcttcaacttcccaggctcagatgatattcctaccacagcctccagaagagctgggactacaagcatgcatcaccatgcccggttaattttttgtatttttagtaaagatgggatttcaacatgttgcccaggctgatctcaaactcctgggctcaagtgatccaccctcctcagcctcccaaagtgctgggattataggtatgagccaccatgcccagcctcatttggcataatgttttcaaaggtcatccatgctgtatgtagcatgtatcagaatttcattcctctttatggcggaataatattccattgtatggctgaaccacattttgtttatccgttcagccgtcagtggacacttggatcatttccacctttcagccactgtgagtagtgctcctgtgaacttttgcatacaagtttttgcttaaatacttgttttcaattattttgggtataaacccagaagtacaattgctgagtcatatggtagttttgtatgtacctttttgaggaatcatccagtgttttccacagctttttatgcaccgttttacattccaccagcgtgtgtgagtgttccattcctccacatcctcaccaacacattttttctttttctttttctatctttattatggccaacctagcgagtgtgaaggagcagcagttttcagcccagacactcgtgttgggtcatgggacctttcccactctgagtttctgtaaactgaaggacaatgcccaccttagagagtagacagcagcgtcacataagtcactgtacatagcatccccagcacagtgtccaacatgagagatgctgttcactggggcactgtattagtctgttctcatgctgctagtaaaacatacctgaggctgggtcatttataaaggaaggaggtttaattgactcacagttccacatggctgcggaggcctcacaatcatggtggaaggcaaaggaggagcaaagtcacgtcttacatggtggcaggcaagagaacatgtgcaggggaactcccctttataaaaccatcagatctcatgagacttattcactatcaccagaacagcatgggaaagatctgcccccatgattcaattacctcccaccaggtccctcccatgacacgtgggaattatgggagctacaattcaagatgagatttgggtggggacacagccaaactatatcaggtaccaaggccacctccaggcaccatattacccagtgcttctcattctcactgtcatgaaggacaagggcttcttcccccatttagcgtaaaataaaaatgaatcaccagaatatgtattctcagtaggggaaatatcatcccaagaggggaaaaagtggtccctgggagtggagcaaaaacacatacacatacagtcccaaaacagatatacagtctaactataatagtaaaatttcatgggaggtggggcaattaggggagaaaaaaaaattataaaagaaccctggcgaagggtggcaataatgaaaaaaaggttgagaaacaatgaagtttaaagcaatttaaatttgtttaatttttattttataatttttaataaattaaaagcgtgatttttttattagatttaacaggcataaagtactgtattaaattgctctggaggtttaaatttctctatttatctcagactggtaataaacacagtggctttcaatttctctatttatctcatcatagactggtaataaacggtttgtgagcaggcaccaatctgcagttcacacctcagtagtgctgtgcagaagcatcactgcgtctttgtctgtctggaattatctcacttccttatgtatctgttcatttgattgttgtctgtctctcttacctgaatgtcagtgtcaacaccatatctaaaacagtgtctgccacacggtgatatttggtacatcactaggaaatgaattgttgaatgcctgagggaatgaatgaacaaattaatgattgaatgaatatccacttaaaaattgttttgctggctgggcatggtgacttacacctgtaatctgagcatttagggaggccaaggtgggcagattgcttgagcccaggagttcaacaccagctttggcaacatggcaaaactccatctctacaaaaaattagccagatgtggtggcatgctcctgtagtctcagctactcaggaggctaaggtaggagggtcaccagagtctgggaggtcaagactgcagtgagctgtgatcatgccactgcactccagcctgggcaacagagtgagaccttgtctcaaaaaaaaaaaattattttactgagtcaggcactggaggctacttttacttaaaacccaagaaaaccaatcaaccaaaaatggtagcagttctctgcctttgacagagactcaaaatagcaatgtcttcaacaagaaagaagggtatttctctctcacctaaaagtcctaactaatgtggccattctagtctgcaaacgtgatgggggtccaagctcctcatgtcctgttgctcagctgcatatccaagatggccccattccatggagaaagagaagctgccactgcccttcaaaatttactcctatccctttgcctagaactcatcatgtggccacatttagccatagggaatctgggaattgtagtttttattctaatcagccatgtgctcagcttagaaacagattctattaatatgagagagaaggggtgaatcaatattaggggaccctccaggagacctgccaccatcaccttaagaggatgtttttttcatctcatctttgccttccctcactgggcattgtatcagccagaaggaagaaagaggtcagtgtttcacattccagcaccaagctgggtctgtttgtcaaaaccctccagagaccacaacttgtggcacaagacttcaggggccacgtgcccccttcttcctgggtcctctctggcacaggatggatttctcactgcaggcactctgtggctgccctcacgctgtagtttgttcagctgtccattcttcagctgaccctgggtcacaaaatgaaaataaacaagagactattttggagaaagcataccaagggacaagacgatagcctgtttatttccaaacctgccctgagtcatcattcagaaggttcatgcaaaagaaaagagaaatcagaagagaaaacactgcagtcaggagtcttctgagacaggtggcttcctaagcttttgcaagtagggtcaccatggtaaccagaaccaaacagatgacctcgaatggaatagactgacctagaccttctgctaaatgtgtctgggcaggacattgaggatagagtgggattttgttgactatagtcaacaaaaatttaaatgtacattctcaaataactggaagagtataattggattgtttataacacaaaggataaatgcttgaggtgatggataccccatttaccctgatttgatcattacacattgcatgtctctatcaaaatagctcatgtcacccataaatatatacacctaatatgtacccacaaaaattaaaaatttttaaattaaaaaaaaatttaatgtaacgaaccaaattgtatattgagctgttggcacaaccacatagagaggaactatcttaaatgactttatttacacatatttttattcttttcctttttctttcttccttcctgatgtttccagcttttttatccttttctttctatgagaagaatttcctgtacccattctttctgggtagagctgctgtaacaaattcttttggttttccttcattcgaggatgtcttagttttcccttcattcctgaaggatattgtctctggatatagcattctgagttgatgtttcttttccttaagcccttgaaaaatgttgtgccatttccttccggcctccatggttcctgatgagaaatctgctgtcattcctattctttttcccttattctggcacattttgtttgattaataaatgaatgaataaaagaattaatcttagcttcacagcctactagctttatgacttgggaaaaactccattcctaagcctcagtttctctgtatggaacatgggaatggcaattatataccttcctctcaggatcgatgtgaggattaagtgcagttatatacaaagtgcctaatacagtgcttggtgcataaagcactcaataatctcagtggaatgaataaatgaatgcatgcatgaattaatgaactaattaatggcctcagtatctttgtgtagagaagccatgtgctgccatggaaaggccctgagctgggaagcatgagacaggcttaaggccttctctgctgccaagaccaaagcacaggatcagcactgtttgccttccctctttgtgcctcagtctccccatttggaccataaagaatttggcatggactattggttctcaattctcagtgtgtactaggatctcccagaaaggtttgttgttgttgttgttgttttcatatactgatgcctggcccaactctagactaactcaaatcagactctctgtgggaagggccctcagactgcttttttgttctgttttgttttttgtttcaagttctttgggagattctgatgcagaacaagggttgagatcctatggttctgatggatccatcatcttggataattttagaggtgttgtggttcctttattatcctcttatcttctcctacctcaccccaggaagtaagtttcctggagtccattgtgttcattttagccactttataaaaagtagtgtgggctctagaagcttcttgtttgatgtaagtcaccgctcatttgagtagccatttgttttctaaccagcaactagtgtgaatgtttagagatgtgcctgcagttgtgcggttgctgctttaaaacctctgacagcagtccatgccccttcagcagatgcaaaccatgctccaggcttccgggtcctgaagcatccagccctaactttcttaatctggcctcatcttataaaagaagtctgttgattcagtccaattcctaccaaaatcccagatggtgtttagtagaaactgacatgcaaagtaactaaaagccaaaacaaacttgaaaaagaacaaagttggagaacttatactacctggtttcaaaactcaccataggccgggctcagtggctcacgtctgtaatcccaacactttgggaagctgaggcaggtggatcacctgaggtcaggagttcaagaccagcctggccaacatagtaaaaccccatctctactaaaaatacaaaaaattaactgggcatagtggtgggcacctgtaatcccttgggaggctgaggcaggagaatcacttgaacctgagaggcggagattgcagtgagcctagattgcgcctctgcactccagcctgggtgagaagagcgagattctgttttttaaaaaaaatcaccataaagcttcagtaataaggataggatggaattggtataggatagataaatcagtgaaacagaataaagtccagaaataaaccttctcatttatggtcagtttatctttggcaaatgtaccaagtaattcagtgggggaagaaatggataccccttctccatgatgtgtttatatcatatttcatacttatatcaaaacatctcatgtaccccataaatatatacacctactgtgtacccacaaaaattttaaaaaataataaaatcagtgggagaaaggatagactttttatagtggtcctggaacaactgtgtgtgtgtatatgtatatatacacacatatacatacatatatatgcacatatatatatatgaaaagatgaatttaagtccttaatccacactgtatacaaagattaacttaaattggatcatagacctaaatacaagaatactgtgaaatttctagaagaaaacacaagagcagttctttgtgaccttgaattaggcaacaaaagcaaaatgcatcaaagaaaaaaatcaacaacctacaatcttttgctcttcaaaagacaccattaagaaaaagacaagccacaaactgggagataatattcacaaatcatgtatctgatcaaggacttgtgtccaagatatataaagaactcttataacagtaataagaggccaaacctaattttttaaaaagatttgactagggtttgatgggaaaaagatttgagtagatatttcatcaaagaagatatgtgaatggctaaaaagcacatgaaaaatgcccaacaccattagtcattggagaaatgctacttaaaaccacagtgagatacaaccacatacttcgtagagtggctgtaatcaagaagactgaaatgaccaagtgctggagaatcgagaactctcgtgcattaccagtcagaatgtaaaatggcacagccacttaggaaaacagtttggccatttcttttaaaaggtaaacatatgcttaccacacaactctgtaattctactcttagggatttacccaagagaaatgaaaatatatatccatacaaagacttgtatgtgaatgcttatattgcattatccataatagcccaatattggatgttgtacatctatgccattgtgcattgttgtttaatgggtacatagttccaattttacaagaagaaaaatgttctaaagatgaatgatggtgatgagtacccaataatgtggatgtagttaatgccactgaactgtacactttaaaatggttaagagggtaaattttatgttgtatatataccacaattttttaaataaataatttttattttttattttatttactgttttctagagacagggtcttgccgtgttgcgcaggctggagtgcagtggtgagattgtagtttactgcagcctcaaactcctaggttcaagcaatccccccgcctcagcctcccaagtagctggaactataggcatgcgccaccacacctggaatttttttttttccaagatggagtcttgctctgtcacccagagctggagtgcagtggcacagtcttggctcgctgctacctccgcctcccgagttcaagcagttctcctgcctcagcctccctagtagctgggattacaggcacacaccaccacgcctggctaatttttgtatttttagtagagacagaatttcaccatgttggccaggttggtctcgagctcctgacctcctgatcctcccgtctcagcctcccaaagtgctgggattacaggtgtgagccactgtgcccagccaatgttttaatttttttgtagagacaacatctcactatgttgaccagactactagagtggccataatcaagaagactgaaactaccaagtgctggagaatctagaactctcgtgaattcctagtaagaatgcaaatggcacagccactttggaaaacagtttggccatttctttaaaaagtgaaacacttaaatgaccaaactccggggctcaagtgatcctcccacctcagcctcccaaagcattggaattacagaaaaatctgaggccaccacacctggcctcaaattttttaaaaacataattattaaggaccaggatctgggtagtgggcactatctcacttatttctcaccatagccctttgaaaaggacaccgtttattttcttcatctatccaggaaattgaggttcagagaaatttggtaaccaaagtcacaggttccatcccagcctgtcagacctcaaagaccccacctggccatggtaccctcctcctgcatgttcctctccgactgtaagaaacctaacctggctcttgggtctgggccgccaacatgccatccggacagaggaagatccagagacttaggggtcacgtgagccatagccacggccgcatcagcaagcacttggaagcacccaggaggccgtggtgatgctggtggtaggcgtcaccagaggattagtgtcaacaagtctcacctgggttgctttgggaacgctggtgtgaggcattaccactaggaaccagagcttctgcccagctgtcacccttgaagccacatggagggaggttcatgaaatgctaacaactgctttaaagagaaaaaaagacaagaaccctaacctgtacccctgttcctccttcccacaggcacaacagggttctatcaaggaggaaatggactgggcaacgcagccggtttcgggagtgtgcaccaggtagacatggctccctcccgattctttcctcagttctttctggaaatattccccttacatcagggcacccagagagcccacgacacacacaatccccattgggaacctgcctcttagtccctgggtttggagactacaggggctagattgtgcaaaaggctgctggaaggacacagtatacaggcggagacgtaggaattgttagaagattcctgagatgtcatggagatctacaagtatgttccatcttgacctggactcaggacacccattgactgttgaatctgatatatatcaatacaaatgggtgggttctttcaccagaccatgggcttctcaagggggaccgtatatcttgctcacctctgcatccccagtggtgagagcccagcacacagtgggggctttataaatacttgttaaatagagcaaagtcaactctatataggtaaatgttggctagtactttgattctcttggtgtcacttacaaagtgaattaagagttcgcatctgctcaaagtgtgcagtaactctgctgtgtgtacaccttccctgtacacctaaaattatttcaaaacaaaaggttcacctgctttcaggctaccatttaaaacagaaccaccctggggtagatgggctttaggaatatttaacatatttagatctgaggaatacgcaatttcttttccagtgagaatctaaataatttaaaacttagcaaatgtaaaaattgtttcatgtatttttgcattatttctaatgtactatgtacatagataaaatacttataaataaaacagtactttttaagatgtggttcttaaccctccatttcaccattaaatctgtgtttttcaaaaacactgaccacccccgcaacccccacccccaggaactctgactcccagctctggggtggggcccaggaagcagaacgttccatgagttccgtgcagggttgagaagcactggtttggtgatagtgcggcaggatatttgaaacaatgactgttggagaattgggatcgctggtctgcttaaacaaagcttgatcaaaggtgattggcagctattgaattgatctccatgactccctcatagaatattctggacccctaatgctgtgtaggtgctgctgtatttgcacctcctccccatgaacataaaatgtcacctagtctcctgggtttgtgtgtcgtgtgggtgtgtgtgcggtcttctaggtttgtgtgtgtgtcgtggggggggggtgcagtgtggtcttaattgttaatgcatttgtttattaatttaaccagtatttgttgagttactgcatataccaggcactgtttcaggtgcagaggatacaatagtgaccaggacaggtgccatcagggccacgtctatatcccttagggtggcctgtggacctccaggtgccagcatctgcatgcctgggcccaaggggcttttctagaaccagtgcacggggcaggcaggaagtgcctgggaattaaagccccctgggtgcagctctcaaagaccaacaagttgatgtataaacccctccactcccttgacccgtgggagaggcagttctgagatgtggattttagaccatctcagcttttcctcatagggctcatctctggtcactaccacagaagcacctatgcaggctgctctcccgcatctctctcacttccccgatcccctgctggtgtctccttcaccttccaaacagcctccttgcacttgaatccttgccccggggtctgcttctgggaaaccaaaatgaagacagtttctgcccacagagagcttttattctaatggtgagacagagtggccaggctgaccaacggcccgagcccagaaaggcttcctcacatatgtccttggtttgtttttctcttcccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtaggtgcagtcactggtggggccattcatggctgtggtctgagagcttctatgaaggagggacccgcacatgggtcccaattgtaacaaacaggttacccaagggtcattcatggatgtggcctgagagcttctctgaaggagggacctggatatgggtcccagttgtcacaaacaggctcccaagggctaaatccatctctcagacatgttttgttggcctgtttgtgcatgtgtttaattgcatttacgtttaaaagtcagaaaattttataaatacctaaaaattctattttctggcttcttttgaaagaagatctggccatagtagccacattcccaaggaacaccacttggttaaaactaagtgtgtctgctctttttagaaaggacacacccaattccacatctagctagcttaccccatgttcattactgcctggcccatgtaggccttggagttgatgaaccctggtagtatttataatattaccagctgggcacggtggctcacacctgtaatcccagcacttttggaggctgaggcgggtggatcacctgaggtcaggagttcgagaccagcctggccaacatgatgaaaccccatctctactaaaaatacagaaattagcctgagtcatggcaggcacctgtaatcccagctactagggcggctgaggtaggagaatcgcttgaacctgggaggcggaggttgcagtgagccgagatcgcgccattgcgctccagcctgggcaacaagagtgaaactccatctcaaaaaattaaataaataaataaaatacccatctgtttcgtgctgagcacatacctgtgtggtcttctctaatcatttacttatatatttattcaacaaatatttggtaagctcccactgcattccaggccctccctttagtttgggaaataaagtgcagtgtagagttaagctttgcagacaggaatcaaataatcatacaaatatctcattacaaactgtgataaggagaggcataatcctcacaaaaacaggtttatattatccccaccctttttctagataagaacaatgaagatgagagtgataaggagcttgctagtgattggtggggctaggatcccaatcccagtttgttggcccccataaccagcactcctgctatgcactggccatacacagccaggaactgtgtacacagcctggctgtgtacggccaggaatatgttatctaaaatccgtttgagaacagaagggcagaggctttcaaatgttgattctttgtctaagaggggttcaagtatagcgactcagggtcctcaagaattatacaatccttcaaaacatccttaagcatgttcattttttttttctttcaacttgtattttaggtttggggtacacatgcaggtttgttacatgggtaaattgcatgtcgtggaggtttagtgtacagataattttgtcacccagataatcagcacaatacccactaggtagttttccagtcctcaccttccttccatcctctaccctcaagtaggtccttgggtctattgttcccttctttgtatccatgtgtactcaatgtttagctcccacttataagtaagaacatgtggtatttggttttctgttcctgtgttaattcacttaggataatggcctctagccctatccatgttggttcaaaggacatgatcttattttttatggctgcgtagtattccatggtgtatatataccacattttctttatccagtttgccattgatgggcatctaggttgattctttgtctttgctattgtgaatagtgctgcaatgaacatacacatgcatgtgtctttatggtagaaaaatttatattcctttggatatatacccagtaatgggattgctggtatatatccaaatggtagtttcattttaagttccttgagaaatcttcaggccgctttccacagtggctgaactaatttacattcccatgaacaatgtataagcattcccttttctctgtaaccttgccagcatctgttattttttgactttttaataatggccattctgattggtgtgagatggtatatcattgtggttttgatttgcatttccctaatgaccagtgatattattttttcatatgcttgttggctgcatgtatgtcttcttttgagaagtgtctgttcatgtcctttgcccattttttaatcgggttatctttaaggatgtttgtttctgatggcacaatagttttaggaaacccttttgattagccaagattttttggcttcaaaagacatagaaaatccaattcaaactagtttaagaaaaagcaaatgaacttttaggcatatctaacctagatgtacaggggtttagagctaggtccaggtgttccaatgacaatgttgagacttagtttctctcttccttctggctctgaattttcctgggttcgttccgttctcaggcaagctcctcccctatggtggcaaagatggccaccagctacccagagctcaatcctgtctgctaatccatcccagcaaacatagttcctccttcttagccattcctgcaaaagtcccaagtaaagctcccattggcccagcttaggtcacatgctcatccccaaaccaatctctgtggtcagtggaatggaatgctgggatgaagcagcagactttgggctcatgcctacggctggagctagagttggggtcagcctcacctcaaccaccagggactgagagtgaggaagaggtgatcacctcaaaaaacctagagcattgtaactacaagaagacagaagagacaatgggtgagcaaaaacaataaatgtccacaaccttgatatggatgccacctacactatgagcaacatgtggcagagtccatgtcctgacccctctgtggtcacagaacttagtatgtaacatccctatgcaactaatgcaccagcctgtggattcattcattcattccccagacctgctatgcacatcttctcttttacaaggtggttttggcttatcaacattaaataacatggcagcaatacgttagaatgtcagtagatatcactgagtttcgttcctttgtcttcttttctgaaacctactgatgctgtagggctttgcagaagctaagctagcacgatggtgtggagacagtcatcaacaaatattaattggttgattgttagaaaaggaacaatagggaagacccacctgttttgttcctggggttcttggtgtggctattgattttagcccttaaattttccatcactgggaatgagtgagttatccttggtttgatgacaaatggagacaatatggcaaagcatgttaaataaagtcaactttttaaaaggtttagagcttgagcattgattttggtcattgtgatctcatcccagaatatttaatgatgcatagtacctatttaataactttctttgaagagtttgaagtttaacaaagtttttctctgtcatcatcttgaattatctttagccatcctgattttcagaatgtggttcttccgatctcatttcaacaaaggagataaaaacaaaacattgatgagaaattagggcagagaggaactataagcaggaaaccatcgagtagatgccactatccgtctataattcaatggtgaactgaatggcaaacgaaaaacttacctccccagaatttgagttttgtgggaaggttctcttcattcccatcaggagtgaatataaaggctcattgtgtctttgaaatttttctgtcttgtttccctctgttcttcctttatcccttgatcaaaggttcaacagtaagtggttgagatggtttttactgtgtgtctaacaagctgacataaaatctaatgacgtaaataatggtcagctgtagctgaggtctcctgcctctttttcctagtgttcactgtaaaggaatttaagcatatgtgtgtgcacatgtgcacgtgcgcgcgcgcgcgcacacacacacacacacacacacacacacacattcatgcactctttttaaatttcccataaaaactctacttttgaaattatccaggatatccttgagtggttggttccaaactccagaggctctagaggtttactgacagacagatcacactcactgtgtgcactgcctggatatagtattttggtgctctcaccactcacatcccccatgcaccccatcctcgccacaggacactctgcattgacatgcattaatgtgtgtgtgaagtgccaacaatttgcagatgattacagggcaatttgctgatatagagggcagaatctgaacatctcatgttacttaagagaaaaaccaaatcattggttacttaaggatttttttctttttacatttttaaatatgatacaaattatctaaaaagaagttgaaggattttttaacttctaagatcaacttcctttgccaagagaagaagaatttttttaatctctcaagaagaaattgggaaggctcttccgtgtaatttggcaacatctaacaaaatttaaaatgcatagaccttttaactcaactattcgacatctaagaatttatccgaaagataaactttgacctaggtacaaacacttaagtaaaaagaatacttatttttttcactgattaaaaatttattaatactattatgcaaataattttagtgataaccacaagggttttgtactgttagtacataaatacatacaaaaatgcattttgaaacttcttgtatcccctttatccttttcaatttctgtttatgtttgctctacaatatatatgatggatctgtgcagtagaaaattttttgctgatgagtatggtacaatcagaaatgtttggagactgtatcagtttcttcttgctgctgtaacaaattattatgacctttgtgtcttaaaacaacacagtgatattttacagttctggaggtaagaaatgcaacatggctctcactgaactaaaattgaggggtcagcagggttatagtattggaggctccagaggagaatcacttccttgcccttctacctgcagaggccacctgccttccttggctcatgaccctgcatcattccagtttctacttacattgtctcatctccttctctaactcctgcccccgaccccttataaggactgttgtgattccactgggcccactcagagaatccaggatcatctccccatctcgaagtccttaagtcagtcacatcaagaatatttatttttttaaaaaagaatatttattgcagcagcatcatagcaaaaggctggaaacaacctggataccatgccattaacaggaaacaggttaaatcaatcatggtgcatccaccagtagcatactatacagctgttaaaaagaataagttagatatatttgtgctactatgggtttctctttgagctattgtgataggttaaaaaaaaaaagcaggaggcagaattacatgggtaatgtgagcctgagttttttaaaagtttaagtgtagcttaatacccatatttactcatattccataaggaatttctagaaggatgcaataagaactgttaatagtcattttctctggagaggaaaacaagatctggagtgaaaggaaaagactgtatgtaacaggcaatctgtagaacactccacccaacagcagcaaatacacattcttttcaagtgcacatgggacatttaccaagataaatattaatatcttctgggccataaaacaagtttcagtacctttaaaagaatcaaggcatacaaagcatgttctctgacagcagtggaattaaattagaaataaatttcagaaagatttttgggaagttcccaaatcttcagaatctcaataatatacatttcagtgacccatgggtcaaagaagaaatcaatgggaaattaaaaagcacttggaactgaatgaaaatgaaaacaaatatatcaaaatttatggaatgtcattaaagcagtacttaaagggaaacttacagcacgaaatacctgaattagaaaagaagacacaattaccacaggtatcaggtgaaggaagggagggagggaaatgagggaggggggagggagggaaatgagggagggagggagggaaatgagggagggagggagtaaaggggagtggaggggagggaagattggtcaaaggatacaaaatttcagttaataggaataagttcagaagaactattgtacaatatggtgactatagttaataaataaggtatttgtattagtctatcttcatgctactgataaagacacacctgaaactgagcagtttacaaaggaaagaggtttaatggagaactcagttccatgtggctggggaagcctcacaatcatggctgaaaaaaaggagaagcaagtcacatcttacgtggatggcagcaggcaaagagagaactcgtgcaggcgaactgccactttcttaaaaccatcagatcttgcgagactcgttcactatcacaagaacagtgcaggaaagaccctccttcttaaagagacaaggtcttactctgtcacccaggctgaagtgcagtggtacgatcatagttctccgtaacctcgaactcctgggctcaagcaatcctccctcagcctctcaagtagttgggactacaggtgtgtgccaccatgcgcagctaatttttaaattttttgtagagatggggacttgctcctccttgtcttcggccatgattgtgaggcttccccagccacatggaactgagttctccattaatgctctttcctttgtaaattgttcagtctcaggtatgtctttatcataattcagtcacctcccactgggttcctctcatgacatgtgggaattgtgggagttacaattcaagatgagatttgatggggacacagagccaaaccctatcagtgttatatacttgaaacttgctgagagagtagattttaagtgtttttagtaaaaaaaaaataaaaaatatgtgaatgttaattagcttgatttagccatccccaatatatacatatatcaaaatatgttgtacatcataaatatacacaatttttatttgtccagttaacaaatcatcatcatcatctacagggttgctgtgaaaattgaaataaaaaggccgggcatggtggctcatgcctgtaatcccagcattttgggaggcacaggcacgtggagcacctgaggtcaggagttcaagaccagcctggccaacatggcgaaaccccgtctctactaaaaatacaaaaattagccaggcgtggtgccacacgcctgtgatcccagctactcaggaggctgaggcaggagaatcacttgaacctgggaggcagaggttgcagcgagccaagattttaccactgcactccagcctgggtgacaaagcgagaccttgtctcaaaaaaaaaaaaaaagaagaaagaaaaaaagagagagagagagaaagaaaaaatgtgcattgcctattattattattttgagacagagtctcgatctgtcgcccaggctggagtgcgatggtgtgaccttggctcactgcaacctctgcctcccaggttcaagtgattctcctccctcagcttcctgagtagttgggattacaggcgcccactaccatgcccggctaatttttgtgtttttagtagagacggggttttaccacgttggtcaggctggtctcaaactcctgacctcaggtgatccacctgcctcagcctcgcaaagtgctgggattacaagcgtgagccactgtgcccagccaaccctgccaattattaagtaacatgcaaatataaataatgattaatgaaaatatatttaagaactcactttaacccagacagttaaatataataattttcatccaaagatatgattatttaacttaatttaaaattttttaaaaataagaaaagaagaagtaaaacttcatgaagtaaagagataaaatgacctggtcacctatgtagaaaatctgatggaatctatgaaaaagctactagatctaaaaagtaactttagcagtgttgcagggtactaggtgaatatctaaaaatcaacaaacaacaggaaatagaatattttaaatgccatttgaaatagtatcaaagatgtgaaatactcaaggttaaatttggcaaaagatatgcatgactttacactaaaacctataaaactgctgagagaagttaaagaaggcattaataaatggagatatatacctggttcgtgaatcagaagacttaatattgttaaaatgccagctcttcccaaattgagctataagattaatacaatctctatcaacatctcaggctttttttaagaaactgtcaagctgtttctgaactttaaatggaaatgcagaggaccaagaagggccacaatgacttttgtagagaagaacaaagttagagggctaagactacctgattttaaaatccattttaaagccacagtacttaagacaatgcagcactggcataaaaatagacaaataaatcaatggaacagaattgagagttcagaaataggttgggtgccgtggctcgtgcttgtaatcccagcactttgggaggccgaagagggaggatcacttgaggccagaagtctgagaccagcctgagcaacatagcaagaccctgtctctgcaaaaaaataaaaataacccaggcagtgggttgtgcctgcagtcccatctgctcaggaaggtgaggtgggagaattgcttcagccaggggtttgaggatacagtgagctatgatcataccactgtactccagcctggatgacagagtaagaccctgtctccacagtaaataaatgaattaacccacatgtatatggtcacctgatttttgacaaaagacaattcaatggagaaaggacagtcttttcaacaaaagatgctggaacagccgagcacagtggctcacgcctgtaatcccagcattttgggagtccaaggcaggtggatcacctgaggtcaggagttcaagatcagcctggccaacatgatgaaaccccgtctctactaaatatacaaaaaaatagccaggcttggtggcgcacacctgtaatcccagctacttgggaggctgaggcaggagaatcccttgaaccagggaggtggaggttgcagtgagccaagatcatgccaccacactgcagcctgggtgacagagcaagagtccatctcaaaaaaaaaaaaaaaaatcgtggaacaactgattatctatacttcatacctcacatgacacacaaaaaaaatgcaaaatagatcatagacttaaatataaaactgtaatcttctacaagaaaacataggagacagttttgtgactttgatttaggcaaagatttctcatatgtaacaccaaaaatatgatccaaaaagaaaaaaagaatataaactggacttcatacaaatttaaaactgttcagagaatgaaaagaaatccatggtccaggagaaaaataattgcaaggcatatctcgaataaagcatgtgtttatatagaatatagaaggagtgttcaaaatccaataataagaaagcaaacaatctgataaagaaatgggcagggccaggtgcagtggctcatgcctgtaatcccagcactttgggaggccaaggcaggcaggtcacctgaggtcaggagtttgagatcagcctggctaacatggtgaaaccctgtgtctactaaaaaatacaaaattagctgggtgtggtggcatgtgcctgtaatcccagctactcgggaggctgagtcaggagaatcgcttgaacccaggaggcggaggttgcagggagccagaattgcgccactgcactccagcctgggcgacagagtgagactttgtctcaaaaaaaaaggctggctctgtgcagtagctcacgcctctaatcccagcactttgggaggccaaggacggcagattgcttgagcccaagacttcaagaccagcgtgggcaacatggggaaaccctgtctctacaaaaaatacaaacattagacaggtgttgtggtgcaggctcgtagtcccagctactcaggaggctgaggcaggaggatcgtgtgagcccgggacatcaacattgcagggagctgtaattgtgccactgcacttcagcctgacagagtgagaccctgtctcaaaaaataaagaaataaaaataaagaaatgggcaaaatatttgaacagatgatagatgcctcaccaaagaagatatagggatggccaaaagcacatgattaagatgccaaatgtcattaatcattagagaaatgcaaattaagttcacaatgagacaccactacatacccactggaatggctttaatcacaaagacggaccataccaagggctggcaaggatgtggagcagccagaactctcatccactgctggaaaatggtacaaccactatggaaaataattcatctgtttctttctttttttttttttttttttgagacaggttctcactctgttacccaggctggagtgcagtggtgtgatcatagctcactgcagcctcaacctcctgggctcaagtgatcctctggcctcagcctcctgagtagctgggactatgggtgtgtgccatgaaacccagttaatttttgtattttttgtagagacgggggtctcattatgttgcccaggctggtctcaaactcccagggtcaagcaattctctcaccttgacctcccaaagtgctaggattacaggcatgagccaccatgcccagcctcatccattttttcaaaagttaaacactacttattatatgacctagcaaacaagctcagtaaaaataaaaagcttacatctagaccaatgtgtgaattaatgttcatagcagccttattagaactgaaaactagaatcaacccaaacgtctacctacaggcgaatggataaacaaattctgatgtatccatacaattgaatagtactcagcaatagaaatgaaatattaggctgggcatggtggctcatgcctataatcccagcactttgggaggctgaggtgggcggatcatgaggtcaagagatcgagaccaccctggccaacatggtaaaatcctgtctctactaaaaatacaaaaattagctgggcgtggtggtgcatgcctgtaatcccagctactcaggaggccaaggcaggagaatcgcttgaaccggggaggcggaggttgcagtgagccaagatctcaccactgcactccaggctggcaacagagggagactctgtctcaaaaaaaaaaaagaaagaaagaaatgaagtatcgataaacaccgcatgtactgaatctcaaagcaattatgctgaccaaaacaagccagaaaaaagaatacatactatatgattccaattgtttaaacctctagaaaattcaaaccaaagtctatagtgaaagaaagcagtttagtggttttctggggagggtaactggaggaagagcttatccaaagggataacaaggaaattcttggggtgctggatttgtttattatgttgattgtggcaatggcttcacagatgtgtacatacgtcaaaacttaagaaattgtgtactctaaatatgtctagtttattgtatgtcagttgtgcctcagtaatgcgttaaataagtaaacacattaaaagagagaaagaaaaagaatgaaattactccaagaaaggtttacataaattgtgctatcctgtggatctctgactgtgaccttgaacttttactctgtattagtctgttctctcattgctataaagaaatacctgagactgggtaatttataaagaaaagaggtttaatggctgggcacagtggctcattcctgtaatcccagcactttgggaggccaaggcaggcagatcacttaaggtcaggagttcgagaccagcctggccaacatggtgaaaccccatctctactaaaaatataaaaattagccaggtatggtggcgtgtgcctgtaatcccagctaaagaaaagaggtttaattgtctcatcattcctcaggctgtacaggaagtatggtgctggcatctgctcagcttctgggaaggcctcaggaaatttgcaatcatggcggaaggtaaaagggaagcaggcacgtcttacatagccagagcaggaaaaggagggggtcaggggaggtgccacacatttttaaacagccagatctcatgagaactcactcactgtgcggtacccggggaggggagatggtgctaaaccattcatgagaactccatgcccatgatccagtcacctcctaccaggccccgcctctaacactaaggattacaatttgacaggagatttgggcggggacacagatccaaaccatatcactcctcattctcaagaatgtgtacgtttgggtaaaggcctgggtttttctgtttgtttttttgttgtttttttttttggcacccctgcgaaattggtttcacacagaccttattttagacatttcttagataactagcatttacccctctttttaatatttgcctgttttaatggggggggcaaacaaatgttttctaagcccagtagccttaaactaccaagtgaaccaggaaagaccttatttacattgctcttcagcatctgtgaattgagaagaaattctttttccagaggaaagtctttgctcactcaatgtttgggaatctctcatgctgcatcctgaagactctggggaggtggaaaacacccagccatcctgacagcgcaaaatcatgtcttgtcttattatgtccttagtctgttaagaagcttttataaatattaaataaacaaagttcagtcccttgggtcttaaagggaaatagttctttcagtgtagaaaaaaactctccctagccaagtctttttagacaaaggattttcccctgatgatccaagaactggcaattagggcaggaaggatggggtctgtgtgacacatttgggagctaaaccaagcaactgtaaagtgagaaaatgggatgggatgtcctcgaaggttcacgctgttttacagttctgtcactcacgagtgacaaggacaggtccaaattttagttctggctttgccactcatttgcagactcacatggtccagtaagtcacctcactaaacctgagttacctcgttagctaaataaggatagtaaagtacaatcaaaagccatgcatttaaaacatctgtgcgtaagcagcaacacagctctgatgctggctttaggacctgggtcggggacagtgctgcttcacttgttggggaccactagacaatcgccggtgggcacaagtgtgacagcctctcagtggggccacacccaggagcaccccaaagtgagaagcagcaaggacccacattctgtgctgcgtctctcactaatccacacatatccatgggttgactccagccagaactccattcaagtcacctcctaactgccaggcctgtgctagatgctctcgcctatataatctcatttacttctcagattgacagctctcagcaggtaaagcttaaaaggcttgcatttaatagagaagtggcggggcacagtggctcacgcctgtaatcccagcactttgggaggccgaggcaggtagatcacctgaggtcaggagttcgagaccagcctgaccaacagggtgaaacctcgtctccctgtctctactaaaaatacaaaaattagccgggcatggtggtgggtgcctataatcccagctacttgggaggccaaggtaggagaattgctgaatccaggaggcagagtttgcagtgagccgggatcacgccattgcactccagcctgagcaacagagcgagactccgtctcaaaaaataaaaattaaaataaaaaaatagagaatagagggagcccagcagggagaggaaagtagagaatccttcccatgcagcccccgtttacctctggggcagagagaggggaatcttctaaaggtggaagagtgtaatgctcagctacagataaatacgtgttgccctccttctgttcatctaggcatgctcaggatttcagattgagagagttgtaaatgcataactcctccatcattacagcatccagtggcccctccctcactccctgaccgaggccttccctgactagccccatataaatgagtcacctttcagccctccccgctgccccaccctgattgattgaatacttgattggttgattttagagaagaggcctcgctctgttatccaggttggagtgcagtggcgctatcatagctcactgcaacctctaactcctgggctcaagcgaccctcctactctgcctcccgagtagctgggactataggcatgcaccaccacacgaggtcaacttttctatacttcatagagacagggtcttgctatgttgcctaggctggtctcaaagcaatcaagcgatcctctcaccttggaggtgctgggattacaggcgtaagcccccacgccgggccccctgacttgttaattctctgtggcacatttccctcccgggcttggtgtatgcttacttgtcgatgtgtctgatgactgtctcctctcactagcgttgaagtgctgtgagaaccaggacataatcccactgcctggagcagtgcccgctgaccaagtgtctgctggatggatgaaagataatgaaggtcaccaatgggcaatttaagggacttccaagggcagttttcatcctacgagatctttgcctctggtgctgccttggaacccactgctttggagctagacggtgctgttgggatatttcccaggaggagacacccagcaaagcttctgatttgtccaccattccctttcttacgccaggtgaatacaacacacacaatggaccttccacaccagcgaaagagggagacacagacaggccgcaccgggcctccgacgggaagctccgaggccggtctaagaggagcagtgacccgtccccggcaggggacaatgagattgaggtaatccaaaggggctctgtgtgacctggtgaatgtaatctccatctgaggcccaaacaagagtggggacagagttttctccaagtacgaggcggagaatcgcccttcgtgttttacaaagcatgagcagggaagcatgaggttgtccaagcaggtagtcctggggccaggacagaagagaggttctcaaactgaagcagcatcagaatcacctggggggtgggggatggtgcttttgaaatcagggattgctgggcctcagcccaagagtttccaattcagcagatctggggcagggcatgagaatttacgtttctgacaagcccccagatgattatgatgctctggattgaggaccacactctgagagtccctgataaagaaaagaatgggcctccgaccttccagctgggttaaagtggttctctaccctggttacacagcagaatcatctgggatgctctttaaaaaacagataccctggccccatcccagatcaattgaaaagactcactggaggaactaggggggaggaggggagttttaaacattctcggtggggactctaataaggcttagatattgatctgtgtggaggctggctctaatgagtgtgcctctatttctgggattctgggattctgacttctcagaaaggggctctcaacctggactgcacacgacaatcacatgaggactttgagaaaccttcattatcaagttgcacctcagaccaattaaatcctattccctgagggtagaagctaggcatcagtgtttttaaagctccgtgggtgattcctgtgtgcagctcaggctgagaactagtggtcagggatgctccaatctttttttttttttttttttgaattggagcctctctctggctcccccatcacccaggctggagtgcagtggcacaatctcggctcaccgcaacctccacctcccaggttcaagcgattctcttgcctcggcctcctgaatagctgagattacaggtgcacgccaccatgctcagctaatttttgtatttttagtagagacgaggttttaccatgttggccaggctggtcttgaactcctgccctcaactgacctacccgccttggcctcccaaagtgctgagattacaggcgtgagccgccatgcccggacttttttttttttaatcaggtatacatgaggttttcaacaggttgctatgggatacatacagatagtaagatgataatcatcatgaaacagattaccaagtctaccatctcacaaagttactttttctgtctgacaaaagcagctaaaatctacttatttaacaaaaatccctaatacaatataactttgttaactctaattcttgtgttgcacattagatctctatacttgtcatttgttatgcaagtgtagtagtattggccaggtactgacattttcccaaaaacaaaacattatgcctaggggagggtaccagtagaaataggcaaaatggatgccccaaaaccggaagtaagctactgttgtcttatcaagggaggaaaatgagcaaactcaccggtttatacttctttgaaaaaggcagtcagttgctggcctgagtgtgctaggtgtctcggtaggattgtcagtgccaggcagttcaagtacaccagcgtcacatccctatttataatctgtatactttatgcggcagctgcaatgctcagccacaaactcaaacacactgagaaagatcacctttgtcatttccttaaaaagcaatgtaattttaaccctgagtccccatgccaccagatggtaagaaatttcatttcattattagggaccctccactcccaggattaaatgagaatccaggggtcaagtggtctcagaaaccagaccagcctctgacgtccagtgtggctgggtggcccctgccaccttcattgtcaaagcctgcagtcgtcactaaaagtccagccactctctggtgtttccatgctatacaatgggtatggaaatctttgttgagcctgagaaccttgaaatatttgctacaattctttggttgcaagcaacagaaaccagtaccgggcccagcacagtggctcacgcctataaccttaccactttcagaggccgaggtgggcagattgcttaagtccagtaatttgaaaccagcctgggcaacatggcaaaacaccatctctaccaaaaaaaaaaaaaaaaaaaaaagccagccatggtggcacacacctgtagtcccagctactcagggggctgaagtggaaggatcaattgagcccaggaggtagaggctgcgttgagccatgaccacaccactgcactccagcctgggcgacaaattgagaacctatctcaaaaaaaagaaaccagttctggttacttaagcaaaaatgaatttactaggaaaggacaatgagaggaggccgtaaaaccaagtttagaaagaaagtaacaaagacattgttgagaaatctaggaatgccagaaagcaaacattttagagtgcagtgtcctgtccttcggtgtccgattccaagaagacagtatcccagtggcctagcttgggtcttaccccttaattgacagccccaccaaaatagcacacaatggggaaggaaaactaggatgctcttttcagaagccctgaagttggaagctaggggtggggaccgggacctccaagcaacacatgctgacttcagcatgttcagggcatttgatatttagccagtggtccctagttcacctgtagcagttgtttatagctggggtcggttctgatcaccctggaagatattaaatatcctgaacatcatgcttggtgccctacacttggtcagcctcccgagatctaccagtagccttgatccatgctagagacctggtgcagagcaagtgttcccactgttcctggggccattcttagtccagggaattctgtccttgctttttgccttgttcttaaagctccatcctttccccaaatagaggagattttgcacaatcccttcagtgggtttaggcctttgcaaaagactgaaagaaaacgtattggcgtcaggttgtacttgctgtctgccttcccatattcctagaatctcctaccagcttgaagttgcagagcttcgaaaacacagagagccacacatacataatattccctccccacaagaaaattattcagtcacctaacatgttttctgctctctgtaggggaacggcgggggtagagagagatttttccattaaactgagaaagaggtggggagggttatggcatagaagtcagggattatagggtgatattattctggaaacatctgcttcttgatttcagcataagtaccactggcaagaaccattgaaaaggtgtgagctgtgtttcacttctatgcttaatgtcatcatagaaggtttgcttgggtcacacctcttaagtctttggctgttttgctaatgactgaagcccacgggagagaaattatgtggaagtggaaaggaggaaaattctgagcatgtattagttaaaatccttcagctgcacgtgccagggaccaacttgagctacttaggtgaaaaagcagaatttattttaaggatacagggcctctcttagaacttaaggacagaagtagagtagagtatcagcgaggcactggaaccagcaagggagacagggacaagaaactgcatgtatgccttctcttcccatttgccacagtgaagatgacagaactcccaaactatagtgtcctggccgtgccttcatgtgctagttactgggcacagctctcctctgggcctcctcactcctcctttccctctactcccaatgaaaccaggtcctggtaaagtgttagtttgtttgtatctttcaccttctgttcttgtctctggagactacctgtcagatcccggggtctgggtccagcccatgctgaagtccgaggggagtgggtggatgggcagaaagaacactcagggggccataggaggtgaaatgtagttttatttagcagctttctcatcagcagctttctcacattagctgtctcacattgtccacctttatctcggctgtctgcttcagctctgcggctcctgctgccctgacagctgcagccgcgcagccggctctcccttgccttcagggtcagcagcttaactcttcccctctctgggcaccagcgcaagctgtgctgtggctcccctctgtctatctgcaaaacagtcattctcccttacaggggcctgtagcttcattccctctctgggcaccagcgcctgcacaagagccacattgagccaaactgagccaagagccatgccctgtgcacagcgtcagcagggcaattatatcttctaaagacagtagtgactgcaagccaagtatgaactacacaaacaggttatataacaagtggaggtatgcacctgcacgccaaactcgctgagtcacgcaggcctgggtatccatctcagcctagtccttgaccaaagcacatccatgtgccttacgctgcccttgtctccccttcagatcacatggctaaacttggccaccaatagccctccccaaaagacaattactttcttcctagccccaattttaaattgcaaaataaaaggtctctgacccacccatggttaaggacgcaccctggtctgcaccatgatggcctagggaatagggtcacctgcagaatggccaccaggaacttacccactaagaatcgaggatggtgaggtagtaggagaaagggatggatttttttcagaggggatttaatggataaagtaagggagcctgcactaaatttgaaaatatttgctgatttttaaaagttctattactgaaatttctaaatttaatttcctaagttcaaccccagtgaattcagataagttaggacttggcatatttgaatctcagaaggtccttctcaaacactgattttcaaacatttttaccatgacccgtaataagaaatatacttactatgatggcccagcatatatatgcacataaatataactggtccaaaagatttatgaaataatacttagccttactaattgcttcagaaatccctgtactagagaatctgggatgctaatacctttttcattctagatatttctcttaactttcaaaggcatggcaaatgccattgtgttaatacagccattgacctccagagagttttaaaaggtggcccactcaagattgcatactggggagggacatttgcctccccttctcaacactagctacagagttagtcaggtcctttgtccttgaaaataatgatcaccagaaaaataaagaaaatcaacagtatgaaaaataaagaacaagattagccaggcgtagtggctcaccatgccagcactgtgggaggccaagtggggaggattgcttgcattcaggagttcaagaacagcctgggcaacatagcgagaccctgtctctacaaaaagaaagatcaaaaattagccaggcatggtgccacatgcctgtagtcccactactcaggaggctgaggtgggaggatcgcttgagcctggagaggtctaggctgcagtgagtgatgattacgccactgcacacaggccctgtctcaaaaaaaatttttttaattaaaaacaataaaggccaaggtaaataaatgggataagttagaagtgaagtaatttaagaaacataaaataacttaggaaaattctaattggttttcatataaaaactcaagatcttgcatccataaaataaaaagtggaggctactgggaaaggaatactcagagggaaaaaaagttattggaaatcttttaattactgcaaaaatcaaaaatttaataagggttataagagaaagtttaagaaatctcccagaacacagatcaaaaagacagatttattaaaaaatattatttacaaggaaaggcagtatcaacccaaaaggtttgatttgactattgggaatttcacaaaaagaaaacagtagaaaagatgggagaaaattattaaaagaaataagaaaataaaaattttcagatctgtagaaagatgcaagtcattgggttgaaaatgctgaagtgccaaacagaattcattaaaaagaagaccatacccagatatatcttcatggaatttgaggataccaagtgtaaagaaaagatcctttaaaattctagaaagaaaaaaaaggtaaaacctacaaggactgaggaacagtgaaataccagatttctcatcagtgaccctggacacttaaaaaaaatgatgaaagaattctttcaaagatctagaggatattgttttcaaattggaattctgtacccagagaaactatagagaaaaataaagataacttcagatattcgagaattcaggaagattactttccatgtaccatttcaggaaaagcaacttaaggatgtattcaagcaaaacaaggaagaaaaccaaggaagagagacttgggatccagaaaacagtggatccaacccagaaatacaatgaagggaagtctgcagcaagcctaaaaatgatccagtccacattggaggtttctatcactgaggatagatatctccaatacagagtgtgtggctgaatttgacattttaatgaaggtacattgttgcaaacaagaaaaaattaataaattctgacaaaaccaaaaaagttacatcagacaggtatgatacatatatgaacaaactgagatatgacattattttaattatgatggagtacaagtaaagagaatacatacaatggtaggggcattctccttaaaatcaatctggggatatgacattggacacatagagaagacaatgcaatcttagcatattacttggctctgtagtgaacaataatcacaaaatgtaaatgtatattactagttaccaacttttaaaattgacataggcagagtgcagaaaatttaaccttagttataaaaccaatgtacaaacaagtttatcctcattgacaatatgaaggtaaagctacagctgatagacattagagcggggaggatgtatgggaaaaggtagggactcccatatcgatagctccatgtttgtttacctttttagccaagggagaatgtccaaggagaattggaatagagggactcacatatgagaaaaatgtaagtttccagagaaacaacagagatttccatgagttaaaccctcatcttttaagactgcccagtcaaaagatattgtctcaagttgaaaaatcagtaagggtataaatatgttacttagaattatagaggtgatcaccagacttgctaaaaacagaaatagttgagcgtatggtgaacagtgaatttaaaatggtggtatttcattttgtaaaacgagttatatgattttcgttgttgattttggcctgaatcctcctttttgagcttttatatggaaggcaaggacagacttcttgattctgacatcttttgagttgataagagcccaaaaactgggcatccgaatacacatgacacagataaggttggatggggattcatgacacatcagtgagttacatgttttgtaactaaagataatgtttttcgagacttcttttcctccaagggaatgaatttctgcagacattaagtcagatgcacgtgagtccatttttctccattctcttcctctctttcatcacagcgtgtgttcgtgtgggacttggatgagacaataattatttttcactccttactcacggggacatttgcatccagatacgggaaggtaagaatccattttgtctctctctctctttttttgttttcaacgttattgtccagccagtttgtcctggaaattgtgcggacagtttatgaggcagcttctccaacaaaagctgccctttggggtcagcccaggtttaaaaattcctatgacattttcctttgccatgtgaaaatttaattagcttccccttctattgtcttccatgccttttcttccaacgtttgaagcaatcaacatttacttgataggaaatacacttgttgtcttcagccgtctcccttcctaagacagtgggctatggtgcagccaaagccagtaattctagctagaaaacgaggtaaagtacttttcttcttccctgttgtttatcctagtgtctccggcagatgaatttaattttccttctgtttttttgagacaagggggaggcattgtcagctccagtgtggatcttagcaatcgttttgcaaatgtatcatcaacaaattatgtcggggaaccatctagttagaattctaggcaaatgctattggctgaatcgtggtggatggaagagaccttgaaaccactttaataatgcaaaaatgaactcaactgctaaaactcaaaccttgtcaattatttgggttcatcccatgggctactgaacagacgacgagtggatgccctagacatctgtcatctcttcaggggcacgcatggggtggaagggcagtacttaagacgacagcctagttttcatctcctcagaggtgagtgacccactggcagctgcttccacgcatgggtaggaaccttgagacttgccagcgcctggaaaatatttctgtttctgtttagagaccaggaatatgatttgacatcacttcatggcttttccagctgctcatgttttttatgggggttataacaagctggatgtgtaattagcaagatagatttatcgtctgccattatgttgtaaagaatataaaaatggtgttggtggtgcagaaatctcttgccgtgtaggaatgccgttaatatgtctagcagtgcctgtgggaaatccagcatgcatttttggactgtgcacagcttaggtaaaagatggcagagtcaagagctgctgaaaacactgaagaatgggctccacagccattgcaaaaatttgggctatcccaaaggggccacagtagtaagttgcctgctaagtcgtggtgttttatggttttcctaaccactcctgtaaagtcacctcccctgagacacaggcactcactcatcttgcccttagaggcagcctgctgtgaagttccatagctccgtgcaacaactcacttagtatggattgtgtagggatgtgtgatcttgggtatgatttttgtatctgtgtctcaccaacattcctcaaaccaaactgtgggctccttcaagtcagagacaaagccccgagttcctttctgggccccatgtcccctggcccatgccattcctcactgccagccacctctctcccacctcaccacccaattccagccaccttcacctccaactcggcttcctatctggtctcccagcttctactcttgcccactgcagccccctacattggagtcatcctgaaatgcaagcttggccatatcactctccagccgaaaaatcttcagtggcttccccattgacaagcctacccccagcctccaaggctcttcatgagtagcctcctgccccattctccagcctcctttcctgctcttaccctgagttgtttttggtccttgaacctgccacattctctcccatcgctgctgggtttctcccagaagatcctgagacaaagagtgagtgcgagtaatctatctgggaggtaatcccaggaagtagtggggaattcaggcaaggagggaaaggaagccaatacaaattacacaaatataatagttactgccgtgggcagttggggctaagtcccaccagggacagtgttaacccacccaaggagtgagggagctgggatatttacctgcaaattcccttccattaagcgttgaaggcttttcctggaaattgtctccttgcacttctggcctgtccccaagaagccgcagagggcagccttggtggctgacacctataatcctagcacttcgggaggccgaagtgagaggattgcttgaggccagcctgggcaacatagtgagaccccatctctttaaaaaacttaaaaattagcctggtgtgatagtgtgtacctttggtcccagctactcaggaagctgagaagggaggatcgcttgagcctgtggtgagctatgatcgcaccactgcactctagcctgggcaacagagcaagaccctgtctcaatcaatcactcaatcaataaaaagagagccccagggtagagcatcacaaatgctaactgtggaaggtttcttcatatatgtacaggaatggtgacagttgaggggacgtggagctggggcacactggaagcctctgctataatctaagatgttctagaatgttcttttattaagttaaatcctacttatctttcagttctcatttaaaacgtagcttcctccaaaaggactttcctcagtactcctctccatctaaattgcgtctgtcctcataactgtgttttccattcatgtcataattatgtttatttttattttatgtcttccttctaggctataagcaccataagggcagagaccatgaacatttttttttatttccccaaccacgcgcagtacacagggcagaattgctcaataaatatttgttgaatgaatgaatcagggtgatcccctagaatgttaagctgcacgaggacagggacctttggtttggtttggtttggtttggtttggtttggttttgttcatagctttatcaccagtgcatggaacagtgtctcccacttagtaggtgtcaagtaaatatttgttaaatgaaggaaggaaggaaggaaaatagtatcaaaacagaaatttttaactggtggccgctggccaaattcatactgcagatatttctctttggcccccagagtgtttgaaaaaatgtgaatgtgtcgccaacatttaaaaatcaggagattgcacagaccaaaacaatctagatttccagctcttcttgaaaaattagaaatctggcaatcctgcattcccctggggccacaatcaacaggagcagaggaggactgccctcttagggggggtggacattctccagcccatcgcagcccccacctggcctggttaacccattcttgggactctctggccccattggtatctgagtttcaacatccatcctagaattacagaatcatagaagattagagctggaaggacttgagagatcatcatgtccagttagtctccatcgtccataaggagaaactgaggctcagagggagtaagatcatccaagaaagcatgagaatcagactcaagctcacctgccttcctgtgtgatctctggatgtccagggaaaactgaggtgaaaagctgttagagcacccagatcgcctgtgccatcttcatgactctcctagaattttccattccctcctccagctctcgctaaggtgaggaatgaatgagtattatcatttgctaaatctagcaaccttcagagagacccaaaataattgtgacttaaacaagatgcaagtttatttcactcccctgcagtccagatggaagcagttcaagctggggaaactgctgtgcagcaccagagaccacagcctctacagtcttattccctgccattttttggagtgtcaccagcattggcaagataaatcatagcttacccccatgtctgcattccagccagtaagcaagaataggaaaagggggacttgcccctctcttttgatatttttattttcttgtccctctttttttattatttttattaatttttttagagacagggtcttgctctgctgcccaggctggagtgcagtagcacaatcatagctcactgtaacctcaaactcctcactcaagcaagcctcccacctgagcttcctgagtagctgggacaacaggcaagtgccaccatgcccagctaatttttaaaagttttttgtagagatgggatctcactgtgttgcccaggctggtctcgaactcttgggctcaagtgattctcccacctcggcctcccaaagttctgggattacaggcctgagccaccacacccagcaagccccacttttttaaaggccagactcagaagttgcaggcatcacttctgctcttatcctattgggcagaacttggtcagatggcctcatctacctgcaagggagtctgtgaaatgtactctttatttgaggctgtcatggccagttaaaatttagatattctattactctgagagggagaaaagaagaatgggtattagaggacaactagcaatttctagcccaaagtactgtatagtaaaaggaaaaacaattaaatagaaaactgatgaggaaacataaaattagttatgtttgagaggcctgagggacaacaggatttgtaggtctgaagctccagagagaggtctgcactatagctctaagcttggatgtcagagaagtaataaggatgtagaggagaagtgtgagccccattttgcagacagagtgactgagatgagacctacagaagttgtgtagttggtgggatattcatgacagaaccaaaactcatggcctcagcttctggctcacagttctttctctctgtacttccccagcactgcagccatgtgaaacttgttattaatagctgtcatcaagtatgacattcagtttgaagtacagcatatttaagctgcaaagaaaatttattgaagcacaataattgaaaaacccagggatacctgggattcaggtctggctggatccagatgtttaagcaatgttcttaggtcattctgtatctcttagccaattttctccatgtggtaactccctctcagcaatcccaactaaaaactggaaatttctagtacccacattccagcacaacttctaggcgttaatgccaatgtcccaaactgggtcacatgcccatccatatgccaacctctgtagctctgattggccagccaaatcaagagcccactcctggcatgggaaaggaggggcagatcagctccacctcaaccaaatagagtgagagagggaggatggtcccccaaaggaaactggagtaatccttccagaagagtatgaaggcccatggatgtccagtgaatgggcactggatgccaagatcccctgaacatccatgacaagaaccagcagcactttgcttgtggccatcatgctgcataccatgcaggaagccaaaatcattaatagtaccagccagagtggggacttgctgttttttgggggaactaagcccaacaaagctaaaatgattggggaatgattcaaaataggttgtttgaattttaagacagaaactgggctcccgttctgttcccaatcaagggatgtgctgcttgaggctgtcatctcttcacttcctttccatttcttcctccccagtgctcagagccagaacatccctttggtagctgtatctcccagcatcttgtggatccattagaaattccctagagagctggagcagccagtgactgctgcctctttcctaacccctcccttcccctaccaccctcctccgcagtctctgaactctgtttttttccagctggtattaggcaaatgcaaggtggtcaagagcctttgcctgtggccaggaagggattctaaaagaaattagtcagctttcctccagggattcatggggagttgccctgactcctccttttgtgccttgccttctaggcagcccactaccaatatgaagctcaactccaggacctgttgttgttgttgttgttaataacaattttattgagatacaatctacatatcataatttaccctttcgatgtgtacaattcagtaatttttagtatattcacagagttgtacaaccatcaccactctaattttagaatattttcatcaccccaaaaagaaaccctatactcactagcagtcacccctgccatttccttctccccctggcccctgacaaccactaatctactttctttctctacagatttgcctcttctggatatttcatataaagggaatcacacagtacgtgtgatcatccgtgttgtagcatgtatcagtactccattcctttttatggccacataattttccattgtgtattagtccattttcacatggctataaacaaatattcaagactgggtaatttataaaggaaataggttaaatcatctcacagttctgcgtggctggagaggcctcaggaaagttaacgaacatggcagaagaggaagcaaacacttccttcttcacaaggcagtaggagagagaaagttcagagtgtagggggaagagccccttgtaaaacgatcagacatagtgacaacccacccacccaccacaagaacagcatgggggaaaccacccctatgatccaatcacctcccacgaggttcctccaccaacacaaggggattacaatttggattatgattcaagatgagatttgggtggggacacagagccagaccatatcacagttcatggataaactatattttgtctatccatttatcagttggatagttgaagtttgggccattatgaataatgctgctatgaacattggcatacaagtatttgcatgtgcatatgtttttaattctcttaggtatatgcctaggagtagaattgctgggccacatggtaactctaggtttaatgcttttgaggaacagccagattattttccaaagtgactgtatcattttaccttcccatcagccatgtaaaatggctccaatttctccacatcctcatcaatatgttattgtctgcctttttggctatagtcctagtaagtatgaagtggtatctcattgtgggtttgattggcatttccctaataatgttgacaagtgactagtgatgtttttatgtgcttattggccatttgtatatcttctttggaaaaatatttattcaaatcttttgctcatttttaattggtttgtctttatatcattataagagtttttatatatctggataccagtctattatcagatatgtgatttgcaaatattttctctctcattctgtgagttgtctttccattttctttgtggtatcctttgaaataccaagctttttatttttatgaagtgcaatttatgtatattttctttggttacttttgcttttggtgtcatatctgagaccctattgcctaacctaggtcacagagatttactcctgcacttttttctaagaattttctcattttagctcttacatttaggtctgtgatccattttgagttaatttgtgtgtatgatgtgaggcaggggtgcaacctcattgttttacctatgactatcaagtcgtcccagtagcatttgttgaaaagactcttctttcccctactgaattgtctcaacatcctgtcagaaaatcaattggcagccaggtgcagtggctcacacctgtaatctcagcactctgggaggtccaggcaggtggattacatgaggccaggagttcaagaccagcctggccaacatggtgaaactccatctctactaaaaatacaaaaattagccagatgagatggtgcacgtctgtaatcccagctacttgggaggcttaggcatgagaattccttgaacccgggaggtggaggctgcagtgaaccaagatcatgccattgcactccagcctgggcgacagagccagactctatctcaaaaatttttttaaaaaatcaattggccgtaaatatgtttatttcttgactcttcattttatcccatagatctgtatgtatgcccttatgccagtaccacactgtcttgattactgtagctttgtagtaagtttcaaaaatggaaagtaggagtcctccacctttgttcttatgaccagtcttgacctttataattggcatctccattggttttattttttgtggttttaacatagcctttgcacttgctgttgttccctgtgccaggaatgcccatctccccattttctacatggctcctttattcacgaatctgcccagtggctgggcgtggtggcccatgcctgtaatcccagcactttgggaagctgaggcaggcagatcacttgaggccaggagttcgaaaccagcctgtccaacatgatgaaaccctgtctctactaaaaacacaaaaattagctgggcatgatggcaggcacctgtaatcccagctactcaggaggctgagacaggagaatcacttgaacctgggaggcggaggttgcaatgagctgagatcacgccactgaactccagcctgggcgacagagcaagactctgtcccaaaaaaaaaaaaaaaaggaacctgcccaaatgtttcctcatcaaaccacctgatgcgttaaatatgtattatttattacctgccctctccaacacacacacatttgaatgtaaactctatgaaaacaagcaccagggccaggattagccttttgtaggcacaaaatttaagtgggtactgagaaacagagtaatcaagctcaatcatattttaatgcaatattttacaaatcaaaattgatgccaaaaaatcgatcatgaaagaaaatcaaaatgtaaacaaagacagatggttgtgtgtgttactgccctgcgttattgtgcaatgggaacagtttccaatcagcccctgactccctggcctgagtgactgttacctctccacagggcaggtttatgagccttggcaatggcaggaacagattggccaacgagaggctttaatatatagtcatcttttgtgttttgttttttgtttttgtttttgttttttactgtagagcttttattaactttttccacttgagtcaaaatacagaaaaatgttttgataagtgtatgtaggggccacatttttcctcttgcctcaggccctgtggcttggcctggaatggcaagcaccagggtggtctgcctcccagctgtagcccccggacctagcacagggcctggcacatggtaggagctcagtaaacgtttgttgattacatgactgtaatcaagggagtattttaagtgttagtagcagggagagatctcaacccacacagcatgcatgaaatagaattttggttttctgtaacgcaatggaattcctacttgcagcctttgttctgctgggttctttttccttcctcaccaggttatatcagacttccagggagctcacaaagcacccagggattgggtgagagtccatggacccacgagtcctctgtccacttacgacactgctgacatgtatctggttcctgtccctaggggtgcttcaggtctggtgggatctggaatctcagtgaggctggctatggtcctatctgcctgaccccctagcccagactgtcactctcttaggttttgcttcctggcacacgtggcagggtagggaggcctctgaaaacccccttccatccttcagttgttggaagtcaggacaagaaaccagtgccactcgctcagcatcccaaggccaaaaagctcaaaatctgctaccttatgaatgggaggctggaaaacagggaactgagggagcagagagtaacaactcacatctcgcccatgttcttgttggcggatacatcagatccttgagggagcgaactggagtagaagggagtgtttggaaaagggaggaatttgcagttgtcacggtgatgggaggcacaacaaacccgtgaatcaacccaccaagataccattagtggtctccatagaaatgtgtgcattttctcattttattcaacaaatatttatcaagtgcctcctgcatgccaggtgtactgttctaggccctggggatgcggcagggaacaaagtccattaaaaactctgccctcatggagctgatatccttggggagaggaaggaagatgataagcaagacacatagaaatgcaagtggccaggcacagtgacacacgcctgtaatcccagcactttgggaggctgaggcaagtggatgacttgaggccaggagttcgagaccagcctgcccgttatggtgaaaccccatctctactaaaaatacaaaaattagccaggcgtggtggtgggcacctgtagtcccagctatctgggaggcttgaggcatgagagttacttaaacccaggtggcagaggttgcagtgagcctagatcatgccactgtactccagcctagacaacagagtgagactctgtatcaaaaaaaaaaaaaaaagaaagaaagaaatgcaaggccaggcatggtggtgtacccctgtaatcccagcactttgggaggttgaggcaggaggattgcttgaggccagaagttcaagaccagcctggacaacatgagaccctgtctctaaaacaagaaagagagaaagaaaaaacaaaagagaagaaggaagaagaagaagaagaaaagaaaaagaagaagagagaaggaaaaaggagaagaaagaagaagtaggaagaggaagaggaagaaggaagggaagggaaggggaaagaagaagaaataagaagaaataataatccagagaaaaagagaagttgaaattaaatttgagaaaaatgtggccagggaaggaggccacacagagaagctaaattttgaataaggcctgaaggaagtggaggaacagaaatctggtggaagggcagagggaatggcacatgcaaaggccctgcagcagaagtgtgcctggggagtttgagggacagcaaggaggccagtgtggctggagcacagcagactgactcttaagttggagctggtagagatttggagtagaaggacagagtctgccctggtttcagtatggtttgttgagccccacaaagtctcatgttgaaatttcatccccattgttgaaggtggggcctaaagggaggtgtttggatcctggaggtggatccctcattaatggcttggtgccattcttgcaggagtgagtgagttctcttagttcccgtgagaactcgttgttgaaaagagcctggcagctccctccactctctctcttcctctctctccacatgtgatctgcacatgctggctcccctttgctttccaccatgagtggaagcagcctgaggcctcaccagatgcagatgctgttgccatgcttcttgtacagcctgccgaactgtgagccaaataaacctcttttctttatcaattccctagcctcagatattcctttatagcaacacaaatggatgaagatggaatctgagttccattcttatttatctttattttttatttatttattttagagacagggtcttgctctgtcacccaggctggagtgcagtggcatgatcatagttcactgcaacctcaacctcctgggctcaagcagtcctctcacctcagcctcccaagtagctgagactacaggtgcacaccactgtgcccagctaattttttttgagagacgagggtctcagtggctggtctctactcctgggctcaagcgatcctcccccctcagctttccaaggtgctgggattacaggcgtgagctactgcatccagcctgagctccattcttaaggagcccctctggctctccccggggagaggagagtagaaagtggccaggttggaatcctggcgatgggtgaggaggctactgcaccagtttatctgaaagactgaactggtctttctcagtttaccgttctctccacccagggagtggagatgcaggcggggaggagcacagtaggctgggtatattttgaaggcagaccagccacagataaagaaggtaaagggagtcctaattctcaccaccaagctgcaaagatgccctgttttccatccagggtctccccctgaagagacctgattgcttctacccctgttggcaaccagccaattcctcctgaacaaattcctcaagctttactgcacatttcctatacaccaagcactcactatcaattttattattttcttaagttaagcctcaaaggcacagcttgagttattcatattctttgtccacacaaggcccctttcttgtttcacgtaggtactaccaatgtgtttccttttaaacctatttgtgctcctttccctcccctccctatatagctcagtgtatagccttttgtttgtttcctgtaacatatacattctctttttgtgtgcatttatttcttatgtgtataggtgacattgtttaaataccctgtgtttcttacctttctccctctgtgctatggtttcacttatttatttctgagacaggggtctcgtcatgttgcccacgctagtctcgaactccagggctctagtaatcctcctgcctcagcctcccaaagtgctgggattacaagcatgaggcaccacaccctgcctgcactatggttttagatcctcccacattgccatacatacaactctatcactctaacacaatagtttttaaccagaggaagttttggcccccaggggacatttgacattccccatttttggggaatgggatactactggcatctagtgggtagaagccagggatgctgctacacatcccacaatgcacaggatggccccacaataaaggatgattgggccctccgggtccatagtgctgtggctgggggcctgcatctgaccgctgcatagtcccaggtcctccaggtcttccttatggcactctcttcagggaggacactcaggcttcctcagctccgcatcagcacagacagagctgtgacgagcaacctttatggactgctctgagctttacaccctctctctcatttaatccccaccatgaatctataaggcccagctgctccctttatactcatttccagagaaactgaggcccagagaggtgatgtgacttagtcaaggtcacccagcttaggagggatgaaagccaggaagtggcccactgctctttaatttattttttattttatttttctgcgacagggtctcactctgtcactcgctgaagcacagtggtgcaaacacggctcactgcagcctcaacttcctgggatcaagcaatcctctcagctcagcctcttgtgtagctgggaccacagacatgcactaccatgcccagctaattttttatgtttttttgtgagacagggatctcactttccccaggctggtctcgaactcctgggcttaaatcccaaagtgctgtgattacaggcgtgagccaccatgtccggccgctccactgctcttaaccacgtaacatgtccctagtgatccatgtgactgtctcgagggtaaaaattaaaagcctctggaatgaactcttctgctgcctcttagctcgtggagcacagggactgggtctgatgtgttcacagctttatcccaatacccagcacagtacctggcacctccactggacaaatatttgttgaataaacaaataaacaaagggctgccaggtagggagttttcacttgtgtgatggcaaatacagcagaaataagattccagggcattcacccacaagggagcagacagccacgtgtgtgacaagcaggggcctggcagcctctgtctcagactgagatgctccatgccccctagcctggcctcacctagagcctggcccacagcagggtctcagcaaaggcttcacaattttgttttcagacattgcatccatcccctccttcctgaaaatgtctttgttctactgtccttcatggcagtttggctgggtatagaatttttgtttggaaataataattttccttcatagttttaaggcattttcccattgactctggcttccagagaataaatgacaggtgcagttggtcctaattgaagtaggtcagaaggtgctgagaaagacatcttgaagaagtgaaattggtaaaatacctggtacatctgaatgcattgagaggatttttaaaagatcattatttactccaacggaaaacaaaaggcatgagaagtgatcatagtttactacctggcttagctgtgttatcagttagctacaaaacaatcaccccaggacttagtggcataaaacaataagcatttattattcagcccatgagattttgagttggcagagaggttctactgagctagactgggctcttgcatgtgtctgcagggtcagctggcagatcagctggtagagaatggcctgagctgggacaacctgtctctgctccatggggtctctcatcctccagcaggcaagtccaggcttttcctcgtggcctaagaagtgttcctttcaaggagagagacccgtctttagtcctccatttggaactggcgtgccatttggaactggcacactgtgaaaagtgggcagcactgtaccctggggcttagaaacgagcccagatcatttctgctgcattctgtcagcaaaagtaaacataagccagcccagatttaaacagagcagtaaccccacctcttgaagggagaagctttactatcacacttcagagggtgaagatgtaaggacattgagtcatcaaggcagtcagcctatgcagtaatcacagcagcgtgaactctgactagtagcccaataaaaaccattcacttttgagaagccgaggtgggcagatcacttgagcccaggagtttgagactagcctgggcaaaacagcaaaatcccatctgtacaaaaaaaaatttttttttcaaaaaattagccaggcgtggtggtgtgcacctgtagtcctagctactccggaggctgaggttgaaggatcccttgagcccaggagttagaggctgcagtgagccgaggtggcaccactgcactccagtttggccaacagagcaagaccgctgtctcaagcaaacaaacaaagccatgactatttaggaggaaaagagaatgagaaggatacatatgtgcggtaaaggtagcaagaagaaaatccacattgcccatagtgggatcaaataatgcctcaaagtgaaaaatcaaaaagccatgtaattataaccatgcaatttagagacagggcagtgagtatcaagataatgaatgaaggaaagagttgaaggtggtgacaaagggggcatgagagggtgtgtcagggaaactgcagtcttataacaagccttgtggaactttttgagcatttgacaaaaattaaaactattaaaaattaaatgatttaacttgattatattatgcatataaaagaatgagttatgcaagactatatctgatcagctccttgctgagaggagagattaggcatagattggagaaagaaggtatctgcatggctcagatagtcaaggaagacttcctgtaaaaggaagtatcagctgagacttcaaaactaggccaaaaaaaaagcacttaggcacgtttgggagtttacagttcattcttacattatttgtcttaattccacaaccaccttcttgaggtgaataaatcaggaattattgttactcttcttattttgcaaaagagaaaacagttccagggaagttgagggacttgcctgaggctccagaagcagggaatggctccaaaagttagatttcatgttcactcctttttttttttttttttttttttttttgagacggagtcttattctgtcacccgggctggagtgcagtggtgatgtcttggctcactgcaaccactgcctcccaggttcaagcgatcctcctgcctcagcctccctagtagctgggattataagcatgcaccaccacgcccggctaatttttgtatttttagtagaggtgggggtttcaccatgttgaccgggctggtcttgaacccccgacctcaagtgatacgcccacctcagcctccccaagtgctgggattacaggtgtgagccaccgcaactggcagattttacgtccaaatgcaacaaaggctagctgtggctaacttaaccacaaggaaattgattgggagggtatgagggagttttcaggatccaggagaagaatggaggaaaagttggggctcccaaggagcaggagtgatgaggtggcacctttaggccttacagctgctgtttcatccttgaattgcttcagtcccaggagagaggggctgatcggctgtgcctgggacctgtgcccacctctcagctaagcagggttagacaccttgatggacagcccaccaagccacctgcagtgggggcaggcagttccccatgaggaacctaaggagcttttagcagaaagaatgagaatggatgagaggcagaaaccatgggtgctcatgccaggagcagagccagcctccacatccacactcggggctgtctgctctgaaaggtgggtagcgctgtagcctggagcttagaaacgaacctcagatcacacactttgtattcacccactgcaaaggtcattcccaggctgagatttctccagagagagaaatgcccagcatctgccaccagcacacccctccttaagggaaacccactctcctgagacacacagaccataatgtttctgcttttcagagtgaatcactgcctcagacacagctgagcccacatcaaattcctagatgggttttttttttttgtggatatgctgtggtttcaagggggagatctccactgtgcttctggggtttcttatttaaatggaactaggtgtcattcaaagtagcagtggctgggatcaccacatgttccctgacttgcctttttagtgaccatccacacagatatctgtttgttccatgactcttggactcatgagtcagctcttctgtcgggggagaatgggcagaactcacaggcagcctcaaaggctctgtataagacacctgttggtgtgatggctacagaaacacaccatcctctcatccctgggggcagggcaggtgaatgcccatgtcacagatgagaaccctgaggctcacctcgctgaagtgcctgcactaaaagcctctggaaaaggtctttcacacagggttttctgtccccctttaagggtgacgtttttagcctttcctcttcagaaggcatgaaaagcttcagccttggccggccacggtggctcatgcctgtaatcccagcacttgggaagctgaggctggtggatcacctgaggtcaggagttcgagaccagcctggccgacatggtgaaaccccgtctctactaaaaatacaaaaattagccgagagtggtggtgtgcgcctgtaatcccagctactcaggaggctgaggcaaaagaatcacttgaacccaggagatggatattgtagtgagccgaaatcgtgccattgcactccagcctgggccacaagagcaagactccttcaaataataataataataataaagctttggcctctatcaaagacactgagagagtttggatatttgatccctgccccagtctcatgttaaattataatccccagtgctagaagtggggcctggtgggaggtgttgggatcatgggtgcggatccctcatggcttgtgaggatcccacatggcttcacaatagtgagttcttgtgagatctggtcatttaaaagtgtgtggcacttctccgccactctccccctcttgctcctgcttttgccaggtgaagtacctgctcccacttggccttctgccatgaataaaagctccctgaggcctccccagaagctcagcagttgcctgtgctgtgcttatacagcctgcagaactgtgagccaattaaacctcttttctttatagattaccctggctcagatatttctttatagcaatgcaagaatggactcacaaagatactttcgggcatgccgaggcaagcagctgaagggtcttcatagccaaatttgctcacaggtggggcctcctgcccacctcccaactgcccaccaccttacccttctcccacctgccagagggattgcttgaaaatgcaaatcaggccctgcaatgaccccctcttgctgccagggaagcagactgctcccaaggaccccctgcccagctcatcgctgccgtcttcagccgtcttccctggccatacaggtgcctttgctcacccagggcatcaaattcccaactgtctgggcctctgcgtatgctattctgaattcttagaatattcttcatccttcttttttactcctgttattcactgggaggctcagcttttctttcataacacagttcagaagttacttcctcgagggtcccccagagtaagtcaggtcacccgtcttatgctcacgtaactctcttaactgacccatacgccaaccatcatcattgctgtgtctgtctcttgaatcccatccccttctctccagctcccccaccacctccttcatttcagcctcctccgccctctccacgggtctggacagctgcctccctgcttcccctctgcctccaccaccctcagcctattgggcagccaaacaactgcttcaagaggcaaatgggattgtgccaccttctccatcctcacccggtggagaaccctgcagtgatgctcactgcccttaaggcaaactctttgccatgactttccaggccccgggcggtccagcccctgccaaccttgccaactttcaccttgatctctttcacccacccccagcactgctgcagcctcctgctcacatgcacttcccaccacagggcctttgcacacactgttgctctgcccagaacactcttcctaccctcccttagtctaaccagtgttgcctgtccagtgtggtatccttagggacgcttcccaatctttccaagttggttaaaaacctcctactgatggttcatagcaccacagtgctcatagtagcacagttgcaattatttatttctgggtgtgattatttgattatagaataacatcatcatccttcttttttttttttttttttttttttgagatggagtttcgctcttattgcccaggctggagtgcagtggtgcaatcttggctcactgcaacctccgcctggctagttcaagcgattctcctgcctcagcctctcgagtagctgggatgacaggcgcctgccaatacgcctagctaatttttgtatttttagtagagactgggtttcaccatgttggccaggctggtctcgaactcctgacctcaggtgatccacccacctcagcctcccaaagtgctgggatcataggcatgagccactgcgcccggcccaccatccttcttaaaaggctggaattgaaacctcattataacagattctgtcaatctcccctcccccattattcccgtagcactctgctcctttgggtgtgacgatgtccctctgcaggcacctgtgaccctctgcagtgcgttgggcagtgtcccagagggacagagccccagtggcccaggcattgacctgctcattgacccacccttccttcccctccactctcacgctcccactgtgtcaacagcccttcctgagatcacctcccagaaaaaccacctgcatgtgaatctttggctctgggtcagcatcctgggagacccaaactaagacatcgaggatgtatgaatgctgggactccatgattgctgctgcagggatggaaactcctcttagtagagccctgctgtgacataagtctcctggctactgaagggcggtctggcatcaccaggtagctggcagaaatgcagagtctcagaccccgctgtagactcactgaacatgcatctgcattttttttttttttttttttgaggcagagtcttgctctgtcacccagacttcagtgcggtagtgcagtggtgtagtggtgcgatctcggctcactgcaacctctgccccctgggttcaagccattctcctgcctcagcctccccagtagctgggaccacaggcgcacgccaccacacccagctaatttttgtatttttagtaaagacggggtttcacgatggccaggctggtctcgaactcctggcctcaaatgatccgcccgcctgggccttccaaagtgctggggttacaggcatgagccaccgcacccagccaagcatctgcatttaactccatccccaggccatcctttcacacattcatctgtgaggtgagatggagccccgaattcacctggtgttggcttttcttgcagatccagaggccaggtcgagagagcatgacctgatctccacagctcctcgaccggctcctctgccctctccgttccaccacagtcctccccgattcctccgcgggtgttattacgtgattccggcttggattccggaatccagaacccagcacaggactgtagggattcaatcagatccagttggcgataggcggcttggcctgtctgttactgctttacaaactgagaagaaataaaaagaaaaagaaaaagaaaacccggttttatgacgcagcagttaaaaactatttgtagaagttgctaaggttcaaatcaaaagtgccctctctcgaggactattagttaattcagaggaccacagattctttccttttcttccttttcccccttctaccttgaaatgtagctgtaattcatttctgccgttcatacagctagagctttccatcctgtgacaaacacaagccaaagtgcttaaggacatctgtttattttatttctttaacgagaaaaccttccaatttctcctgagctcagctgtgtttatttacattttcttggtcatgtgaggcgagcaccttggaagtttaaaggcctggccagacccttgcaggagcctgtagctctgaaacggagaggaagccctgcccaaggaaaacagagtccttggaactctataaaatagattctcaaaataaatactgcctcattcacttggtagatgtggattaagtcaagatgaatacaatttgaaaaggattttctgaggaagtcggagatttctttcccccactgggggttaaaccttgtatttaaatctctcttcccccttccctctctcttttcagctgagtaaaaggtgtttagtctttgtggctaataaagaaaggatgactttgattgggcttctccagcagtgattattttctttgcagcacggctgggagaaggagagtgacctcactagtcactctgtcccatcctgtaaggagtgagggcaagaagcaaacatctgcagttgtcattttggcgggggtgggtgaggaagaagttggaacagccttgagagatgtcccggaggtgaatgacattgtttgaggtgttggatgggggtggtaccctttgttggcttaatcccttataatgatgcttccctaagccagggaccttcatgccaagtacccccgcttatgtattttacagcattaaaggattatttccaacataaaatatattttaaagatggtttggggttgtcagaaaagtgctcattagcagagactttctttgaagccctgtgctctcggccgctttgagagagaccatttccttatagaatcactcaacttgggttgagagttctgagcgagttaagtctcctgactatgcctaattttccgcccacagatttaacaaacacagactgcttccccagacttccttcgccaacttcccccgctttcttgccccacctctcagtgaatgctgaagggcatctgaaaggaaagaaaaaggagagggatttaaatcctccatgcaaaacctacaacaaattgtcagctgggttggagtaagaagctcctttgtcttctgtaaatatagagcttgctgctcacgatgataagtgctgaaaaaaatcccaggcactctgggaacctacataatgggaacaattttcctttacacttaactagcaggttgagaagccgtctcccctccaactactcacctgcactttttacactacttatttcccaacaatagtgttcttccagcgtccaaagattgctggtgatgaggtgtcacctgctaaacggcaggaaggtgtcaacgccattgtatttggggttgactttgacagggaaataggaggtgtcccctcaccatgcctgcttcccacacttcctctgtgaattcgtgaactttcaggcccctccgatggcagatggggaaaagctccaatggatgtctcccagtggggcctaattcaaagcagaaatatgcagtctcggagtggaaatgaccatcaatggatgaatggataaatcataggatagtcatactcgtggaatatgattcagctatgaaaaggaatggggtactgatacatgctacaacacacttatgtcaagtgaaagaagccagatacagaaggtcatatttgtatgactgtttatatgaaatacccagaagaggtcaatccttagagccagaatgaagactgttggttactagggactgggggtagtggggaatggggagtaagtgcttcttgggtacagagtttccttttagggtgatgaaaatgttttggacctaggtggaggtggtgggtgcacaacattgtaccctagattccactgaagtgttcactttaaagtggttcattttcacacctgtaatcccagcatttcaggaggctgaggtgagaggatagcttgagcttaggagtttgagaccagcctgggcaacatagtaagagcttgtcgctacagaaagaaaaataagtaaaataggccgggcacagtggctcatgcctgtaatcccagcactttgggaggccaaggcgggcggatcacctgaggtcaggagttgagaccagcctggccaacatggtgaaaccccgtctatactaaaagtacaaaaattagccggggcatggtggcacacacctgtagacccagctactcaggagactgaggcagaagaattgtttgaatccaggaggcagaggttgcagtgagccaagattgtgccattgcactccagcctggatgacagagcaagactccgcctcaaaaaaaaaattaaataaaatagccaggcatggtggcgtgtgcctgtggtcccagctactcaggaggctgaggtgggaggatcgcttgagcccaggagttcaaggctgtggtgagctatgatcgcaccactgcactccagcctgggcaacagagtgagaccccatctcaaaaaaaagggtttattttcagtgctatggattttacctaaattttttaaaaagaaagaaagaaagaatctccttgggtagtcacgttttgttagaccgctgagcccaggcttggtcttggtatgtgctgccatagcccgtgtgcccaatgcggtggggaagtcgcttcttgccatggtgtctgttgtgacatttctgactggaatcctgccgggtgatgtgacactgtggagtctaaaggtcccagatcaaatcccatccccaccacttcctggaacaagtcagttttttcctaaggtctcagtctgtaaaattggaacagcagttcttgccctactgacctcataagacaagcccgagaatgattctgtttcccaaagggcactgagagtgctctggaaggaacgcacacggtctggagatagctaaagatgaatattttttacttggaaattcagataggactttttgttagttcttgagtttgaattttatactgtcatcatctggttttggtgtccagataatactggcctcatcgaatgggttggaagtgttccctcctcattagtttcttgaagagattgtggagaattggtgctaattcttttggaatatttgatagcattctcccctggaaccatctagcccttgcagttcttttttgttttctgggaggcttttaattaggaattcaagtttgttgttgttgttgttgttgttgttgggttttctttgagacagagtctttctctgttgcccaggttggagtgcagtggcacaacctcagctcactgcaacctccacctcctgggttcaagctattctgcctcagcctgcggagtagctgggtctacaggcacccgccgccacactcagctaatttttgtatttttagttgagacagagtttcaccatgtttggccaggcttgtctcgaactcctgacctcaagtgatccacccaccttggcctcccaaagtgctggaattacacgcatgagccaccgtgccccgccagaattcaatgttttcgtaggggtagttatttcatcttgggtgagtttgggtagtttatggtcttcaaggaattgattcatttcattcgttgtcaaatttgtatgtgtacagctaaaaaacaaaattgaagtatctacttttatgatgactttcagtttgtagcatataatccataatcagaaacctacagtaggcaggaggatcactcgagtccaggagtttgagaccaccctggacaacatagatcctgtctctacaattaaaaataaaataaatctctctccccatgcatagcactgggtcagatcctttgcatgggtcatctccttggtcttcaacacgaacctgcaagctaaacatagtaatccccattcaacccagaaggacacaagctctgcccaagactaccacgctgggaagtggcagagaagggatcagacccagaactccaaaggccattctaaacccaactgagctgaccaaggccccaagttccctggcccagccctcaaacttgccctccaaccccagctccttcctcggccagacatcacactgagggcatctgcaggccacacctggcccttaaacatatcctttttattacttttaaaatttgttgccagcatttaaaatcaggatatttcacatacaaatccagctttctggtttcttttgaaaaatcagaagatctgggcatgctgcacccacaatcccaaatggcatcacttggctgcagctgcccagaaaccaccccctataaatggctcaggtgttcagtttgccacagtcccctcattccctatcatctccctaacattaatgtcatcatgtttcattttcttcataacatttgtcactctctgaaatgaaatgtttcttagttattttcttggttttttttttttttttttttttgagatggagtcttattctgtcgcctaggctggagtgcagtggcacgatctcagctcactgcaagctctgcctgctgggttcatgccattctcctgcctcagcctcccaagtagctgggtctacaggcacccgccaccgcacccggctaattttttttttgtattttttagtagagatggggtttcaccgtgttagccagggtggtctcgatctcctgacctcgtgatccacctatctcggcctcccaaagtgctgggattacaggcgtgtttcttagttttttatgcccttctctgccattagaatataagctccttgaggcaagggactttcaatatctgagagcaaggagacagcattgcaaagtggtcaagagcagaggtcagcaaactacatccatcctatgggccaaatctgctccctccccactcccccagcttgtttttttaaataaagttttattgtaacagtcacacccattcgtttacatcttgtctatgtctgcttttgtgctaccgcagcagagttgaatagttatgatggaaaccatatgggccacagagcctaaaatatatgctttccaaacctttatagaaaaagttcaccacccctggtctcaagagccagactactcagatccaaagacagctccacttcctagccatgtgacctcagacaagtcactttgccttcctgtgcctcagttttcacctctgtagcatggatgtaataacaataatactcaccttatagggtcactgggggaggattacatgagttaatacatgtcgagtgtttggagctgtacctcctatgtagtaaagagtttttgtagataagcaaatgacacttttttttttaattgacagataataattgtacacattcatggggtacatggtgatgtttcgatgcatataaagtataatgatcagatcagggtaattaacatatccaccatcgcaaacatttctcatttctttgtgttgggaatgtttaatatcctccttctagctatttgaaactatatattattattaaaatattgtcatgagtggggcaaggtcagatataaccaggtccacgcacgtttatgtctttccacaaggtcaggctttcactgatgctatttcagttatgaaagccactagctagaggaagacaagagaatgacctgtctggagttcccaaggaggcaattctccttaatattaccctttcacttggtagtcagggccatgagcacaaaaggctgaaaccactccacaagtcagtcaatattgcaaaccatacataatagtatacttaattgatatataaatgttatagattagaatttcatgccaaacagcaacattaggcatcaagaataaaggggatatgaaaagggactaacgggctgggtacggtggctcacgcctgtaatcccagcactttgggaggccgaggcaggcagatcacttgaggtcaagagttcaagaccagcctggccaacatggtgaaacccccgtctctactaaaaatacaaaaattagacagacctggtggcacacacctgtaatcccagctacttgggagactgaggcaggagaatcacttgaacccaagaggcagaggttgcagtgtgccaagtgcactccagcctgggtgacagagtgagattccatctcaaaaaaaaaaaaaggtgggggagtggggggcctaatgaaccagtccaaggagagtgacatgtagaaggagagagtcctgatccgggcacttgccagtatcttccaagagtcctttatttgggcagagccttcagcttcaaattctgggtgctgatgacaagtgacagtgagacagaatgtgttaagatgtcaagctggtgaggtcctgctcattttatgacccttgagtcctctggtgaggactggtggtaaagggttacacccttatctggttgggtgttgtctctattgattaggtagacatctggactcttgttgacttgatgacttttaaaatgtaagatggagtctttttctaagatggagtcacttatgtcaagggtgtgctatacatatagtatcttttaaagagctgcatctttagaagcacattgctggttatgtaagatgttctatctgaggaagtgtgctgaagtgtgacgactactaataataagcagaaagcacgtggtgttgatggggatgttgtcaatgctgatggcagcagcgggcacttgctgggcatcaaaccctgttctgagtccttggaatgactttccataaacaaacccatctcccatgtcaccacatgcccctcagccctgggcagtgactcctgttagggtgatcatctcatccaggtttgtctgtgactttcccacttgtagcactggaagtcccaagacccaggaaacccctcaatcccaggcaaatcaggagagttggtcactctactccatatccacaatccattttatctatttatttgttatttttgcctttaaatttatatcctagaaaaatactttaaaagctgctagacatgtccagctgaaagaacattcttcaaagattaaaaaaaaaaaaattctaagaggctgaatagttgcacaaaaccccaaaagaggaaccggtttcaacatctttctttgttctcttaaatttgaccatgatttcatcatttgtcatgagtttgactcttgtgattcagcgatgatggaatgtatcctacagtcttttggttaagttttttttttttttttttttttttgagacagagtcttgctctgttgcccaggctggagtgcagtggcactatctcggctcactgcaagctccacctcctgggttcacgccattctcctgccttagcctcccgagtagctgggactacaggcacctgccactatgcccggctaattttttttgtatttttagtagagatggggtttcactgtattagccaggatggtcttgatctcctgacctcgtgatccgcccgcctcggcctcccaaagtgctgggattacaggtgtgagccacctgcctggccagttaagttcttgttagtacagatagacccattatcttttctatttttggtgttctcccacaaaactgtcgaagaagccaagtttttttttaactttactgtttaaacatgtgaatcaacttattttttctttatcagcatcattttcttgtcttcctctaaaaaaaatttttttaaacaagctgatctgccttccaaaagtttccaagtaattaaacccaattaaaaccattaaattctttcttttaatgacaactttattattaaaagctaaccacaaggaggagatttaactggcaaagctctctgttgtgtgttaatccattcctgacctctggctgacacttccaagagataaaccccacagaatagggagctggtttaatgaacagctttaattaatacttttcttccttgtggcagagtaattatttgttcaacttgtaaacagctccttggcggtgattttttaaagacccagttggcttggatagtgtgatggttttgatgtgttttgtgtgtttgtgtgtgtttttttttctttaaaagagagaggggaggagatctccattccaggattggtgctgaagcacatgtgtcctgaagttcaggacgtcagggtaattgacacagaagaaaagtgaggcgaaggcaggcagcaagctgcctgtatttttgagacatctccagagagggcaggtctgcagacgggcaggtctgcactttgcagcaacagtctgcaagcccagacaaggcccccaaggagacacaagcccagcccaaatgcagtctgagtgttaagaaaggaaagggcctgggattgcaaagcgcgaggccaaacgcctcccccgaccttcccttcgcgtggcacctgagaaaggggcagcccagtgcaaatgctaggtgtgaccaaccaggccccggagaagcgattctgtgaacaaggatgactagcccgctagtagtgcttgccgcaagccgcccatgcatcccaagtgctttccacccatcacctccctaacctgtctcagggaggtagatgccgtgggttttcgtgaggttaagtggcctgtcccaagtcacgtaccttctagcaataagggcagagcgcagattgcagccagctgtctggctgcaggagtcagtcctaactactgggcagagctgccccttgagacaagaaagtggcacctcccactcagctggcggggagagacttaggtttgttttttttcatttagttcatctcttagttagaaagctggtttcattaacaagttagaaagttagtttcattgcccactctgtaattccaaagttaatttactaacactaaggaccaagctttttcattattttaaaaatcatttagaggagtgattctcaactaggggtgatcttgtccctcagaggacatttggtgacgtctggagacatttttgactgtcacaactgggtaggcgtgctactgaatttagtgggtagaggccacggatgctgctcaaattcctacaacccacaggatggaactacaacgtggaattatctggctcaaaatgccaacagtgccaaagcggaaaaaccctgatttgtagaatcctcaaatgtttcattcttatataattactcagacttttcattcttgtagaatgctcaaatgctcactctagaagcaatttgtaaacacacaaaagcaatattaatgcacccatcagtccccaccccaccccctcaaaattaggctgaatctcttataaaaaaaaaaagttaattaattaacttagtgaatttgttaaccaggccaccagaaattcttcagaaacacatctaaagtgccactaactgttctcaactgaacagttagttacggatgaaattgttagtacaagaatatttgaagacagtccccaaattcccaaacatctacctctacttattatgcaagtttccttaagaaaatgcttatgtggccaagctcggtggctcatgcttgtaatcccagcactttggaaggccgaggcgagaggatcacctgaggtcaggagttcgagaccagcctggccaacatggtgaaatcccatctctactaaaaataccaaaattagccagctgtagtggcacacacctgtaatcccagctactcaggaggctgaggcaggagaatcacttgaacccgggaagcagaggttacagtgagccaagataacaaaaaagaaaagaaaatatgtatgaagagcacaaagcagattaactaatttcaccctctgagcctccttgggctgagggatgtgttcagagatctctgatgcctctttggggctcccaagactctcctccccaagggctcagagctgtgtctgaagctggaaagataagcagacagtcctggagggcttaatcctgggactgggttgagtccaatgcttaagatgtcagaattcaagcttcttagagcaagggccgtaggcttcgtgtttctatctggaaggactgaccgtggcatcccacctgcaagacccttgacaagagcgaaacagacagctagcgttgctgacagaccaagacattattcagagagtgttgctgttttctgaaaattatctttggatatgttgcatttgataagattaatggatctaaagaggccctaaagttaatcttttcacaaacacacctgtttttgactcctagggtgacatcctagaaagacatgggctacaagtaagtgaggggaaaggctgggagcagagagagatggttctgagcccttcgggggcagctaaaatgagctgatttccaatcgcggccaaggtgtctggttcccgcagagccattcccggcctttggcaggcagcaaatggcagctgacaaggaagggattttccagttagctttgccttttcatatcaagtccaggaaattaaagacacacatactccacagcaataaggggagacggtttcccaccctgtgggctctccttttgtcccctccaaagaccagcattgcagttatcagagaggaaagccagcctgagacctgagaaaagaatcagggctgatttttaggtggcagctgcctgccgtttctcctcactttggaagtgtaattgtcattaaacatgttgtttgtttcattaaaagtagacatcaacagttacaaatcaggcatttacgaaaaaaaaaaaaatctggtggttatctgccctaagcttttttttcctaataaatcatttcattttatgttactagttcccatgaagatatatttatgagtaaaatggttaagattttggattcttgagttagacagtcctagatttgaatcccagctctgccacttattggcagcgtgaccttggacaagtcacttcatcagtctgagttttgatttatctgtaaaacagggaaaagatattttgaggaggaaatgggataatgtacacaaagttcacacatattcatatattcatttaaaataaaaaaatggccaggcacggtggctcatgcccataatcccagcattttgggaggccgaggtgggtggatcacttgaggccagaagtttgagacaagcctggccaacatggtgaaaccctgtcttcattaaaaaatacaaaaattagccgagcatggtggcatgtgcccatagtcccagctactcaggaggctgaggcaggagaatcacctgaacccaggaggcggaggttgcagtgagccaagatcatgccactgcactccagcctgggtaacacagcaagactcttgtctcaaaaaaagaaaataaattaaccaagcatctgccattcaagctctgatctaggtatgagggacacagtaatagctcccatggagtttgcctcctacttagaggagaagcacaaaaaattataaataaataaataagagcatttcagtcaatgataaatgctgtttaaaactgcaacagagtaatgggatgtggagtgagtggggaggagtatgttagtttatttcatagggaatggtcagagaagacctttctggcattgaaagtgggaatggaatgttacaaaggatccagccctgaaagagcctgggaagaggggatttcaggctgaggaacagcatgtgcaaaggccctgaggcaggagcaagtttggcagattcaaggcagagtggaagagtaggtggttactagagcacatgaggccactagaagacggtggctttactcagagggccaggggaagccagtgggttttaagtgaaaagcacagctctgatagttgttttaaaaagagcactctggctgctgtgtggacaacagacatgggggacaagggaggctagctgcctttatagtggcccagcacacagaggggctccttgtcttcctccctcaccgcccccctctcttggtgatggactgaaggtgccttggaaataagataaatgacaacatgcaaataaagtgctgagcgcaggagcaggtgcatagtagaccatccaaccagcaaagctctgataagaattattattttggggaactatctcttaatcccttgctccttggaaaacctggaagaaatcaggcaattggggtataaggaccaggtgaagtgctagagccctcaggtcaggggagcagttgtgccccccaccccagtcacatgcatgtccccctccaacccccaccacggatcagatcaaatgaggatggctagcatcagggtctgagtcactgccttagctgccagtttttcctaaagcagatttcaaccttgaaataaatctcttaaaatgccttttttatgatcccaaaatgaaaaccccaaataatatagctgaccactcactactttaaaaaaaatgaatgtagtatcctaactgtaacttaacggaaagaaataaaagaaggtttattttctttttttttttttttttttttgagacagagtcttgctctgtagcccaggtgggagtgcagtggcacaatctcggctcactgcaagctccgcctcccaggttcacgccattctcctgcctcagcctcccgagtagctgggactacaggcgcccgccatcacgccccgctaatttttttgtatttttagtagaggcagggtttcaccatgtcagccaggatggtctcgatctcctgacctcgtgatccacccgcctcggcctcccaaagtgctgggattacaagcgtgagccaccgcgcccggccgagaaggtttattttctaaaaatatgtatttcagtatgtaaatgctcaaacatgaccgcaatagaagacatgacaaaggagtctgatactaccacccacttctcatttaaaaggttgcatttcagagaactaggaagatctggggctcttctctactagaagtaaaggaaaatggaagaacagagatgggatggaccatgggatacaaacaagtatattcagtatttatcaaaaccatgcaaagcccgggcgaggtggctcatgcctataatcccaacactttgggaggccaaggtaggcagatcacctgaggtcaggagttcaagaccagcctggccaacatggtgaaaccccatctctactaaaaatacaagaattagccagtgtagtggcgggtgcctgtaatcccagctactcagggggctgaggcaggagaatcacttgagcccaggaggtggaggttgcagtgagctgagactgcgccattgcactccagcctgggctacaagagcgaaactccatctcaagaaaaaaaaaatcaaaaatactctatgtttacttctataaaggagttagattctaggctcagatcattagaaacaggtttttcacaacgtgagtgttcatcaggagatatgaaagtcacatgggttgtgggacaatttttctttctgtacaacttcctacagtgcattagaagacattaatatccttggcacccccaaataccactatccctctcaactattacaacgaacaaaatgcttcccccacaaatttccaaaccactgtctaggcggaggtgccacacctgccgagaaccactgccctaaaacagattcatggatgatatactcaaaataaccgcatttggcaattttataattgcatgctgtggtgggcagacaaatggcaccccaaagacgtccacatcctagtccccagaatctgtggctgttaaccttctatggccaaagggactttgcagctgtgattatgtgtccctaatgtaatcagaagggtttttataaaagggagggtggtcaaagtgggcggtaggagatgtgaggccagaagcaagatattggagtgacatgaggaaggggccatgagcccaggaatgcaggtggcctctagcagctaacacaagcaaggaaacagtcttctcctctgaagccttcaaaggaacgcagccctgcagacacctctcatctctagaactattagagaataagtgtacattgtttaaagccactaagtttgtgctaatgtgttatggcagccacgggaaactatattacatgtgtttatattcatggtgacttcccatttatggtgactacaccaggttttctatttatgatcatgataacaagtttctttctaaactaaaatgcacttagattttgtttttgtctttgaaacagggtctcactctgttgcccaggctggagtgcagtagcgcaatcatagttcactgtcacctcaacctcccaggcttgagcaatcctcctgctaggactgtaggcacacaccaccacgcccagctaattttttaattttttgtagagatgaagtcttactatgttgtccaagctggtcttcagttcctgggctcaagcgatcctcctgcctcagcctcccaaagcactagattatgagcgtgagccaccatgcccccagcgaggtgttttagaaggagggagtagccaaattaaaggaaaatattaagttaataataacacagctactctgtagcttggcagaacttgcaaaggtgttccaagaatggccctagtttggaaaataacaggttaaactatcgcatgggaatttctcagcgggagaagtcttctgttggaagcttctgaatgctgctgctttttgttagtaatacctaggcaccaggtgttttgcaagacacaccacacacaaatcctcaggagccctggaaaggactcactgcttatgttcagctgaagaaactgaggcccagggagagtgaacatctccttcaaggtgatgtacctggggaatggcagtcccaggatttgaacctgggtcctgccaactccatgggtgatgctctcaaccactttgcttcatggagattcttgtctatggccacattcatggataccttgtgaatgatggaggcaatttgtggtggccatttgggtgagtcccttgccccattaggcaatgcttgtataagggagaggttactcttttcagactacataataacccaggcccttccatggacttggcttaaatcaccttggggtgggggtagcaagaggtgccatcagaagagaagacagtctttccaaagtgcttcctggcaaagctcgaccattgctaagatgtaaagaaacacttgggcttgctcagcaggccttgtctatgccgcaaacacccgtttttgcttggaattggcacgttgcatgctgagttaagaatcttttgattataagcgacagaaattcaatgcacatcagcttaggccaaaaaggagaatttgttcatgtcaccaagatgtccaaacgtagacctaaagcaaggtgggatccagctccctaaatattttcatatgaatctgtgtgcactgtcaggaaggctctgcctgtagggtgacagagatggctgccggcatccttgagcctagatctaccagctcagccaccccaggaaaaaaaggtgcctctcccaggagtcatagctaaagtcctcaggccaatgcccattggctcataatcatccttgaatcaatcactatgattctagccagggatgggttatgagatcaccctgaaagacccataatgggtgttatttttactaaaaattattaactgctaatttacggatgtgactgctcattctcagagagattgggtatctccacaatagcatgctgcctcctttgctaaccggttgttttttgaaggtgtctaataaagacactgtgttgggaatccccaagaccaccttcggcctcaatgattgactagaactcacaaggctcagagaagctgttagactcacagttacagttattacagtaaaaggacacagattaaaatctgcaaggggaagaggcacatggggtgaaatccaggaaagaccaggcacaatcttccgggagtcctctcccaggggagcacggacactccacctaattctcccagcaacaatgtgtgcgaacacatgccaagtgttgccaaccagggaagcccacttgagccttgatgtccagggtcttattgggggtcagtgacataggcatgcgacacctaagtaactgacctcagccactcagacaccagcaccccagagcaaaaatagacattcaccataaactacattcttagcctaaactatctcaagtggaagtgcatggtgtggcccaagggcttggagctcatgcaccaggaactggccaagggccagccctgaagacagacatttcttaaggaatgtgcagggtttgagcaacccaggcctgctgagttaaccctttcctgcacagccagcctctaaatctttatagcagaccccaaatgaaatcagctaaatggctcttcccaagtaaagaccaccagatagcgtagatgtctggtgcacttggagattccacagaggggacagcacatcccttctgcccagtcatgcagctgagccatggaaggcagacgctccctcagagcaaaaaagccatgacaggggtggtggcctaaccagaggattatggagtctggagtcagattagacctgagttcagtgccaacactttctcttacaagctaagcaacattgaacaagctacacagtaataatagtaacagtaatagcaatataaacagtagctattattaagctaacatttattcagaccttgctatgttccaggcatggttttaagcacttaaacagtcattaatttattgtttttaattttttttacatggtcacagtaagaaatacattttacactataacccaccacatacacacacacacacaaacacacacacaccccaactggaataggtgttcaccattgctgtgtatgatagattctgatagttcgttgtctattgtaggaattaacaaacttttcctataaagggataataaatattttaggatttcagctaggtcctgtggtgactactcaactatgccattgtaccatgaaaacagccataaataaacattaagtgatcaaatgggcactgctaggttccaacaaaactttatttacaaaaacagacaacgggccgggtgcagtggctcacgcctgtaatcccagcactttgggaggctgaggcgggcggatcatgaggtcaggagatcaagaccatcctggctaacgtggtgaaaccccgtctctactaaaaatacaaaaaattagccgggcgtggtggcgggcacctgtagtcccagctacttgggaggctgaggcacaagaatggcgtgaacccaggaggcggagcttgcagtgagccgagatcacgccactgtactccagcctgggcgacagagcgagactccatatcaaaaaaaaaaaaaaaaaaaaaaacagacaacaggccatagttccatagtttgctgactcctgggttctattatatttcttccagtcttttttttaatgctgttcattaaactttcactaaaaggattataacctgcacttttacaaaaacgtatttaatctttacaacaatcctatcaggtatataagcccattttacagatgagaaactgagacacactgaagttaagtaacttgtaagaagtggaactggccttgatcagaggtagtctggcttagagcccaccttcttcacctgtacaacaaagcactcactagagattggccattatcattatcaacattattattaattattattattattattattcagccaggagttaagttatgaaggaactcatatttgaattatgaaggaactcaaaatcccacagtcacataaaccagtttcaggatgaaatcggcatgccttccttttgttcaaagggttgtacagctaattagtatgtaaatctcacttctttgaattgaacacattttagagtcatctattacaaaagtgctgcatgcttgaaacagaaagcttgcaaaatctgtaatctcagcactttgtgaggctgaggcaggaggatcacttgaggccaagaattcaataccagcctgggcaacataaggagaccctgtctctacaaaaaaaaaaaaaaaaaaaaaaacaaacaaacaaacaaaaaactaattaattaattaattagctaggtatggtggtgcaagcctataatcctagctactcaggaggctgaggtgtgaggatcaagaagatcaaggctgcagtgagctatggtcatgccactgcactccagcctgggtgacataggtagtagacctgtctcaaaaaagaaaagaaagaaacagaaaacttggaaaatccaggaaaaaaagtctttaatggatagagttctgattcattaaaacaattttttggtaaaaatctatatgtgttattttgaaatgagaacagttacctcctaatctatgtggactgggaagtagacttacaatacggcataaattggagagctgataaatttgaggatggtagagacacttgatagaaaacaactgtttagtcttaattaactatgaataactttggcattcacgttttgaaactcattcatgtttgctttacatcagattaattttattttaagaaagatttttgtatactcttatcctctccctttcatccaagaaatacaaccatacatcccaagatagtgatccacgaggcagatctttgggccgcctacgtggtgaaaggccccaccaacctcctataattcagagaactttgcctgtaattccagcactttgggaggctgaggcaagaggatcacttgaaccaaggagtttgagattaccctgggccacatagcaagaccctgtctctacacaaaataaaatataagccaggtgtgctagcacacgtctctagtcctagctacttgggaggctgaggcaggaggactgtttgagtccaggagttcaaggctgcattgagctatggtcacaccactgcaccccagcctgggtgacaggggagaccctgtctcaaaaaaaaaaaaaaaagaacttcatcaagaatgcataatagttatattactgagctgccatccaggtccatagcctctctcctgaagggcagttccaactcgaaacctcttcaccagcctcccacacaagtatgcagagcccaccacaccatcataaaaactgaacccggagaaatctgtagaacattagggcacgctaagaaaatctacagcgtctttgtctgatccgtaccttcgcctcaagagaaccacccacaagttctctagtcaaacaaagatgacattccatccacccccaccccttagcccccagcatggtccttcccaggatgagttacacattgaagcctgttttggaaaaactacctcctctcagttcattctggtttaaattgattttttttaaagtaatccacttatgctgttgcttgtttaggaaattaaccactgttgttttttgttttttaatccaaagaatatgtaatgcttcagaaaatgggtttcatgtaagtggcatgttaaaagcttttgtaccaactgatgtggggtcttcctgctgggttcgcagaaacgattctttgcttaaaggctcaaggaaggggactgggggattttgacaataaccaatgcttgtggagtgcctgctgcagtccaggcctgggctaggtgcttccacacgtgctgtctgatttaatcctcactgcaatgttaggtcttagagggatcaggctggacttgaaggggtcagtggcccgaaagagcatggtgtgaaagctgtctattttaggctttatttgactgggagaagttctgggtcagacagagggttgcctccaagctgtcctctgtgactaaagtcaagacaccaggatggaatatttatggtttatagtagggctgcattcagcaggcagcccaggatgaaactgatggcttttgtcttgtcctcactccagatgtatttcacataaattaatactgagtcaccaccaaatttttttttcttttagtttcttgctctctgcaaccctggaaaaacatttcctacttggataaactatgcagccataaaaaatgatgggttcatgtcctttgtagggacatggatgaaattggaaatcatcattctcagtaaactatcgcaagaacaaaaaactaaacagcgcgtattctcactcataggtgggaattgaacaatgagaacacatggacacaggaaggggaacatcacactctggggactgttgtggggtgtggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaactaaaaattaaaaaaaaaaaagtgttctgacccagggcaacactgtgttacttgactcctgagttagccttgcttttctgaggctattccagacttttctgcctctgtgcaactagtttttatcgtgttttttgaacagaggtaccacctacatagcttaaaacaatcttaggaaaatctgaaataataagaatgctccaagagtaggtgggtattctaaaggctcatcatataaacatttgggtgtcttcaatctttagaaaaatgtttaattacatgataagtatttgaatcccttctcttttaaaaaattctagaaggctgggcatggtggctcacgcctgtaatcctagcactttgggaggccgaggtgggtggatcgcttgagctcaggagtttgagaccagcctgggcaacatggtgaaacccctgtctctacaaaaaaaaatacaaaaaaattagccaggcgtggtggtgcacacctgtagtcccaattacttgggggctgaggcaggaggatcacttgaacctgggaggtcgaggctgcagtgagccaagattgtgccactctactctgggtgacaaagtgagaccctgtctcaaaaaaaaaaaaaatctagaatattctagataatactgaagttcactttgaccatcacttttaattcctgttccttcctctctgccttctagaagtaactgcctttctttttgtgtacagcctttcagatatgtataaatatgtaagtgcacatggaaaatatagtaacattttatgtgtctctaataaacggtaataacatacagtacatagtacataatgcaatcagaaaactttttttcactccagtgtattttttgatgtgtccctgttaatacatggagatctggtgcatttccttccattgaaatttcatttcccattgtatgaatagaccacatttcatttttcaagtctgctttgaagtgatagctaaattattcccaatcttttgctatttactaacaattctgtaatgaacatcttcgatatgtccccttgctcatgtgtatgagattttctgtaggatagataatgaaaagtggaattactgagtatgttgcctgttatttttaaattgttaatccaagaaatatatgcctatagtttaatattcatagttctacaaaggaatatatatggaaaacagcagtcctcagtgactgcccaccacccttttttcctgcccaggggcaacaactcttgctgctgcctttaaaaatgtaacctccaaattatttttattttattttatttttttggtacggagtttcactcttgttgcccaggctggagtgcagtggcacaatctcggctcaccacaacctcctcctcctgggttcaagcaattctgcctcagcctcccgaatagctgggattacaggcatgcgccaccacacccggctaatttttgtacttttagtggagacggggtttctccatgttggtcaggctggtctcgaactcctgacctcaaatgatctacccgcctcggcctcccaaagcactggattacaggtgtgagccactgcacccagcctcactcccaaatttctaagtaacatccttaggtgctacttcttgattctttttttccccccattgtaggcatgatctctggcttcccaaaatatactaattgagctctcttttctcacccttgaccccaacacacacatgcaaactttctcttcatgtcttcccagtatcagtcaatcataacttgagctttaccaatatgcggtatttgccttcttacaactatataaatactcttcacagagaagtcatttggtatgcaataattacttttccttctctgtgtgctggcctgggaggtgacaactttcagaataaatcctttcagcaaacaagtctgggtggcagctccttcttgcttcttgtccagtacatggagggttggtaatcagtgattaggtgcacgaattgctccgtcaaagaggagtgtgtgattgtgcagaggtgaaatgctttggatatgagtaatgcaaaaccttttcccaggtcacacacgattccctcctaggccctgagaagtttgttttcctcatttgctcttcatttttcactgagtaccctgccccatcgacttccagccaggaccaagagtgctaagctttggctctcggggccttgatgaagtgttttgcctaatggctgtgttcctgggcctgattcttcacagttgtgtgtgtgaagctgagatcaccagctgcatttttttctttctttttttttaagggtcaaaaagggtttatgtccttaattatttatttttataatagaaataatatagcctccagtgaaaaatttaaacaggaaaaggactgtatggagcaaggggacaaggcccctgtcgctcctctcccaactcagcccctttgagtcctcagaagcagtgttgttccagaaccagattacctatgttctaatctcagcatttgttagcttgtatggccttgaacaagttgcctaacctttgtatgcctccattttctcatctataaaatgggtgttttagtccatttagtgttgctataatagagtacctgaggctggataatttataaagaaaaggggtttatttgacttatgattctggggatcggcaagttcaagattgggtagctgtacctggtgagggcctcaagctgcttccattcatggtggaaagtggaaggggagtcaacgtgtgcaaagatcacatggggagagaggaagtcaactcttttaacaactcacactcttggaaactaatctattcctgagagactgagaattcactgactctcatgggaaggcattaatctattcatgacccaaacacctcctactaggccttacctcccaacactgccacattggagatcaaatttcaacacgagttgtgacaggaacaaaccaaatccaaaccatagcaatggaaaaataatagtgttcacctcacagagtttggtggggattaaatgagttaatacttataaagtggcacagagaaagcacttcatagatattagccaggaatattagccaggaatattattaacagtgtgttttatatcctcctagactagtggttcttaaccttgactgcatattgaaatctagactagtggttcttaaccttgactgcatattgaaatcacctggggagctttaaacttcttggtgcctggaccctgctgtcagcaattctgattttattggtctggagagcagcctgggcatcaggatttttaaaggcttctcagagcatcacaatatgtatccaggggtggaaaccattgtgctgcatattttccatgtgtatcggttaggataggtaagggcatgctgcagtaacaaacatccccaaaatctcatctacttctcatttatgatacatgtccattgtggtcagctgtatctctgatccacatcatctttattctggaacccaagccaacagaatatgtgtgggcattggtgaacatagctgccttccaggctaacagaataaatatccagaatacttgcagccttgtgaagtgagaaaagagagtgcatggggaagtgtgcactggctcctaaaaacttctgatcaaaagtgaaacataacttttgcccacatatcactggccaaagcaagttgcatggtccaatttctaagtaacatgcgtatgtgctccttcttgtagcacatacaagaagtatgttttttcagttgtaggtatgatctcttgcttcccaaaatagaagaattgagctctcttttctcacccttgaccccatcacacatatgcaaacgttctcttcatgtcctcccaatattaatcaatcataacctgaattgaacagggagggtatgtgtcagcggctggatggtaaatattttaggctttgtgggacacacagtctactcacctctgactttgtagtacagtgtagacaatacactgattttctaaaaaaatgtaaaaaccattcttaactcattagtcatacaaaaacaagcagcaggccaggtatggcgtgggggctgcagcttgccaacccctgctacatgtcctccttttgcagggagaagcacctcagggagggaccccaaatatgggtgaacagcagtacagtctaccacactgtgtatacagaaaggaggcactttcattgcacaagtgtgcaaattcatacgttatgctgtgttgcagcttgcttttgttacttagtactgtatctcttgatgacagtttcatatcagtaactccagaatgacttcgtttgtataatggctgcctagttttccctcctatgaatgtaccatagtgcctttgtgtttgtgtgtttttatcattaaccctctattgttggataacagggatttttttaaatatcaagaggagggagtaaggcagtgtgcctagagagattgttggagagagagactcaacatcccaactctcccagtagtttatactgaaatcttccagacctccctgaaaacaaaaatgtgttgggggcaacccctgaaaacatgcatttgccaggaggccctgttttattacagccatatcatatctgtgataagtgtccttgcaacgctgaacactgttgcaatcccagggtcattttccaggagatttaaatactggaaagggtaaaaagaaatggtgaaaactggaagtgagatcccggaagctgtacaacatgattatcacaccggcctcacacagagactcattttaggccacgcgtgagccgagcagatgaggaaaaaccaaaactgcttttcggcagtggaatgggaccaaaagggtagctaagattcctcaggctccgcgtgcatgtgattttccccttctctgcctcgcaggacaccacgacgtccgtgcgcattggccttatgatggaagagatgatcttcaaccttgcagatacacatctgttcttcaatgacctggaggtttgtggttgctgatttcatttaatatttgccatgtttaatcacctgcatctagtttatgggaagaaggatgctgcctttcctttctttttctttttctttttttctcctttttcttttagaagcttgaaacttttgctaacaacccccaaaaaggcccaaaactgtggccggtgatggtttattggaaacacacttagctcaattatctccctagctttcctgtgcagttaacgggctcttctctgttccagtggtagtgtccactggcagttttactaatccaataatggctatgtagtttcttcctcctgaaatttgctatttaataagtttattaaggcaaattagtacagatcctcctgggtcagtaataattagcagtggcccagggtggaagcttttaaaaacaatttacattcccctgaaagcatgttttataaagagaaagagtgagagtgagcagagggaatatgcttatttaaagtatctgctcctgagcccgtaagcaagatccaagggagatagggaaaaaagcgggagagcagcttcaaaaataaattgaattcatttgtttatacccagcctatgtcagaaaggatttcgaatgggaaacatatttagaatagaactagtaacacaaaggcaagcggaagcaaagctatgtcatgaataagggtaagacattgcacaaaaaaaatccaggctcaggctaactattgcaatcaagttcagagtgtatcacttcctggtagccaaagtaaagagggaaatacaatgagttacttctctctaatgaaagagcaagcaactttctccaacgtgaagaaggggttttggctgataaaaggatcagtaaggaaatcttctggctttgtaaattatgttcaccttattggttcaacagattgaaaagtaaaggcaaccggccgggcgcggtggctcacgcctgtaatcccagcactttgggaggccgaggcgggtggatcacaaggtcaggagatcgagaccatcctggctaacatggcgaaaccccgtctctactaaaaatacaaaaattagccgggcatggtggcgggcacctttagtcccagctacgcaggaggctgaggcaggagagtagcgtgaacccggaaggcggaccttgcggtgagcagagatcgtgccactgcactccagcctggcaacagagcaagacaccatcaaaaaaaaaaaaaaagaaagaaaaagaaaggcaatctaaaataaaactgtatacaaaaaaacaattctatttctcttagtaggaatattttttcccggaatctggaatatccctggggactaaactgaagtagaaatataaaggttatggatttcaaatccatcctggctagcccaaggcactactaatatttatcattaggaaagcatacagatttttctttctagtctgcaggctggagttccagagagaggaatccttgctgaaataatcagtcttgtgttttgtctaatctatgtaagcctcttgggcctcagtcttcacatctataaaatggaattggtattctttgcccaacatctgtttcaaagagcagaactaggtagaaacttgaggaagaaagagagctttggagcaatggagaataaataccattggcttcaaggcttgggactgtctctattcaaaagcaaagttcaggctcgcttcacgatgacgtctatggctcgaaggacacaagagagaaaacaaacaaacaaaaactgtggccgttgaattcagtgagtatttatggagcctaatgcggtaaagactcagccgattgcaaagatcaaaacccaactcgttttaaccaaaagtggaaattattggcccttgtagttgaaaagtccagggttgttttcattcttgcttattgcccccacttctgtgagaacagggaccactctgtgtgattgaccctgaatctctagggcccaggcagtaaacaaccaaacaaatccataaacaagaccatttatgataataaaaaggatatgaagaaaataaaataatcagatgtgagaacaagtgatggggatggaggagggttggggggcagcattcttgagggggccggtccagggaaggcctcttaaggcagtagcacttgaaccaaaggatgacaagcacccattcagatggagatcgggggcagtggggcggggacagcaagtgcaaaggtcctgagtgagaacaagcatgaaggcccctgggatcagagagaaggcatggaggccgaagtgcaggagtaaaagtatggaggtggccaggatagatgagcctggggcaggagatattacagcaatcgaagctcattctaagtgccttggacatctctggggcaagctgatattaagaaggaaaagccacatggtctgggttgtgtgttaaaaagacctctctggctgctgtgtggagaatgggcagtcagaggagaaatgtggtctgggcatggtggctcacacctgtaatcccagcactttgggaggccaaggcgggtggatcacttgagatcaggagttcaagaccagcctggccaacatgatgaaaccctgtctctactaaaaatacaaaaatattagccaggtgtggtggcgggtgcctgtaatcccagctactcaggaagctgaggcaggagaatcacttgaacccaggaggcagaggttgcagtgagctgagatcaagccactgtattccagcctgggcgacagattgaaactccatcttaaaaaaaaaaaaagtaaaaaagaaaagaaatgtggaggcagagagaccagccaagaggctactgcaatagtccaagcaagagaagaaaatggactggatccaggtggtaggaagacgtggacttgagggtgaggtgaagccaagaggacttgctgatagactagatgtggaggttgggggagagagaggtggcaaggactcctgggcttgatctgaccaggatgtgttgtccttcactgagatgggcaaaacagaagaggtgtttggtatgcagtggaggatcccatccccctgtctggggtacgtggggtttgagatgtctgagacaccctggtgaagatgccagatcaggcagcagatagatgagtttgaacctccactgcagtaacaacaccaggcatggaataggcgccttgtggatcttggttgaacctgcgactcaaagccaggtattttgtgggatttctgtgtatttcaagctgatgtcttcagagtcttgccccactctgctgtttctgtctggcccctgaagtcgaagttgcacctctggaaggaggatcttaattaccagctggagctacttagggaagccagtttgtttttattttctaaatttatttcgaaaatgtcccagtgccagaagccccccagggcacctcagcagaattgaaaccacgttatacgatgatgaagttaaaatccacacaagtgaaaacatattgtttgttggtgcaaggcagtccctgtcaaaatctaaagcacagccttctgcagctgcccagggaagctgtgtggaccagagagaggcgtgctcaaggcccggcaaagccagaagcctttgttctccgagcctgtagtagtaccacctgtaagggagttccttcccgcgtccagcagcgctttatgaagggcttaccatttgccaggccctaatggaatgctgtggattcagcagcaaaccaaacacagcaagacccgtgcccacaaggcattgaccttccagttcaggaggctgaccataaacaatggaatgcaaagtataatgtcagagcaaagtgctctgaagagagaccaagagagtcagggaggaggctctcaccagggcttttgttttgtggtttttacttgttatatccaggagaggctcctctgactttttttttttttttttttttgagacagtctcactctgttgtccaggctggaggtacgatcttgtcgcactgcaacctctgcctcctgggttcaagcgattctcctgcctcagcctcccaagtagttgagattacaggcacacgccaccatgtccagctaatttttgtatttttagtagaaacagggcttcaccttgttgggcacggtggtctcgaactcctgacctcaagtgatccaccctcctcaacccccaaaataccaaagtactgggattacaggtgtgagccaccgcacccaggctcttctgacttttgagcaaagacctgaaggaggtggaggaggaggccatgccgatatctgggtgaagagtgttccagatagaagcactgtgcaaaggccaaggtatgattagagttgatgggctccagaaactgggaggaaaccagcaagactgaagcagagggaacaggaagaattgtggtgggcaatgagggtgacgcctttgggccattgtaaggctttgggtaacagccaagggtgacaaaagccactggagggtttggaacaacatgatgtgactttggttcagaagctgcctctggctgcctggtggagaacagactccagaggacaaggattgaagcaggcatccgcattaaatcagcaacttccagactcccaggggaaagaatctgtggggtttaaagaatggtccaggattggcctggtgcggtggctcacgcctgtagtcctaacactttgggaggccgaggcgggtggatcacttgaggtcaggagttcaagaccagcctggccaacatggtgaaaccccgtctttactaaaaatacaaaaattagccaggtgtggtagcaggcgcctgtaatcccagctacccaggaggctggggcaggagaatcactggaacccaggaggcggaagctgcagtgagcagagatcgccccactgtactccagcctgggcgacagagcaagactctgtctcaaaaaaaaaaaaaaagaataaaaaaaaatggtccgggacacagaaggtgccacatgcagctgtatcttaggatattctgcacgcatgtcccaagttgaggacaaaagccttctaatcagttccatctgctgttgagtcctggatccaccatctcctaacctgggcaagtctctccatccctctgagcctcagtttgctcatctgttaaatgggtggaagaaaagcccccaccatctagggctgtaaggatggagctatgtgaaagcagtcagcacagagcctggcatacctgcccaatgtgggggcctttccaccagggggctacaggggctacatgtgtccctggggataggcaagtgggggttctatggtaccagggcaaattgtttaattgctacatatttattttactgtgaattagaaaactataactagcttgccgacccctgattttacaatcattttataaaagtataggcaacagaaatatgacaaagatgatgacagtcatgagcagaccaggcctgggtcccagccaactgctgcagcttgggcataaatatcgacactccctcccctgctccctgccactttgcctttgtgcaagagctgctgattttgcagctcttactttgcagggcaggtgaaccctcctctgaaatgtcacctgggtcatgggtaagggtggatgttgggttaaaattcaagcacctgctcaagatctgtcaaaactgtcctccagccccactctactgcactcactctgaaagctgttcatgggaagcccccaagccctacttcacagggatgtgccactgtcgagtcagagctggacctaggtctgcggcctctgtcccagccaagcagggaccccttaggttttgacttctgggctcggatgcagccaggaggagatactgttcagccctgccctgtgagaagaagagattggggaggcctggcagccgagactgtgctactgcactccagcctgggcgatagagggagactccatctccaaaaaacaaaaaaaaaaaacaagtattatttatgttttgagatgtcacaactttaatttaaaatacatttaaaacctagatttatgttgaatggctgaaattttataggcagtgtgattaaagatgattccaaatttcagcaaggggacatttagttcgggcatgaaaaagaagttaacaagcaaaggtacctataaacaaaggcatcataaatagatataaagccagaagaaaagggatctaaagtagacagagaagataggctgactctccagttgcagattttcattatcagctcatcacaccaccgaaactctctggtgatttgctatccacatccatggcgtttggtggccctaaagattgtaacggcccccatcctcttggttaaaatggcaggtgtgttgacaagaactgtcttaggtaccccctgcctgctgggcatcacattcttcttggtatatattaaaagaacacaagtttgggccaggcacgatggctcatgcctgtaatcccagcactttgggaggctgagacagtggatcatttgcggtcaggagttcaagaccagcctcgccaacatggcaaaaccccatctctactaaaaatacaaaaaaaaaaaaaaaaaaaaaaattagccaagcagggtggcgtgcacctgtaatctcagttacttgggaggctgaggcagcagaaaccaggaggcggaggttgcagtgagccgagatcacaccactgcagtccagactgggcaacagagcaagacttcatctcaaaataagtaaataaatacatacatacacacatacacacacgcaagatttgcaggcaagatgcagcaggactgaggagggggccttccttgctctcccttgccttagcaggcaatctgtcaatgtcagggtgtcctctggaagccaggaggtgtgcctgagtgaggtgctgtccctgaagaagatgtccaggggctggcatggtgagggcagtagtaagagggaggcaaagagtttggccccaggagggtggaattaatgcatctggccagggagtcaatggtcgcacagcagtggctgaggttggaggcacctggcgtcatcctgcctcacctgagtttctgctgcattctctggtcctggcccctgtccgcttctcttcactccccttgccattacctctgtggtctaagtcaccatcatctttctcttggacgtcatcacggccttctcactgtccccctgctgtctatgaattaggatacaagctcatcaaaataaagaggcttaagtacaacacagatctgtttctctctcatgaggaaatctgaaatgtgaacagtctagggccagaaaggcagctcttccatgccagaagcccaggcacagcggcttccttttcccccaccccccgaaagacagggtcttactctgtcacccaagctggagtgcagtggcatggtcatggctcactgcagcctcgacctcctgggctcaagccatcctcccacctcagcctcctgagtagctgggactataggcaggcgtcaccatgctccgctaatatttttattttctgtagagatggagtctcctatgctacccaggctggtctcaaattcgtagtctcaaggaatcctcctgccttgggctctcaaactgctgggattacaggcatgagccacctattccaggcacattccaggcagcagggaaaaggaggcagagacagagaagggcaccacccagcggttgcagttctctcttctgctcacaccccattggccttaacatagtcacttggccacaccttccaaggcaagggagcctgggaaatgtagtctttattctggacagtcacgtgccaataaaaactgctactaataaagggggaagtgaattgggtattgagggtcagctggcagtctcatcctgacacctttcctcggttttcatcacagtagccagagaggtgaaaaggaaagctgaacatgtcacctgcttaaaactcttcagtaggctgggcacagttgtttgcgcctgtaatcccagcactttggaaggtcgaagcaggtgtatcacttgaggtcaggagttcatgaccagcctggccaacatggcaaaagcctgtctctactaaaaatacaaaaactagcaggtcatcgtggtgggcacctgtaatcccagctactcggtaggctgaggcaggagaatcgcttgaaaccaggaggcagaggttgcagtgaggcaagatcacacctctgcactccagcctgggcaacagagcgagactccatctcaaaaaaaaaaagctcttcagtgagctattatggactgaccccacctgcctctccagactctttttctcctactcttttcatcatttgctccactccagatccaatggtctttttttaattccttgaacatccatgctccccactaccttaagattctgcccacgccatgccctctgtatggaacacgcttccccaccattctcccctcctcttgttctcaaggtccaaggcctcgccagttcctatgcacctcttaaatctctgaaccagttccatgtccttagggaagtcttacccgattcccctcaaaaggttagattctgccatcatatgctcccaggacgcctcatacttatgcggtacattttgtactctttgtaaccatttcataattatttaaagtaattgatgtgaattctgtgttccccaccagctgtgtattccaggagggcagagaacatgtccactgtgttcactgctataactggcacatagtaggtgatcagtaaatcgttgtttcttgacggttgatgatcttgccctacgaccccatccatggtaacaactgccttctggaatttctaactttcaggaaactgactttgtttatgtgcctttgactttattagaaattaagtaggttaacgtcgtccatacaaaacaggatgtatttctcttatctgcagaactctagaggttagcaatccagggacctcttctcgacgaagagctcagattcctgccagcacttaattctcacctcctattttacagacctcaatttccatttactgcattttcttctcctcaaatcctggtttctggttctgcaacctcagccgggtgcctggactctgacccattctcctcatttgctagatcctctagtctggcatgtttgccctggattattcctccacgctgtacacatacctcctaccacctgtattgtgaattaccagccctgctccttagcagtgtcatttgtgtgttgggaggacaggggagtgtacctttttttttttttttctcaaagagtgggcattctgaatgttctcattcacattagtgtcagtgtgtttaactagaccagcattcccacctgagggcagccccatcccttggatggataggggggcgcattagaaactaggggtggggccaggcatggtggctcacgccagtaatcccagcactttgggaggctgaggtggcagatcacttgaggtcagggcttcgagaccagcctggccaacatggtgaaaccccgtctctactaataatacaaaaattagatgggtgtggcagcgggtgcctgtaatcccagctactcaggaggctgaggcacgagaatcactcgaacccaggaggcaatggtcgcggtgagccgagatcgcgccactgcacttcagcctgggtgatggagcaagactcagtctcaaaaaaaaaaaaagaaagaaaagaaaaaaagaaactgggggtgggtgggaggcagagattgcattgagccaaaatcacaccacttcactccagcctgggtgacacagttgagactctgtctcaaaagaaaaaaaaaagaaagaaactgggggttggggtagttggttgtcacatgaagggaaagcactgtttgcttttagaggccgggccagcaataccactcaacccaatatgttggacagtcttgtacaaagtggaattgtcccacccaaatgcccaccacactgagtccctgagagatgtcagtcagctgagcagtatttatggatgccttgtgcacagcatgatccaggtttcatgtggtttgctcttaattaaaatacaaaacaaaacaaaacaaaaaaccactttgttaaatgtatggctttttcttactcgtgttttaggggaaaaatgaccagtacatcaaaccagtgatgtcataggtaatgatgcccaggatgaagcgtaggtttgtgaaagagcatcagtgtaaagataaatgaggaggccaagcgcagtggctcatgcctgtaatcctagcacttttggaggctgaggcgggaggatcacttgagcacaggagtttgagaccagcctgggcaacatgacaaaaccccatatcttcaaaaaatacaaaaaaaaacaaaacaaaattagccgggcatggtgatgagtgcctatagtcccagctacttgggaggctgaggtagaggatcaattgagcctgggaggttgaagctgcagtgagctagctgtgatcacaccattgcacttcagcctgggtgacagagcaagaatatctcagaaaaaaaaaagactgagaagttagtgaaagtggggactcctctatggctaaatccgtgaaggtgcgacatgaaggagcatggctgtatccgggtgagtgccatccactaagaggcctggcaccgtggaaggaatgggatactatttgggatcagaggacctaagttccaattctgaccttgattcttctgagctctaagaccttgaaggaggtatttaacttggctgactttccacttcttcgtctgaaccagatctcaataataactgacatttactgagcactcactacataccaggcactgttctagctggcttgtatgtttcactttatttaatcctattatgatccccattatactagtctgctcagtctgtcctaataaaataccatggagcgggtggcttacacgacagaaattttctttctcccagttctgcaggctggaagtccatgatccaggtgctggcaaagttggtttctggtgagggccctcttcttggcttgcagatggctgcatttttgctgtgtcttcacccggcctttcctcaatgcatgtacatggagagagagccagagagagaaaacagctgtctggtgtctcctctaacaaggacaccaatcccattgggttagggccccaccctgtgacctcacttaaacttaattacttccttagaggccctacctctaaatacagccacatagggaggttagattttcaacatatgaattttgggaggagacacaaacgttcagttcataacatccattttacaaatgaggaaactgaggcagagagtggctaagtgaacagcccaagtcacatagttggcagtggcaatattcagacccaggtggcctggctccagagaccctgcccttacccatggtgctgtgttgcccctgccagggacagtgatgtccgtctggtttgagaaaaaggattcccagtaagaatttaggagctcgtgcagtgccgcagacagtggactcaaaggaagaaaagaaagtgcaagggaggctggagtcactgagaagtgtggtggcggaaagccaagatctgacaccaggaggaggaggaagtcccaatgttcatggagaaaacaaatatttttcatctctttgggtttttctgattttgtttttgtttattttgttttgtgtgtgtgtgtgtgtgtgtgtgtgtgtgtgtgtgtgtgttttgagatggagcctcgctctgtctctcaggctggagtgcagtgctgcgatctcagctcactgcaaccttcacctccctggttcaagcaattctcatgcctcagcctcccgagtagttgggaccaccagctgatagctcctaaagccaccacacctggctaattcttgtatttttagtagagacagggtttcaccatgttggtcaggctggtctcaaactcccgacctcaagtgatccacccacttcagcctcccaaagtgctgggattacaggcgtgagccgccgcacctggccaagatttttcatgtctttgtaagatgaaaaatcgaattattagattcctctgctgtgagtttgcatagcaccttatgcaaagtaaaactcacacaaatagcaacaagcaaccacatgaacacgacagcatccttcactccccgctgaggggatgaatcgcctggaggtgatcaaagcaatgtgcaagggatctgaatgcaccttctagaaaagacatgttactcccacatgctgagtgcacatgtgggagtaacaagcacaatcccgatgggagctagtgtgtcctgcatgcgactgtgtgcctggcagtgactgaagggcttgtctgtacccattcattaacccttacaacaaccacagagggcaggtactgttatgtatccccatgttagagatggggaaactgaggcacagagcggttcacttgtgcgacagctgacgcatatcaagctcttcttttgcaccaggcattgcgcatgaaccatctcaccgcatcctcacagcagccctgcaaaggagatggttttttcaatctccattttacagatgaggaaactgaggcccagaaagatccctttcccagggtcacacagctagtaagaagaatgtggagatttgatcccaggccaaatgacttctctgctaatgtctatctttcatggagaatagagtttgagatgaactaggaagtggagaacatgcatcaactgaatggatggaagaaaagagtctttcagggggccagccatggtggctcatgcctgtaatcccagcactttgggagaccaaggtgggcaggtcacttgaggtcaggagttcaagaccagcccagccaatgtggcgaaatcccgtctctacttaaatatatatatatatacatacacacacacacacacatatatatacatacacacacacacacatatatatacatacacacacacacacacacacacacacacacacacacacatatatatatatatatatatatatatatatatatatatatatatatatatatatatattagccgggcatggtggtgcatgcctgtagtcccagctactcgggaggctaaggcaggagaattgcctgagcccgggagacagaggttgcagtgagccaagatagcaccactgcactccagcctgggcaacagagcaagactccatctcaaaaaataaaaaaataaggaaagagcctttcaggagaaacaaggtaacgctaaagatctttggcaaaaggtatccctagcctgacgcaggaatggccaggcattcgggcaggctggaaggggagcatttcaagatgcagccagggctttaggaaagaccatgccggagagactcagaagttgctgaaatcagggcagccatggctgcttgcctgacacatgagcctggttgctaaacgtgtgatttatcctgatagctttaggagccatcaggaaaataatatgtcactgtgttaacactgaactctctccaaagcatcctgcccaatggtcattaatacaattcaggccacagcctctttagcgctcttaagataagttaaacacttagcacaagagatgtggcccaggtttccctcccagggagtagactcctctctggctagtctggaggcagcattaagcaatctcacttgaaaaatatacctgcctcagaggagaaggagcagccaggaagttcatcggggccctgatgagcatcatttttctaacgcaaatttgtcaacaatttctgcattcatgtctccaagcagccaaagacaaaaagtaatggaatcaaaccacagcaggagagtttgagaaaccccagctgtcaccagctcaatcagaacaggttttgataagtatttgtcactgagtttactgatcagcaacgtgcaacaacagtaatactaagtatcggctggggatggtggctcatgcctgtaattccagcattttgggaagctgaggagggcagatcacttgaggtcaggagttcgagaccagactggccaagatggtgaaacctcatctctactaaaaatacaaaaattagccaggcatagtggtgcacgctgtagtcccagctactcaggaggctgaggcagaacaatcacttgaacccaggaggcggaggttgcagtgagccgagattgcacaactgcactccagccttggtgacagagcaagactccgtctcaaaaaaaaaaaaaaaaaaaaaaaaaaagagtactaagtatcatacctgtgggatgcagaagggcagtccagattggcatttacagtcctaaatgacatttgttagaaaaacaggaaaattcataagaataattggaaagaccgttaaaatagataaggctttagcaagcttaatcaaaggggaaaagagagagatcaataaacaacatccagaatgaaagggtggacattactaaaatccaggggaggttgtttcttttaattacaagaatgccaggcacactgttttaccaatgaatttgaaaatctaggtgagattgacacttttcaggaagacacaaattactgaaattagcccaagtggaaataaaaataaatacaacaaaccaaagatcatgaaaatttgttaaatcattaaagagaaagtgcgtttttggtgcccccaccaaaaaaggcaccaggtcccactggttttaaacaagagttccaacaaaacttcaaggaaaggataaatctcatccagcataaactacagagcaaagaaaaagatggaatgctctcccacacattttataagactaacatcaccctaaagctgacactggagttacagcgcatatgacaaatggacaaattgcggtcgtcgctgctgaagttggaaggcccctgcgatcccagcacctaccttcatccatgccctgtgactctttacagaagttttctgcagatcctgtctgagctttagtttccacactggtgaaaagaggggtctggactataattggtatcatttatttgacacctgccccttgcctcgtaacacacctgcaagcagatagaataaccatattttgtaattttttaaaaaacactgaagactgtctgggtgcagtggctcacgcctgtaatttcagcactttggaaggcccaggtgggtgggattacctgaggtcaggagtttgagaccagcctggtcaacatgatgaaaccccatctctactaaaaatacaaaaaattagccagatgtggtggcaggcatttgtaatgccggctacttgggagactgaggcaggagaatcgcttgaacccaggagatggaggttgcagtgagccgagatcaccccactgcactccagcctgggtgacaagagtgaaactctgtctcaaaaaaaaaaaaaggaaactgaagaccttgctgtgttacctgagcccaggaacgatgacacccttgtagcaatgaggatactcagataacagtttctaataccacgctgcaagaaaaaggaaccagagctccatggagaaatggctgattctagggctgggccaagaactatatgattatcccagagcatcttttagcaccgtaaagtaaggaattgctcaggaaaacccaaagtgatacgttatgccagaggaacacaggatccaactgaaaagagttcccaatggccaaatccagaaagataaaaagaacaacaaaataaaacaaaagctggagtaataaaataaataatataatatcagatcccaatggccaaatctggaacaataaataaaaaggagagcaaaataaaataaaagctggaataataaaataaataatgtaatatcagattctaacccaaagtataaaataagtatgtatgagtctatgctgatgtagataaatgattgcataaataaataagtggggagactaaacaaatctcccacacagaaaaattccaggtaacttatgtagatactacacccatagtgtgagccacgcatagtgacttctttccaaagagtacaatatagatgaggggaatagtaacttcggagtggagaaccctgatgaagaccacctgagccaggtgatcaaggtcaacatcaacagtgattagtcatgttgataatatttacccttgatgtgatatgaagagaatggcactccccatctgtgaccttcccaaaacccaggaacccggtgtcatcatgagaaaaacatcggaaaaatcccagttgacaaacattttacaaaatacctgaccagttctccttcacaccgtcctcaaaagcaaggaaagcctgagaaactgtcacaaaccagagaagcctaaggagacaggacaactacgtgtcatgtgatatccaccttggatcctgaaacagtccaagaacagtacagggaaagccttaaaaatctgaataagtaattgacagtagttaacacagcactatctgcttattagttttgacaaatgcagcatactaatgtaagaagttaacaaaaggagaaagtgggtgtggggtgtatgggaactctctgtactatctttgcaacttttctgtaaatctaaaactattccaggccagccacggtggctcatgcctggaatcccagcactttgggaggccaaggtgggcggatcacttgtggtcaggagttcgagaccagtctggccaacatggtgaaaccctgtctctactaaaaatacaaaaattagccaggcatggtggcgcatgcctgtaatcccagctacttgggaggctgaggcaggagaatcactgacctgagaggcggaggctgcagtgagctgcaggaagccactgtgtgggcagtgtagtgaggagagggtaggagatgaggtcagggaggtgatgaacctgagggtgggcagaccacatggagccaggttccactgtgaggactgtgcttttatttggagggaggtgatatccattgtggggatttgagcaggagcgggacgtgatctgacttagggttgaacaggatccctctggctgctggctggagactaggctgggaggataggggctagataaggataggagcaggaagagtgaggaggtgactgtagtagcctacaccaggggtcaacaaacttctgtaaaggaccagagagtaaatatttttggctttgcacatcatagtggacctgtctcagctactcagttctcctgcagtagcacaaaagctgcagcagacaggatgtaattgcatgaacatagatgtgttctaataaaactttatttacacaaacaggcgacaggccagatttggcccctgggttatagcttactaacctctgatctaggtgggagatgatggtggtttggaccacggtggggcggggggcggtgcgggcagtggaggaggtgagaatggtcagattgtgggtatatgtcgaagggaaagccaacaggatttggtgatggatgggtggcaggatgtcagagagaggagacggggataactccaagacacatgcagtgcctaggccagtgttgggaacatagaaggtgatcagtgtgtacgcatcttgaatcagcaatttggtatttcatgcctctttgccttgtcttttccagtgacatgataggcactgtgagggcaagagccagatttcatccttgaagcctcccctctctttttttttttcaagcttaattcactttatttttcttgtataaaaaccctacgttgtagccacagctggagcctgagtcctctgcacagagactctgatggggtcttgacaaggtagtcagtgaattcctgacctgaattcctgaattctagggagacttggtgaatacagtctccttccagaggttgggggtcgggtagctgtaggtcttagagatagcatcaaaggtggccttggtgaagtttcccagggtggcagtgcagctgcggcgtagcagtcatagatacccgccatcagcagcagcttttgggcatggggactgagacgatgccagtgcccctgggtgcagggatgaagtgcaccagcacagagccacagtggcctgtcaccttacaagggacggtgtggggcttgccgatcttgctcccccagtagcctctgcacatggggacaatggagagctagcccaggatgatggccccgcggatggcgtggccacctccttggagcacttaacacccagaccgacataccattatagtcaccgatgacaataaatcccttgagcctggtgcgctggctggcgtgggtctgcttttgtactggcatgatcttcaaaacctcatccttgagagaagcccccaggaaaaagtcaatgatctcaaactctttgatggccaggaagaagagatagatctcctccaggaacttgatcttcatgtccttgaccaggtggcccagcttggggatagacgtccactccttgtccttggtcttgcctctgtgagctcctcggccttggcccgggccctgtccgcggctatgaccccagccccggatgcccctgctgaagcctccacggaagccaccgtggttccccatcccagggtccccagggcctccagccccccatcccccaaaaccggatgttttcttggagaagaaagaagcttcccctctcttgacccatcaatgtctgatgcggtgccgggcccatagtaggtgtttttatagtcttgggatagacagatcttctcgagcacaggctctgaaaggagatgggtccgggtgctggctcctcttcccctcgccttgggcacatctgagtttgcttgagctgccattacaaagtcccacagactgggtgccttaaacaagagaaacttactgtcccacagttcatgagacgagaagtccaagatcaaggttggttccttctgagggctgcaagggagaatcttttccttgcctttctcctagctcctggtggtctcggatgtcctctgactcgtagagaacatgtcacccggtctctgtcctcgtcatcacctggcattcttcgtcttctgtctctgtgtccaaataccccctttataaggacacagacatattggatgaaggcccacgctaaggtcctcatcttaatgtgatcatctgcaaagaccctatttccaaataaggtcacattcaacatcttgtaggggacacagttcaacccataacaggcatgttcctacactcctctctgcctcgttttctcctagtttcccactacatatatagaaagtgctggccatagtccctggcacattgaaagcttttaataaatactagtttctatccctagtccaatactagtttctgtccagtgatagagatttttgtctctatctcactgagatatttgtaattaatttttttcaaaagcagtacatacacacattatcctttttttttttttttttttgagacacagtctcgccctgtcacccaggctgaagtacagtggtgcgatcataactcactccagcctcgacctccccaggcttaggtgatcctcccacctcagcctcccaagtagctacaactgtaggtacatgtcgctacacctggctaatttttgtatttttggtagaaacagagtctcaccatgttgtccaggctggtctcaaactcttgggctcaggagatgcaccctctttggcctcccaaagtgttaggattataggtgtgagccaccacacctggccctcattttttttaatgaaagtatttcaataagctaaaaccttctttgatcaccagcccaatcccagtgactccccatatgaaactgctgcttccagccagatgtatgggcttccagatctttctttttccagttatgtacaatatatccatataaaaatctcatattttaatgggattttataaatatatacatggcatcatactgggtgtatcactcttttttttttttaaacagagtcttgctctgtcacccaggctggagtgcagtggcgccatctcagctcactgtaacctccacctcctgggctcaagcgatcctcctttctcagcctcccaagtagctgggattacaggtgtatgccaccatgcctggctaactttttgtatttttaatagagacagggtttcactatgttggccaggctggtctccaactcctgacctcaagctatctgcccaccttggcctcccaaagtgctgggattacagatgtaagccaccgcgcccagccggatgtatgattctttaacctgcgtttttcacactccaggatgtcttggaaccatttccatgtgctagcataaaaattcacctccttggcttgggacgtggctcacgcctgtaatccccgcactttgggagtccgaggcaggggggtcatctgaggtcgggagttcaagaccggcctgaccaagatggagaaaccccgtctctactaaaaatacaaaattagccaggcgtggtggtgcatgcctgtaatcccagctactcagaaggctgaggcaggagaattgcttgaacctgggaggaagaggttgcagtgagccgagactgcaccattacactccagcctgggcaacaagagcaaaacactgtctcaaaaaaaaaaaaaaaaaaaaaatccacctcctttttctgcactgctgggtaggattccactgaatggatataccacattttatttagctacgacctcatcaagggaactttaggtgttttccagtttctcaccaggatgatggacatttttacacaaggctctttgcaggtgttactctgggtcagaaagtaaaaatccctcgagacggggattgcaccaggtcccggtcctcagccccactgcacttcacctgtgtcaaggccacgggaacccttccaccgtctctgccagcagatgccattcagcacccaccccaagatactcatactttgacccggaagagaccagaagcaccctgcagttcgtgtggacaagtctcccctctgacttacagtcccctcaccctcgtacctaggagagggatggcagcgctgagggtcgtgggattctcttccctggaggctcccccatcctcgtggcctctgcgcggtccagctcccctccgagctggctcaaggggtaacttgatccaggtcagctggtggagtatgaggtagcgtctagctgagcgtcacggtattttattaagtccgaaatgtgatcgctactgttgtcacactttagcgcccccaacaatccccttacaaatgagaaaaacagagcctccccaaatgcctttcctctgacatcaaggaaagcgcatggaaccctgcccagaggcctgagcccgggtgaccccaggagtggctccagagcttgaggaaaggcctggggggcggagggggtgtttttccagtttcaggcaaagcagtgagctgggggctatctgctgtttcctctgcgcctgggtctgtaaagtcagcggttgccgtttaaatcccattttccttaacatgtcaggattgctcattctaggccatccatttatatggccatggctcagaggtctcagactcacatgcctagtggggtcaaggatccaggtaacgtaaactgaagcaagccccgtagagatggtgggaaactgtaaatggatgccctggctgaaggaggtagctgaaaatctggagagagaacaagaacaagaagagaaagggaagaggaggcagagagaaaagagagaggacatcccccaagtttacatattgcccattgcttcaaaaaaatttaaacatgcaatgagctaagtaggtatgtctccaggccagtttgcaggctcttccctaactgaacttatcaacacagtagacaagctgccggcctggctccctcacccctctagagcagcactgtccagtagagatttctgcgatgataaaatatctgcagcgttcactgcaataaccactggctacatgtagctcttgagcacttgaagtaggactaaagaactgaacctttaatgttatttaactttactgaatttcaatataactataactagccacaggcaactaattgctaccatattagacaacatggctctagattctttcaatgtggagggtatcatcgtgcttgactactgcaaaaaagatcactccttcttggggagagggggtagattatacctgagaccaccaagcattaatcagagtcctgggtaaatggaaagaaaggaaattcgaaatactgagcagtaaaagcttaggtgtaaccagatgtctgctggctcaagagtggtcactcagtgtccttccactcccccacttcccagtgagtttctcattcagggtcaccctttagcatccactgtgttcttggccatctgcttactcccatttgcccagagctgacccctaggaagccacctgggggaacttccctgctgccgttggtctccaggccttaagagcacaccactgtccaaacccagggtgctgcccgtgggtcacagaggtgcaaggtcctatgcagaggcgagaacggcagttgcactttgtcacctgccacaaagttgctgtgcctgggcccatgtgtgtcaaggactctggaaacaagcctcacctttcatcaaaaccctttctaatctgaggcccattcaaggggccggagagggaccagcagccgcactacccccttgccaacccctctctcagattccagcccagctccccacagggcaacccaggctgccccagatgccactgacccctctcttgcctccctaaacatcaccataacaacaagactaccttatgtatcttttaaaaattaatgaggaggcctgtaattctaccactttgggaggccacagcgggaggatcacttgagcccagaagttcaagaccagcctgggcaacatattgagaccctatctctatttttcaaaaaaagaaaaaaaatgaatgaggtaggggcttcccaccatccccctgcaaagcttatattctcaaagataaattcaagccttttggccaggcacggtggctcatgcctgcaatcttagcacttcgggaggccaagactagaggatctcttgaggccaggagtttgagaccagcctggccaacatagcaaaacctcatctctactcaaaatacaaaaattagctaggcatggtggcacacacctgtagtcccaactacttgagaggctgaggcttgagaatcacctaaacctgggaggtggtggcagtgaactgagattgtgccactgcactccagcttgggtgacagagcaagactgtcttaaaaaaaaaaaaaaaaaaaaaaaaaaaaaaaaaaaaaaaaaagctttttgcttgtccaattgtctaaaaagagatctgttcaaaatgttgcaaataccctttcttccaatttctctactcccatcaaggttccagagatgttacaaccaattttttctcagtagtcaagctcagagtcccacgtgcttctcctcctccagcagcctttgtaaggaggcagctgcctcgagaaatcaccttgcaactaaactgtgggaaaatgtgtaagatcttaacacagtggtagaaactaacatgtatgcagtagccactgtgcacccgacactgttctcggtgctctcatgcagcatctcgcttctcctcacctcatctggaggtgggttcagttatcaggtccatttatcagtcaggcctctggggttcatgagggtcatgcccctcactcaaggtcacacactgggaagcggttggatccaggatccaggcccaggcagtcagattccagagcctgcaccctgaaccagtaccgcaggggctggcacccccgcacattttttgccccatcaacatattatcatgtcactccgccagcatcatgaagtgcactcatgatatgtttgccccatcagcgtgtcacgagggcatttcatgatgcaggcggggttggcaggtgtgcatcgtgtaggctccacatgggacatggcatcccttatgactcttggctgcaaagtgccagaaacccagctccactcacttaatctgaaaagtgggtgtatttgttcgccagggctgctgtaacaaatttcccccagttactggcttcaaacaacacacacgtgtcctcttacagttctggaggtcaggctctgagaggagaatcggtttttttactttttttttttttttttttttttgagacagagtctcgctctgtcgcccaggctggagtgcagtggtgtgatctcagctcactgcagcctcctgcctcccaggttcaagctattctcgtgcctcagcctcccaagtagctgggaccacagatgtgcaccaccatgcccagctaattttttgtatttttagtagaggtggggtttctccatgttggccaggctggtctcgaactcctggcctcaagtgatccacccgcctcagcctcccaaaatgctgagattacaggtgtaagccaccacacctggccctttggttttttgtttgttttagtttttcttccagtggccacttgtgtatgttgactgtggtctcttcttccatcttcaaagcacatgactccagtcaccctctcctttctgtcatcagatcactgtctctcttacagggacccatgtgattccatttagggcccaccccgacagccaaggaaaaacttcccacctcaagatctctaactgaactaaagtcctgattgccatttaaagtaatagatttgcaggttccgagataagaatgtgcgcatctttgggggttcgttattcggcccagcacagtcagggatggctcagcttcagtcctgactggatccaggggatcagatcgcatgctcatggcatccccctctccagctcgcagccctgctttcctcagcagctcccggcttaatccaccattcaacagccccagggaagagacagcacctcttccaaaagtgccagccaacgtccccgggctggttcccattggcccaccttagaccacatgttcatccttgaagcaatcactgtggccagggggaccttgggtccctctgattggttttcattgtccccaccccgtagtcttttgtttttttgtttttttgttttttttttgagacagagtcttgctctgtcatgcaggctggagcacagtggcgcgatctcggctcactacaacctccacttgctgggttcaagcagttctcctgcttcagcctcccaagtagctgggattacaggcagctgccaccacgcccagctaatttgtgtattttagtagagacagggtttcatcatgttggccaggctggtctcaaactcctgacctcaaacaatccacccgcctgtctcccacagtgctaggattacaggcatgagccaccatgcccagcctccaccccatggtcttgtcccacagagagaggtgtttccccaaggaaactgagtgggaaacagcatggcattggagtttgttcaatggcaagccctggggatagtgcctggcacatagtaagcgctcagtaaatgatgatcacagatcatgaggcacagcaggtgtccctccaggagccaatacttgaagagcacagggtttactaagcagatgtaggcaggagagcatttcaagcagggggaacacctttagcgaggcagaggtgtccaccatatggccagggtgaccaaatgtctggccatacttgggaagctggggacctaggggagtcctggtttgaacctatccccctagtataataccatccccctttaatgcaaaactctctctgtttggagagtatctgtatggtcactttccttgcagtcaacctgctcatttataaggaaaccaaacagacaaagaggatgagattgaacccaaggacctctaaccttgagtgtccaaatccagactagaacccgagcctgatgactcccagtgcagtgctcatcccagccctcagcttatgaggccaacccttgaaggctacatcagattaaccaggcatgttctctctctctctctctctctgtcaaattttccataggattgtgaccagatccacgttgatgacgtctcatcagatgacaatggccaagatttaaggtgggaatttggggagtcaaaaatgcccattgattgactgattgattatcaagttatccttctactaggaagtggggtgggagaggagggctgcttataaggacaaggtgtgcctgcctccagccagaactgggacttttgcatctcagactcaaaaatcacaactagccgggtgtggtggctcatacttgtaatcccagcactttgggaggtcttagcaggaggatcacttgagctcaggagttcaaaaccagcctgagcaacatagtgagacccccatctctactataataaataaatgagtaaaaatttgtttaaaaaatcacaacctcacccctcaaccctacagtctcttgctcatcacctcaaatcactaaactctgctcatttattgctatttttttcctgcttactgaagtaatgcatgcataacagaaaaaattcaaacacttaacctgacctcacctcccaaactcaccaccattaagagtttagtatatattcttcaaagatctgctcaaaatgttgaaaataccctttctttcagcttctctcctccaatcaagggtccggagatgttataaccaattttttctcagtagtcaagctcagagtttcacgtgcttctcctcctccagcagtcttcgtaaggaggcagctgcctccaaatatttggttgtattcattagcatacatatatatatttttttctttttcttttttttgaggctgactttcactcttgtcacccaggctggagtgcaatggtgtgatctcagctcactgcaacctccacctcccaggctcaagcaattctcctgcctcagcctcctgagtagctgggattacagtcatgcaccaccacacccagctaatttttttgtttttttagtagaggcggggtttcaccatattggccaggctggtctcaaactcctaacctcaagtgatctacccacctcagcctcccagagtgctggggttacaggcgtgagccaccgcacccgaccagcatgcatatatttttaatataacaattgatacagccaatacttaagaaacacttctcaaatgaataagtggtgtgtctggtttctaggggaaaacactcccaggacatggcttccaggaatcaggtaacccattgcttaatatgagacaccttcaggccgggtgtggtggctcacgcctgtaatcccagcactttgggaggccaaggcgcaaggatcacctgaggtcaggagttcgagaccagcctggccaacacagtgaaaccccatctctactaaaaatacaaaaattagccgggcgtggtggcgggcgcctgtaatcccagctacttgggaggctgaggcaggagaattgcttgaacccaggaggcggaggttgcagcgagccgagatcgtgccactgcactccagcctggggtacagagcgagactccgtctcaaaaaaaaaaaaaaaagagagacagcttccagaggaatgtgggctggaatgttccaagcctgcccctgggaaaactttgtaaaaatggaaccatagttaatctgtgctcatccaaaattaccacaattcaacggctttaggctcatcagatatattattagaccaactaatgttttggttacgggatcagtcattgtaactttatttagtagctgcttccaaggtgtctctcccaacttactgcaaaaacaaaaatcaaaatttctgttcctgagccctgcaagtcttttcaaagcccggcacaatcggaagtgatcagccggcagatgcctgcttcattttaatcagccattcggaaaatcccttctgcaatcaggactggcaaggagcaaagctccagccccaccaggacttctcacctgatggagtaaataaaccccagatcaaggttaattggtcctttccatgaagtcatcgttgggaagcactcttcctttcaaggcagtgagcagcaccgttctgtttctatagtttcccctgtagctagctggcttggaattgagagcaacagtcctctgaaccctgtctcatgctgagctgtttggtacctcactttgagaattctcagcccaagggtgttttcttccttagagaccaaattctccacttattcattcaagaaatatttatggagtacctactatatgctaggtcccaaacatgaaatgcctcttgtttgtttttttgttttgttttgttttgttttgtttttttcagttagcagtaagaaccaaccttcagagatgcctcgttttgtgccatgttctattctaaatgcattacatgggataactcattgcatatccacagtaaccctaggagagagagatgcttttatcctcatcctcatttttcagctggggaatgtgaggcatagagagattgagcaattggcccaaactcacatggctggtcagcagggaaggcaggattcaaatccaggcagcctggctctgggacccaagctcttaacagatcctctgtccatcctggacactggttcctgccctccccaagggcctccatctcctaacatctagacatctccccatggtagcatctgagttaatggtgagcgttcactttttcaagaataaatctatggccgggcacagtggctcacgcctgtaatcccagcactttgggagcccaaggcgggtggatcacttgaggtccggagtgcaagaccagcctggccaacatggtgaaaccctgtctctactaaaaatacaaaaaattacctgggtgtggtggagggcacctgtaatcccagctacttgggagggggaggctgaggcaggagaatcacttgaacctgggaggcagaggttgcagtgagccgagatcatgcctttgcactccagcctgggcaacagagcaagactccatctcaaaataaattaaaaaaaataaaaaaaataaaaaaataaaaagtcaaaataagggacgaggcacggtggtgcatgcctataatcccagcactttgggaagccaaggtaggaggatcccttgagcccaggagttcaagaacagcccaggcaacatagagagactccatctctccaaaaaataaaaataagttagccaagtgtggtggcgcacacacgaggagcctgtgggcccagctcctcggaaggctgaggtaaaaggatcccttgagctgggaggttgaggctgccatgagctgtgatgacaccactgcactccaacctgggcaacagcgcaagaccctgtctcaaaaaaataaaaattaaaaaataaatgaaaggcaaatggatgtggatcaggtaagagcaaaagacaccacttttcttggggaagctaatgaaagctgtggtcctgctgccccccaaatgcacactcgcagcaccctgtgcatttcgaggggctcatggacacccaaaagcccacccgtgggtcccacagagcctgtggtctcccagggaagatgccctgcacccccctgcactaacactgtccctcccctcctctctccgcagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtggtgagtactgtgagccttgggcctccgaggaagggaaactcattgggatggatgctgtcagtgtccctgctgtgccaggcgccaggcagagaggttcacaagttcagtaccagcccacttaatgcaaccctgacgacacccttcggaatagagcactgggattttgtcaccttcactttgggggtgggaaagctgagggacggaggctgcatctggtccaagatccttcaggccacaaatggcgcggggtggacgtgggggcggaattctcttacccacagccagaggctctcacagtgtggtcctccaagtagcagcgacagcatcacctggggatgtgttgaaaatgcagattctctggccctacctcaggcctagcaaatctgaaactctgcgctggggcccagaatctgtgttttcacagccctggaatccccccttggattctggaattccagaatccccctggaatcgggaggacctgtgccttgagtctttgcatctcagattgttgtccgcagaccaaccacatcagcatcccccggagctggttagaagtgcagggtcaccagcaggcagagtctgcagtgacccaagattacaccactgcaccccagcctgggcaacaaagtgagaccccgtaaaaaaaaaaaaaaaaaaaaaaacgtgcagggtctcaggcctcatcctgggcaactgactcagaatctgctttaaaaaatttttttttatttttgagacaaggtcttgctatgctgcccaggctggtctcaaactacttctggcctcaagtgatcttcccacctcagcctcccaagtagctgggattagaggcatgcaccacctgcctggcccagaatctgcatttttgacaagcccgccaggtgactgtggaggcattaaagttgaagaagccctagaagtcactggttctcacacgtggctctcattggaaccacccagggagtttcagttgctggtggtcttggtatcactgcagcctggacatcaggagtcataaagatccctggggaattctaagtgcagccaaggagagacccgccccctggcttcaggtactaggaacatttgctcattgccccaaacaagaagtctgaaggcactgaaggcgaggctggctcagccgtagtctagagaattctggagttctctagaacagaggtttttaactaggggtggtactgcgccctcctcaggagacatctgggagtcttcctggttgccacagtgcctggaaccaaccactggcccataagggcagggtttgagtaggtggctaatagtgtctgcaatatacacattggccccaaaaacttctagggccccctccctccattcctagaaagaatagagtcccggttctcaaactggacagaacacacttccagtcgcagctctacaactttctagctatgtggccttaggcaacatacatacggtcatcttaatgagccttagtctttaaatctatgaaatggagaatacaaatacttctgcttccctggattattgagagatttattgttagtgcatacaaaaggcatgactccatgcctgatacacagcgggaactcaataaatggtggcatttgtcacgagttgctctcagttttgcttgggagcctcgggttcccctgcgtcttctactgtccctggagctttcccatccgttctttgggacagacttcccgtcgtgttcatggctgcggtgctaatgcagcccacgtgctaagcgcggtcctggcagtagctaatgtttaaggagcactcgctctgccagttttgccaccgttttcatggactagctccttcactcttcacagcatgcctgtaaggtaaatgtttttatcaacggtgttgcttgaaagcagaaactgagatgacggaggttaagtaacctgcccagcgtcacacagcccaggcagaagggccacagtggagtcccaggctgggtgactgcaccacctctgcccttcagggccacacttggtggcctctcagatgtgagtgtgttgattgcaggagtgaagcagcaagctctggtcaggtcccagcctttgtacccagccctgcacggagggaggaggggagcaggagggctgactcaggtgagacagggatggggttggccgccagagagcatctgttccccatccaggttaaggcccaggaaatgccagggctttgtcaggctgctctgctcacccatagctgaggggagagcacccaaggcgtcagccagtgaggagcccacagccagcggcatgccggtctccttccccaacccagctgttcctgcatcacagaactagccaggtgcatggccgtggcttccagcccagggatcaccacagatccccacgattccaagtgttttagaaggtacactcggaagaaaggcatctgcaaaatacagaatagagaaaatgcttagtaaatcaccatctaggaggcaggggttgaaatcaggggccttagcctgatgtcatccttccatctaccacttcccatgtagctctgagcaggttatttgacctccctgtgcctcagtttcctcctcgtgtgcaaaatggggccagtgatgctgcccagcatcattggtagatggctaatagtgtctgcaatatacacaatatacacaaggattcatgccaggatgttgtgaattcacacaggaaaggtgctcagaacggcatctgacacacataagctctcattaagtggcacttttgttatctggggaaggtgggaaggaggccaagcctggaggaaaacgccgaggaaacagcttgaagcacacttcccagcgtggagcaaagtaggggtggttgggcagccagctacacaagacagcacgttgggaagccctttgtcaactgaaaagtgctgagccttgtgagtttgtattgttactgagggttccagctaagggtctgtggggaaggtgcagagacagaggaaaaccagaggccgtgtgttctcctagagttgatagactaatgagaagatgggacatgtagcagtaagaagattcattcattcattcattcttccacgtgtccatcgtcaaaggcctaggttgtggattcagcagtgaacaaaagaaacaaggtccctgttttcaaagagtttatattcagtgagtggaggaaacagaccatcaacaagtgagcaaatcacttaaattctttttttttttttttttttttgagatggagtcttgctctgtcacccaggctggaatacagtggcatgatctcggctcactgcaacctctacctcccaggttcaagtgactctcctgcctcagcctcccgagtagctgggattacaggcacatgccaccatgcccggctaatttttgtatttttaatagagatgaggtttcaccatgttggccaggctggtcttgaactcctgagctcaggtgatccacccgtctcagcctcccaaagtactgggattacaggtatgagccaccatgcccggctttaaattcttaattcagtcatttcgaggatgatcacacctattgaagaaacagatatggcagagagcccagcgtgggcagtggtggccaggggatacttggaatagtagacccagagtccatctctcaggaagggctatttgaactcagtattctaaatattctagatgagattctaataatgataaccagatgcccagagctggggaatgaccaatacaagcaaagagtcaatcagttcagctacattcaactgcataagtaaaagaacaaccaaccaaaaaataacacaaaaaacaacaatggcttaaaccagatagaaatgtattttttttcttatatacaaaagctgtaggcattccaagctggccaagtactctacagtgttatgagcccaggatcccaggatccttctttctttttttttttttgagacagagtctcactctgccacctaggctggagtatagtggcacaatctcggctcactgcaacctccgcctcccgagttcaagcaattctcctgcctcagcctcccaagtagctgggaatacaggcgcctgccaccacacccggctaatttttgtatttttagtagagatagagacgggatttcaccacgttggccaggctgatctcgaactcctgacctcagatgatctgcccgcctcggcctccaaaagtgctgggattacaggcatgagccaccctgcctggccccttctatctttgtatttatttatttatttattgagactgggtctcactctgtttctcaggctggagtgcagtggcatgatctcggctcactgcaccctcgacctcctaggctcaagtgatcctcccacctcagccttcagaatagctgggaccacaggcacatgccaccatgcctggctaatttttaaattttttgtaaagatggggccttcctgtcttgcccaggctggtctcaaacccctggctcaagcgatcctcccacctcagcctcccaaagtgctggggttacaggcgtgggccacctcacccagccaaaatcaggattcttattactaatgagaagatccttttgtatttatatttttactaattacaagtgaaaaaaatggatagtggatggcaactaagtgtctaccacaaacagcaaatgaaaagtctctgagacaaaaagagtttgacacttttcagaaagataaagaaggccagcatagctgaatagctggagtgagggggcacgtggtccaggacaggatgagagagctggcggtgtccagatgacataaggcccagtttggacactgggctcttctatgtagagaagacgatgtctccatagcacaggcagcattttgtcctaattaattcattcttccttcaacaaatactgattgagcatcaagcacaggccagcccctgctacagaaactgctgctatgatggcgaacaagactgacttggtccctgccctctgccctagagtgaatagcctaatggccaaggcagatgccaaacacatcgtcacacagatacacttaaaattagagttgtgagaagtgctgtgaagaagagctacagtgtgttgggagaatataaactaaagggacctgacccagcctggagagatcaggttagaccttccagaacaaatgacatttaagatgaggccgtaaggcaggatgcagaggttcacacctgtaattccagcactttgggaggccaaggcaggattgcttgaggccaggagttcaagaccagtttgggcaacatagcaagaccccacctctatgaaaaatacaaaatttagccggacatggtggcaggcatctgtagttccagctactcaggaggctaaggtggaaggattgcaggattgcttgaacctgggagactgaggctgcagtgagccttgatcacaccactgcactccagcctgggtgacagagcaagatcttgtctcaaaaaaaaaaaaaaaagacaaggcccaaatgcagagtgtgaaggatttagccaggcaaaagcagaagatgagataaaagagtggtccatgttctgaaatgaggtgtgcaaaggtcctggggcaggagtccacttggtgtttcagggaacaaacgaggcctccaggctggaatggaaagacagcggcaggagatgaaactcagtagggacaggatcatgctgctgggggttttgaactttatcttaaagctactgaaggctgagagaatggcaggttgagaaatacccagggtagctctggaagccagctgcctgggtgccggacctgtgtccatttttgttcatatctgtgcattcagtgcctattacaatatcaagcacctagaaggcactcctgaattttttgttggatgcatggatggatgaatgtgggggtagataggtggatgggtggatgggtgggtgggtagatgggtggatgggtgggtgggtggatggatggatattgggtggatggatgggtagatacgtgggtaggtggatggatgggtggataggtgtctattattttctccctatggtgagcaagtcagtcaacatcacaaagcctgtttctttacctaaaaatatagaaataaaaatggtgtccacctctatggtcattgtgagaatgaaataaatcatgttaaaagcagagccctgcacataagcactcaaaaatgttcatcattttttatgttattattaattccctgtctccaccataacaatataagctctataatctgcatatttttgttcatatctgtacattcagtgcctattacaatatcaagtacttagaaggtactcctgaattttttgttggatgcatggatggatggatatggggtagatgggtggttgggtggataggtgggtgggtagatgggtggatgggtgtgtgggtggatgggtggatgggtgggtgggtagactgatgggtgggtgggtgtgtgggtagattgatgggtgggtgggtggatagatggatggttggatattgggtggatggatggatgggtggatggatggatattgggtggatggatgggtggataggtgggtgggtggatggatggatggatattgggcagatggatggatgggtggatggatggatattgggtggatggatgggtggataggtgggtaggtagatagatgggtggataggtgggtggatggatggatggatgaatggaagggtggatgggtggatgggtgaatcagtcagtggatggattaatctatcaatctgttgatctcaggataagattgagagaagccactggattgaagtttactttgggttgtcatctgattttaaccctcagggtacagtagctagattcctgttccctaccttcatcccccagatctttctaatacgatgactacatctttatttcctttgtccacagggttgataggcactcccaaaagggagacctggctacagctccgagctgagctggaagctctcacagacctctggctgacccactccctgaaggcactaaacctcatcaactcccggcaagtggcagccctcattttcctctgtgccactgaactttctcgcagtagacagtggtggctcctgcatgtccacacttgggagaattggactcctcaaactctcacttgtacactttccaaatattttttttttttgatatggagtctcactctgtcgcccaggctggagtgcagtagcgtgatctcggctcatcacaacctctccctcccaggttcaagcaattctccggcctcagcctcctgagtagctgggattgcaggtgtgcaccaccacacctagctaatttttgtatttagtagagatggggtttcaccatgttggccaggcttgtctcgaactcctgacctcaggtgatccacccgcctcggcctcccaaagtactgggattgcaggtgtgagccaccactcccagcccaaatatttaataaagcttaagtgcacaaggctcagtggataccttggagcatagctgagctaatagcggcagagacttttcagggcccaacaggtttccaggtttctggattctcccaaaagatgagaactggcatgcaggctccagcttactctattccccacctctccctcttgtcctacacttgttccatatcactcatttacattacccgcaactatttaagtgtatggcccttgcaataaacatttgctttttatataagaaaagtattccccccatactacatttcactatgtcaggcagcttcaggcttaaaagagaggaacagcctgagaatccttgggccctaacatacctgaagatgacagccatagcctccaagcctaccagatttcccgccaactgcaggctcatgcagcaagaggaggcctggccttgtggtccctctgagttctgatccacagtctcctttgtccttaggcccaactgtgtcaatgtgctggtcaccaccactcaactaattcctgccctggccaaagtcctgctatatggcctggggtctgtgtttcctattgagaacatctacagtgcaaccaagacaggtagggagaagccacacctcggcggggatacagggttggagggtggggttagctttccatcctgggaatggggtgtttaaggaacatgacaccacagaaatggatggagtgtgcctatggccatgactcagattcccaaaacagcccccatagaccacatgccttaacctctgcttctaaagaaattggttaggaccacagttttccaaagtgtctgtatgagttcagatacaggcaaagctgctgtaacaaacacaccccaaatgcaagggcttgcaaaagagtcaaagctgatttctccctagtagaacagacagaggtgagtgatccaggctggtggggtgaccctgtcctcagagacatccagaaacccaggtctctcccgttttatttttccaccatttcttatggttttattctcatgtatggggtcaaatcagagtcctagcccatcctcattctagcaggtctggtatttgaaggccaagctcagaaggctatgtacattacattctactcacttcctgttagccccagcttagtcacgtggccacaagtagctgccagggaagctgggaaatgtagtccatagctgagtgattcatactgtcactcaatctggaatgcagtggcgagatcatagctcactacagcctcaaactcccagcctcaagcaatccttccacctcagcccccaaagtactgggactacaggcatgagccaccgtgccaaaatatttttaattagaaaccttttccattgttttttctctagagcaaaaaataaaaaaaataaataatttatagtactttggcagcattttcttggagcaattttggttttactgaagttctacgtccaaacattatatgaaagtgccttttgattttaaaattatagtagtaggggccaaaatggttgttgaagatttttcaacaagatcctgtcttttcatttttcccatttttcctgcatacctcaagtacctttgcaggtttatttcgaatctcttttttaaataatatttttatttttaattgtggtaaaattaaataatgtaaaattttcaccatcttaaccttttttcttttttttaagatggagtttctctcttgttgcccaggctggagggcagtggtgcaatctcggctcactacaacctccgcctcctgggttcaagcagttctcctgcctcagcctcctgagtagcaaagactacaggcgtgcaccactacaccgagctaattttgtatttttagtagagacggggtttcaccttgttggccaggctagtcttgaactcctgacctcaggtgatccatctgcctcggcctcccaaaatgctgggattacaggcatgaaccaccgcacctggccatgcactatacgcttaaaaatggttaagatgggtcaggcgcggtggctcacgcctgtaatcccagcactttgggaggacgaggcaggtggactgcctgaagtcaggcagttcaagaccagcctgaccgacatagtgaaaactcatctgtactaaaaataaaaaaattagcagggcatggtggcgggtacctgtaatcccaggtacttggaaggctgaggtaggagagtcgcttgaacccaggaggcagaggttgcagtgagccgagaccaggccattgcactccagcctgggcaacaagaacgagactccgtctaaaaaaaaaaaaaaaaggttaagatggctgggtgcagtggctcacgcctgtaatcccagtactttgagacactgaggtgagcagatcacttgaggccaggagttcgagaccagcctggccaacatggtgaagccccatctctactaaaaaatacaaaaattagccaggtgtggtgatgcgtgcctacagtcccagttactcaggaggccgaggcaggagaatggcttgaacccagaaagtggaggtttcagtgagccgagatggcaccactgcactccagcctgggtgacagagcaagactgtgtctcgaaacaaaagtgtccagcgcagtggcatcaagtgcattcaaatggttgtgcatccattgccacttctacatcggacagctgcagagacttgggagcctgctctaacccctgcgctgcctcctcctgctgtgttgccctgggcaagctactgaccctcgctgtgtttccggctgtcatcatccttcatgtggggatgataacagggctcacctcagaagtttgctcaagaacgaaatgatgaataccgggcctttgggagcacagctgcaggcaccaagctcttaatgagcgggtattggctgcaatccggggtcctcacagagcgttttttctttccttcctgtgtgcgtgcagggaaggagagctgcttcgagaggataatgcagagattcggcagaaaagctgtctacgtggtgatcggtgatggtgtggaagaggagcaaggagcgaaaaaggtacttcttccacctctcagactgcgttttcctgctctttcgagcacccctcgtggtcttcaagggctccttccatgatttcctccactccccgtggctggctgggtcctccttcccaggctccttgcttgccagtccattccatttgcaaattgcagaagcatcctgagtaatttccttctacaaatccccctctctgcctctggctgctgcccctggtagccctggattgtttctgggacaactgttcgggagcctagagacgctccggcagggcaggctggtggggggccagtgcacgtgcatgtgttttatttaatacttactgatcatatgttccagcaacccttcccagttaataaagacagcattaagctaatgaaaaagaaaatcctgcatttgtgatctcgggcccgtgaggagagggcagggggttctggtggccacatctctgttcttggaaaagaaacagctgccaaagtcctgggtctggatctgtcaacagcgccccagagaggctgccacccccaacccggaggcctgggaagtggattgttaatgtcacagaccttaattagggggacctggtttcccccatctctgcctggcagcaaatcccaaggaaatgcaaaaatgttcagggtctcagcagatgaaacccagaagaagagggaagccctagggtcctgggagagggccccgggagagaggagcttggaaggctttgcaggcactgttccctccacctggaaggctcctcccctttcctgggagatgtagtctctattatccgccgccatgagccccgctaagaaatgggagctgcttctgagagagaaggggagaagtgatattgaggggcagctgccagggtcagtcgcactggtgtgtggccaggctgtggctggcatcttgagttgctgacctaaccccatgcccttcaccaccgtaactttattgctaacatcatcattgtactcaatcctccaaaaactcctacaaagtgggtatcattgcatccctttttttttttttttttttttagagatagggtctcactctggcacctaggctggagtgcagtggcacaatctcagcttactgcagcctctacctactggactcaagcgatcttcccacttccacctctaagtagctggagctatggacaggcaccaccatacctggttaattttttgtatttttttttttatagagatggggttttgccatgttgcctgggctggcctcaaactcgtaaactcaaacaatctgcccaccttggcctcccagaaagctgggattagaggcatgtgcccggccacaccccattttatagatgacagaatttgagactcagaaaggttaattaatttgcctagggtcacacatctagcacatgcaaacctacctgtgtcatgctccaaacgcctggcagggaggagacggacttacgagtttcaaacacggttggttttcacccctgagctagtcaggcaagagtagagtcagccaaagaagactaggtacacacccaccacacacagaactcccataaaagtcccagtgtctgaggcagaagcctcagaacgttagtgagaaacagtgtccaccagcagctctctcagcctgacaaatggaagtcattagcccaggccaccggaaatctgagcggtgtaaaatatggccgcaggaccaggggccttgactgtttccgctgacagtgttgttaatatctccattttagtgggtgatttgtctccacctcttcacgagtgatgaatccactggcactctggaacctttaagcctggggtaaaggcggctagaacattctctttcttccacctttgctcattctctcccagaaaaatgaatcacactcttttttttttttttttttttttttttttttttttttttttttgagacagaatctcactgtgtcgcccaggctggagtgcagtagcatgatctcggctcactgcaacctccacctcccaggttcaagcgattcttgtgcctcagcctcctgagtagctgggattacaggcatgagccaccacatgtggctaattttttgtaattttaatagagacggggttttgccatgttggccaggctggtctcgaactcctgacctcaggtgatccgaccacctcagcctcccaaagtactgggattagaggtgtgagccaccacactcagccaaattacactctttaaagagggcaggattggccaggtggcaaccagaatctatctttgcaaagaaaggagggcttggccgggatgagggcagggtgggaatgctagggcagtgagaaggcgttgaagagatgagagctgttcccataggagatggttttctgcttcccttgagctgagaattgtttagaaactacagaacaaagagaaaaggatacattcagaggactttgcttgagaaacttaccttctttttttccctctctctcttcctcttttcattccttctacgaatatttcttgagcacctactatgtgtcaagagccatgcggtgcagcaatgagcattgcattccaagctcaaccttcctggggcctttgcacttgctgtgtcttctacctgcccccacgttcccccacatctttgccagggcctgcttaaatgacactccctggagaggcctttcctgacccagctctcaaaagtagacacacaaagctgctttctaccctatctcattctgtttccttcctagcacttaccaggagatgaacttatcttgtttatttcttatctgtgggtttatctgagcctccaatgaaagccccataagtgtttgtgacctgtacagaaggccccactggggtctgcccctggcatctttatagatcttcctttgctcactgagggattctcaatctgggatgcccttcccttcagtgacctgctaactatgaagcacttattcttttttttttttttttttttttttttttgagatgaagtttcactcttgttgcccaggttggagtgcagtggcatgatctcaactcactgcatcctctgcctcctgtgttcaagtgattctcctgccccagcctcccaagtagctgggattacaggtggccaccaccacgcccagctgattcttgtattttagtagagatggggtttcaccatgttggccaggctggtctcaaattcctgatttcaggtagtccacccgccttggcctcccaaagtcctaggattacaggcgtgagccaccacgcccggcctcctcattcgttcttcaaggtctgggtctcatgcgcttcttgtcccctgagacacccccatcccattcacttctaccaaaaaagaggctgcttcctctggctggctcccatgacattttatttacacctgccttaatgatttctttacattcttcctaaggtagtcttatttattatcttttaaactactgagaaacgccagcattctttcttccatatacatgcacatatatatacaatttgtcctgcatccttcctttttcctatttacctagatatgtccctagctactcaggaggctgagtcaggaaaatcagttgagcccaagagatcaaggctgcagtgagccatgatctgcattccagcatggacaacaaactgagactccatctctaaaattaaaaaaaaaaattaatgaaacgaaattcagctgggcacaatggctcatgcctgtaatcccaacactttgggaggctgaggtgggtggatcgcttgagcccagtagtttgagaccagcctggtcaccatggtgaaaccctatctctacaaaaaatacaaaaattagccagatgtggtggcatgcatctgttgtcccagctacccgggaggctaaggtaggaggatcgcttgagcctgggaggttgaggctgcagtgagcagagatcatgtcactgcactctagcctgtctcaaaagaaagaaagaaagaaaaaaaaaactccacatcatgacaataacttgaagcaggtaccacctgctgcaaagaaaaggaaaagataaaaacgaaagctataaagaaaacagattagtgtcatctgacctggctagctacagtggcctgctgaagactctccaagaccagctctgtttgttcacagtggagactgtcaatgctggggaggggttccagcaccgagctgtgactttcttcttgaagtaacaggattcagagcactgcagcctccaattcccggcctcaagcaatcctcccgcctcagcctcccaaagtgctgggattacaaacgtgggccacagtgcccaggcaagaacaaatttttaaaaaggaatcgctttcccattgtgcaatttaacaccatgtcagtgcaccgcctaagaccacgctggtaccaacagaggcgagagggtcaaacagcgaacacgctgggcagtgctggataagcccgtcagagcaggctctgaatagaaatggttggccatactggtgggtactggccagatgtgggtctgccagcaacatcaagtgccccatagtttgggaagtccccacgtgctagacttaactgggttgacttctcacatgccctctaaccacaggcgtggaacccgggggcaggggcggggccataaccttgtggctggtgttctgtgtttcagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 1229 - DNA, 294230 bp, Homo sapiens; identical to SEQ ID NO: 1228

SEQ ID NO: 1230 - DNA, 3127 bp, Homo sapiens
tcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggg

SEQ ID NO: 1231 - DNA, 8466 bp, Homo sapiens
tcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatc

SEQ ID NO: 1232 - DNA, 5723 bp, Homo sapiens
ccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagta

SEQ ID NO: 1233 - DNA, 26506 bp, Homo sapiens
ttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 1234 - DNA, 3768 bp, Homo sapiens
ttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcgg

SEQ ID NO: 1235 - DNA, 15962 bp, Homo sapiens
ccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatct

SEQ ID NO: 1236 - DNA, 26677 bp, Homo sapiens
cgccggttgaaagcgcgtgtctgcgtcgggttctgttggagtgcgttcggtgcgccgtgggtccgcgctgcttccacccaacttcctgttaggtaagaggcgcgtgaggctcctgtgccgggggcggtgctgctcccgagtcggcgcgcggcggggacgcgagtccgtaggtgctggcgggagcgagagtcgggtggggaccctcgcgagcccgcactccgcctctgggtagcagcctcttcggccccacacggcgtgacgcgcgctcgggctccgcgttcgcgtcgaggcagaggcgtagtaggggtcgggcccagggctggaggggccgggaccgggcggggtgccgccctggacaccgcgccggcagctgttccgcgcgggttcatgtcattcctattttcaacctgtcctgctccgcacctgagatgatttataaattcggtacctttgggacaggcgtggatgacatcccataatttacttcgttattaatttctaaatgtaatacataccactctctaaaagtattttttaatttgaaatatatttgtatatatgtacatatatatttatttatttctgaattttgtctccagtacatataatgaggcttgtaaagtggatagtgttcaggacataggtggattttgcttttaagtagtaaagacttaattggtgacttactggggctatttgataaggatttttttttttaaatgaacattaaaaacagtgaaattgtatttccggatttcattagcttcatttatatcttaattggtgaaaactgtaagttaataactcatttttatttcctttggagattcttaagtttgtgctaccaatgattatttccaaaaaaaggcacacttctggttttcccagaactaatgctagcttctcaatcttttgagtttacttgatattaatgtttgacctcaaatcatgtcacatttttgaagaaaactttctcttagccagtggaacataaaccaccctggagttcatatagaggaggggttcaaatgcctctgatagtgtcgtgttaaaactcatggccaaacccaaggtcacatagctttctttccatgttttcctctagaatttgtatagttttgtcattataaaatgggtcttgtcctagaccccaagaacaggtttttggatttcacatgggaaagaccttttggcaagtcacagagtatagtgaagttaagatagtttattagcaactactcagctacatagcagggcgtcctcagaaagcaagaggaggaatgcacctgttgtaaacatataatttttttttgaaacagtttctctcctgtcacaatggcatgatctcggctcactgcgacctctgcttcctgggttcaaggattctcctgcctcagcctcccaagtagctgggattacaggtgcgtgccaatatacccggctaattttttgtatttttggtagagactgggcttcaccatgttggtcaggctggtctggaactcctggcctcaagtgatctgcctgcctcggcttcccaaagtgctgggataacaggcatgagccacccggcgcccgggcttaatgtttgtttatataggttattaagaatcagtttgtgacaggctattagtattgttacttctctttgttactgtcgattttaacatcaatttatgtgtgtactattacctttaaagtaaaacttatttttaaactaagaatgctgagtggtgtgctgtgtgggtgtactgtgctggtgttctatgcaggtgtattatgcatgtgtgctgtgaaagtgtattgtgggggtatattatgtaggtgtgccatgcaggtgtattgtacaggtgtgctgtataggggtggtatgcaggtatattgtgcaggtgtgctgtgtaggtgtattatatgggcatgcagtacaggtgtgcagcatctgagctccgtcttcaccttaatcccgaacactcttttcacctctcacctgcactgcagtgctgtttcctggatcacacttttttgtttgtttgtttaattcctccaggagaatgagtgtataggaaataaggatttctcttcacattttacttgactaacagtttctctggttatagaatatattttggatttaaagctctctctgaattttgaaaacactgtttcattttccgcttgcctcctatgttgttctagagaagctcaatcgcaatctcgtcccccatcctcaagcgatacacttcttttttctttattatcttgaagcattcagggtcttttcttcatttttggctttctgaaattgcaggacaatatgatgtaggttcgtttttatctctgtgctagctcttttcatttggaaacctgtgttgcgttctgaatgctgtggtctgaaagtgtaccttcaaattcatatgttcacacttaatggccaaggtgatagtattgagaggtggggcctgaaggacgtggctaagtcacaagggcagagccttcacagtgggatcagtgcccttaaggaagggctgagggcctgggtttgcctttttaccttttcacctcctgccgcgtgagggcccagccacaaggtaccatctgggaagcagagtcccaacccttgccagacactgagcccactggtgctttatcttggactcccagcctccagaactgtgagagataaatttctgttttttataaagtactcagtctcctgtattttgttggagcagtacaaatggagtaaaacactaagacattttctggaattctttgattgataattttttcttctcagtcttttatcttgtctcttccttgaacacattatttctggtgttgaacattccagaccacttctccaattttcttatacttttttctcctatttttcaccttttagatctctttttgttgttgatttactttctgtgaggtttaccaactttatctagtacaagttttatggaatttaaaaattgtttcagagtttaagttcccagatcctctttttttaactgttcatttttcatgacttccagttctttagtggtgacgtatcttttctctctgaagacagtatttacagttactggaattccttcctgctctccacctgtctttggtctgttttccttttcccgttttgatctctgtccttcatggtgcatcctcctgttgactcctgaccatctgttcacatggggctgctgtggggtgaccgggccacgcagtctcccttggcagctctcagctgtctgtatccgtcagcattttctcttggtctggtcaggttttcccagaggggacagtccgttctccagcctgggacagaggtcagggacacatgtgctccctccctgggttggctctttatatggtgagtggcaactggttttggacctctctcttgcaggctgggtctgtgggatgtaattagaaagcaactttatttctattcacttacatttattcattggaggaggagtttctctttcctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatggggcctagaaaccagagcacctgagctccatcctacagggggccataccgggatctttccattttcagaggcttctctctgacagtgaagtgtgatgacagacttgggggcagggcaatggctagcttctgaaagccgctggcactttagtgataaatttaaattaagtgacgggtagtgaggtgtttgtcaaggaaagtgccgtccaaatgctaaatactgattatttctgcagcagtgactgcaatacctcactcaatctctgtctttcttgaagaagtcataaataaacacgatgaatctatgtagaagcggtaagtcagaaaaatctgtgtgtttcattacataaacaacggtttatcattaattgacaggcttggattgggagttgttaatgaaactgatgagatgttggacagatgagctccctcttatttcgaagagcttatctagggctgagtcatgggacctgatagcgtcttgtggtgctgtcttcttgtagatatatccgtgttttagaggatttagttttttaaaatttctcttagaatgtgaattttacaaaaaagcacttcccaaatggatgattatttgaaaaatgaattgtcagacaaaactgacacatcagttatggagaaaacccttcaagaactggctttaaatgtgttttagtgggagccacagtgtggagagaaacagaagagggaggagagggcgccccttgtttcttctctccacagccaggccttcgccacctttctcagtgtcttcaagaataaaatgcctccgttgttggttttagctgcttttctccctcggggtaggtaaagtggttccaaaacgacaagcatcctgtaaagtcggaagagctgtgtcaacattaagctgcgtgactttggctatgagggaaaaaaggctggtgagtgcagagaagacagagctgtggcagggctcctcccgccaagtcgccatggagaggggctgtgaggtgtccttaaacggcctggtctccagggtgactcaggaagggctgagagtggtcagctccctcacctgctaaacccgcagcgccccgctcagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgcccaggctgtagtgcagtggcgtgatcttggctcactgcagcctccaccttagagcaatcctcttgcctcatcctcccgggtagttgggactacatgtgcatgccacatgcctggctaatttttgtatttttagtagagacacggtttcaccatgttggccaggctggtgtccaactcctgacctcaggtgatccatccgcctcagcctcccaaagtgccgggattacaggtatgagccactgcacctggcctcagctgacagtaggttttagagccagatatttacacactaacttgccagaaacatatatgactttattattctaattgattttaagagatattatgaactcaaatccaaagttacgtcccacctatcatgacaatttcattaaggaaaaagtcaaaccattttggaaatgatttaagtgagcaacttggaaaaattttctacattcctaacttactttccaggggatcgttcctgacttaacatctatcaggtgtcttagcttagctctctttttacttcaggtttttcttgcctcctcagtgtgctgggagtcccactccactcaaatgccctcaggtctaataattaacttcattgcaggctcctggcaggcctgggtgggcggcagctgcattgtgctcctgaagaagatttaagttgggtttggtgaactggtagaatttgcattttgctgtttctttccctctcccagaatttgtacctttaaataggttttttagtgtcattaagtatatcaaaaggaaacccagtggggcaaattggccgggctccatagaggtggccttgtctaagcctttcatcttatcgataaggaaagacaggaccagagaagtcgccgactgtccctggtcccactgcttggtttggggcaatttcctgaaaataatatccaagatgcaaagcatatggctctggtgagacatgtgtgaggagctgagaatgagacggctgagtgtcgggggcagatcacgaagggctgcgctcaccatcaggaggtctggacttcgctgtgaaagacacaggccctcatgtacgtccaggatgcggtgacagcgaggcttgcaggagacaggtccctgctgtgtgggggtgaagctggaggcaagatgatgcctggagctaagagatggtcacaggaaatccggcaagaattaacgaggactggacagtgacaggcaggccaaagagtgagaggaacttcactggcaagagccaacagggcttgttgatttaggagaggagacaaaggactgaggggtttgggggctggggcctgggagggtggagaagccactgtctgcattatgggatgcaggaggagaagcattcagttctccacacaatgagttccctgagaggtgtctcagtgggatcgtggtgcagttggaaatgttcatgagaaagatgagaagcggcaccagcagcaaacatccaggaacccagaaaccatcagcacaggtgcctgctgagtcccatagacccactaatggcccaccaggaccaaccaggaagcaagtgtggagctgggagtgagggagctgggtgtggagatcagggggaagactgtcatctaaagggcgagagtgggaaggatggagtcatctgtagctacagggaaccaccattagtcagtccttgtgatgaaggtgcaagatgttcctgcttccgcgcacgtcgctcctgggctgtgggcaagtttggaactgctgttgttccccagcatagtctcaagcgagtggaatgacggtttcctatagaagcacagttcctacaggaaagaaggcgtggttaagagcatgagggccaaggaaaaggaggggattagagatagccagcagtgagggagacggttccagacacgagccgagtgggcaaagcagggaattcaagagagagaggagcatatattacgcaaattttaaattttttggtagcaagcaacctagcaaaactagctgaatccaaaggggatttattggctcacatcataaaaatctagtgaaagattctagctgaagtcataactagatatacgagtttaaataattttgtcagaaactgtttctttgctgctcatccacctatccatccacccatctatccaaccctccctccctccatccacccatccacccacctacccactcacccgtgtctttatccattgatccacgtgcacatccatcctttcatctctactttcctccatccctctcccttgcctccctccccatccatctgcccatccctccatccacctcttcatctctcctttcctccctcccccatccctccaccccctgttcacccacccattcatccatccctgcatctttccgtccacttctctatcttcttgtctctgcttctctttgtattttgttctcactattctctatttcataaggcttcctgaaagcggcatccatttattccttgtagcaagatccctagagaaagactcataatttatctctcagtgttcataaactctcagggcaagttttatttggcctgacttggatcacctgccaatatctgaacggattgcacacccaggtaatggagtattttaatcactgcagaccccccaccctcacctgaccagtgccccacagcaggaccacgagcagggccaaggtgtctccaaggtgctgaggagctgagcgctcagccagcccacggccacgatggtgtgcctccgaagccacgcggcttacttcacagccaggatccgggatcaggctatgtcccatgcagcctgatgaagggtaaaaaagagcccaatgcagagtgctggggaagcatagagagagccggggcacctgacccagcctgggacggtcaagggtgactgccgtgcaggagttggcatctgagctgttccttaattagaaagcctggcacagaatgaagaatgcattcctcaaactgagtcagggtgcagggatccacatgaccgtgctcctcttatccttaggaagggacaagagacttctatcctttggcctgcagctgctgaaatgacccttgcaagtactgaatcatctttaatgaaaaaatacactaatatgctgcaaatttggagcttatcctttcagtccaatccatggggaaggtgtgaattaaagaccctgtgcgtgtgctggaggcatcgtggacttttgttcacgatttcctttccttttgatgcttcagttatggtggttgcagctctataagctgtgtgatatgggcaattcctctcaccttttgaccactatttttcttactaatgaaatgaatacatacaagaatacttgaagtttaaataatgaaacatctgatactcacaggcactacagtattggctgaattcttaagtgactataggacacctttaagcatgttctagggcaggataaccaaggacaccatctcacgtgccaggaaatgaggggcctgtgtccaataagtccctggctccatgtggctctgctgttgcccacttctcttggaccctggttgtggtcttcccttgccacggggcctttgctggtgatactccctctgcctggagtacctccataatgtccactgctggggccttgcccatattctctacatgtggcactgcagtgcccccccagccagctcccaggggccagtgcccccagttccttgtccaaggtctttgtcccgcagctaaaacccaatctgctgccaccggctccatccacaggcaaaagttcccgggaataaatgcgtcagggcacagccctcaggagaccttggttacggacatctatccatctcctcgccctctggggtgaatacatctcaggtgcactcttttgggtgtttctttttgcttttgttgtttgcattggctcccagagtctgacagtggcagaaggctccagctgcccacagtggtgactggttttaagcgtaccctttgttggccatcttcctctctcttggaaataaacagcctgcactccaatccttgtcacagggtcagctcctgagggatcttcttggccttgctaatgctggcttatccttcagaatttagcttccattttcacttcttcatgggagtcttcttgagtatagtctcctcgtcatgtctgccgcttcttcctgagtcagggaatatctcttaggccatatctattatagtcgtggtctgacttatatttgtggtcaatttttttttcttaatttttcgtagagacggggtctcactatgttgcccaggctggtctcaaactctaagtgatcctcctgcctcagcctcccaaactgctgggattacaggcttgagccaccaagcctggcctatgtttgtggtctctttgactaaaaatgatcttttcttctaacctgaaatctcctgagggatggaactttgtgtctctttggtttatcccagcatataaatagttacgcatttttgaattaacaaatgagcacaaatttgtatcaaattattatctaggacaagcagtggaaaaaaattctgtaaagggccgggtaactgttttaagctttaagggccatgcagtttctgttgcagttaccaactctgctgttgaagggtgaagacgtgggtaggtaatatataaaggaatgagcatgtctggatgttccaataaaattttattttcaaaaataagcagcagaggagagcttctggaatggtggtgtgaggagcttggcaggccctctatccagggaaataaccatttaacctccgaacattcatttttttaaaactagaaattatcctaaaggcatacagcaggtggataaatatttactcaaataaataatcaaatctcagtaagaacggtaaggatcagtggtatcagagccacaatccaccgctccccaccctcaaagcgcattgtgatgaaagctctgctccaggaaggtccagctaacaagatgctgtggtctgtcttcccggctcctggtctagggctgtggtttcaccccaggaaggcaggccaccagcatctctcatccctctcagtttgcactgcagaagcaccgttccaggaagttgcaactgagaggactagggctcccctgcttcagcctgtgcttgtcctcagagggtgggagccccatcccaggtgtggcagactgagcacatctgcctggattgccccacaccaagtcactcacagtgtggaggttccatgtctggaggggcaagctaggaagacaagaggctaccatgcccacccagctactggctcatgcagcaagggtgtcgctctggtggaactggatcacggtccccaggagcagaggagacctaagagcagagcatgtccctgaggtgacagactttacttggagaacagcatgcggaagttcaagcccaaggaagttggcaaaaatagtggagattttgttgatgaacaattaagagtgggtgaaatggtagactagatagaacttaaacagagggaacaaggaagagagattgttgagaagagctccggggtctgagcagacttgaaaagctggcaacactctgcccctgcaaaagagcctgatgttcactggatgagtctatggagcaatttgtgccccaggcatcataaaaaatgatagagcacttgcatttagtggatgttaacagctgtgtgtgacaccaaagagagacagaccagcagaagcttaacagagagcccagagaaaaccacagataccacaggtggtcggagagactgtgtgctagtccaaggctgtgccctctgaggagcaatatcagagctacgtccctaatcaaataaacaagcaatcaaacagaaatagcagcccctgcgggtcggggtcagaatccagatttgctatgatatattacctaaaatgccagtttccacaaaaatgcaagaaaacaggaaagtgagacccatgctcaggaaaacagaaggcaacagaaactatgacaaattccagacatcggattaacagacaaagacagccagtgtcaaaacagccacagaaacatattcaagttactaaaggagaccatgttaaaagaattaaaagaaattatgatgacagtgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctggacacaaacacctagacacaaacacctggacacacacacctagacgcacacacctggacgcacacacctggacaaacacacctggacacacacacctagacacacacacctagacacacactcctggacacacacacctagacacacacacctggacaaacacacctggacacacacacctagacacacacacctggacacacacacgtagacacacacacctagagacacacacctggacacacacacctagacacacacacctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggtgtaaatgcatatattttctcctgttttcaaaagcaactgcataggacaataagtatggaattgtattattggacgcataacatacagaaatgtaatatacttgacaataacagtacaaaggaggcaaatgggaaaaactgcactggagtaaggaaatggccacatattgtataatcccatttatatgaaatgtccagaataggcaaatccacagaagtagaaagtagattcatagttgcctgggcttgcgatgtgggtgcaagaaagaaggaaatgagtactaatgagcatgtttcccttagggaatgacaaaaatgtgatgatttcacagctctatgaacgtactaaaaaccattgtagtattaaaaaaaaaaaaaaagaacaaaagaaaagaagagtagaattttgggtacataattgtaaaatcaatctttagtggaaagctctgttatccagaaactcaaaattagctacataacttccccagaaatattcatccgcagcaaatattcatcagagacagaatccaaacccaggtctgtgtgaatctaaagtttattttcctccacctgccttaacaacaaattattgaataactcaaggacacaatacctcgaaagagtctgaaacatttctgtgatgaatttacttatgaatcccaatactcttgattctagatgatgtgttttgttcagcatctgtttcagtcatatcaagtaaaaccacttcccccaggtaatatagttttcctttttactttttcccttggcctcagcatttacagccccgtgcagactgttttaacaaacgcgttggtgaggtgtggtagaatcacaggcaaaggcgtgctttgctgtgctgtgtaggtacatatcaaacgctcaccaagaaattataaaatattattcatagcagtttttttcttcagtattttatgggctaagtgcaatctggcttttgataacaacggctgaataatatttgagtttgccagctgaaatgtcctaaatatcttattgattcatttattgcctcttcaaataacaaggcaacaagacagtgtcagaatgctcagtgtttttacttttttgtctatcatgggatggtgtcagtttcagtaaaaacgatgtctcttattttggtccacattgtaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttacctactcactcgaatcactagagaataccaaataggaataggaagataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtgagagagaacaatgtcccaattttgcccaggtgatttgaacatctcggtatggatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcctctgtatacatttgtcaagcaggaagctgggtctgcggggagtagggtggggctggttctcccacacgcttgccactttcaggcccttgccttgcatgggctgcggtggttctgccagtgtggattcgaaccgataggtttcgctgtaccttgatcagcatcctgctgccgagaaagccaaaaagggctggagcaaccctcccgtgtgccatgtgagcctgtttcctttctacagtcaccagttcacgcagcaagtgtcagagcattcctgtaaggcccggctctccacaggggccaggggagctttctctggcagggtcttcttcactgtgtgtaggatacggcagcctttgaggctggggaaccgaagttttccttttattctattttaattaatttaaattacaataagtattatcactaagtttatgcaaacacgtgagggaatgctgatttagagctggtggcgtaaggtcacagagctcccacgaatctcacatggaagccttgtttctccaggttttttgtagtttgtactgaatcacacaccatgctgcttccatgttttttcagggatttccaacacagattttcctgagtaccctggattaatctccttttggataggtccatgggggccctgctgctttttccccttagccctgggcgaggtcatcatagagggggagtggcaatggctcacaaggtactagtggaaccccagtaagttatctcagagcccgcttagaacacaagtgctacgtcccccaaaagctttgcaatgagtatctgatgggaacaaactcagtcaaggacaggcccaggttggggcttgcaggctgcagattcagaattgtttatgagatgggagccatactttctaacaacaagacctgaatttctcaatttaatccaagtcgtgacttaagttagcgcccttccgttcctctattacatttctgttcggcatggatcaaattgcctacaaggtggaacagatttcaactgcaatctctgaaccagaaaattcacttattctcatgaaagtttgtaatctttggagagttgcttaaacacttaaaaccatctttcctctttctatactccaaacttacctgctgcaatttcttgctaagaagcaaagtgctatttgcctattcctatctctctttaccatcagacactccttaagttaagagctagataattcgctcagcctcaggccaggccgagcctcactctagaagtcacattcctgaggtgtagggggtcaaaatgcctctcattgttcagaagcaggtgaggggccagccagggcacatcctgctctccaggcttggttcagataactgtcagcccagttttcaagagcacacaccaaaaatgcaccaaagcttacatccatacaaacacccgcacatggatgtttatggaagcttatttgtttttattcataatcacccaaactcagaatcaaccaagatgtccttcagtagatgaatggataaactgtggtgtgtccaggcagtggaatattattcaacgcaaaaagaaatgagctatcaaggcatgaaaaaatatgggggaactttaaatgcataaatgagtgaaagaagccagtctgaaaaggctacaccccgtgtgcttccaactacaggacatcctggaaaaagcagaattaccaacacagtgaaagataaggcctggtggtgtggggaaggatgaacaggtggagcacagggatctttaaggcagacaatctactctgtgtgatactgcaatgatgagttcatgccactatatattttcccaaacctatagaatgtacagcaccagtggtgagccctgatgtgagctgtggactctgggtgacaatagtgtgtcaatggaggttcatggactgtaacaaatgcatcactctggtgggggatgttgataatgggggaggctatgcatgtggggaggtgggtacatgggaaatctctgtactttctgctcagctttgctctgaatctaaaactgctctaaaaatcgtttatttaaaaatacaccaaagcaatgaggccgggcatgcatacagccaaagccaaatgatatttgtgtgagtcaggtaaatttgagatctgaaaaatgatcactccagggaggctgagctgtcatggggcacttattgagaacctactttatgcccatctggtgcttagaattacgaattagctattattattactaaacaattcaaaacaaagtcacttatctcagggcgctttcaatcttgttgccatcgaagctaacaaaagtggaaacagaacaaagctacatacggcacatttcccagaacatgccaggtggagcctggccctgttgattgtgtgtggctgtcacttgcaggagggttccatggacaagtgagtttgggaaatgctgggttgggcaaatatcaacaggcttccttactgcaagatttctcatagtcaaaacatactttaaatctccaagaggatgatacagagagccatgtttcccataattagttggccccagaaacagtttcttctgggaacattttgtaagattagtgctccttgaaacacactgagggagaggctaaactgagtggtagagattcatagactatttggattctggccccagagtataaaaggccagggggaaaggactgtgttcctgagatggtgaggtggagaaggggacgtgtttctccaccacccacagagagggctgagaagccctggcacacgggctgaatctgggaggtcagaaggtgaggtgagaggacaggaagacagcccacgagacttccaaaggaaatggtgagtcttaccatggctctctgggctgatggcagggcccggcacaaggtaggaactgagtgtgagtgcgggatgcacccaggtctgaaatgctcaggaaggaccctaggacatgagcaacctgggctggtcactcatggaacctgaatggctggaaagaaggaagggtgatcctgctaagacagggcgttgtgaagatttcctttccctccgaactaacatctcactcacttctctcagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggtaggtggagacattggggctcaggtgtgggtaagtgattgtgtgactccttgttaagcggcagaaccgggactcaaattcacacagatctgattccaaaccctgtggccctaagcatagtgttattagacaataagccctctgcagggagatttccagtgctgatggcagggtctgtcatgaaggaggactctgctgaatttttctttgaaccccaggaagtgcctggcacagttctctgaagaaattagaatgcagccagtggttactaaagaaatgaataagtcaagtaaatggacagagctgtgtgctaagagttcttttgggacacagaaatgggtcagaattggaaatgtccagaaaatactcttggataattatgaaagctacatataggagctcaggtttaactccatatgaaatgaagagtcacaaaagaaaaggaggaggagcgtgttcaggcggaacctcaagcttgagagtgctatgaaatatgtttgagactcagaaaacagttcctgaaagaaatgacacattaatgaatgaaggtatagttatttggagaaaatgaacctagatataagagtaaccatatcaaaatgtgtttctttaactgcggtcttcagaacctatgaggttcattggtatattcttgggaactatgtgtgtttgagaaacatatttctggcgccaaactgacagtcacctcaaatccatcacagcacttatgatgaattcttttcaagttaaatgctgtaaagaaaatacttctcttttttactgttaattcacaatttaaaagtgttttcttactgaactacatgttggtccctcagataaggatttctcgagtctcaggtctttggggtctttgaggagtgtgacttctcaaattggatgacactgatctaactggctgtagtatccattcaagcatgagggaggtcagagcctgggaaagctcaggtccaaacagctcttgaaagaggacgttgcagggcaggctgctttgcacaaagggacctgtagacactgagaacatcagtataccaggaaccagcccaccctttcactctgccagacatgaggctgtgggttacccatctttccctgtctcctgaactcatagcaaaaacaaaaaacttcacttgtttgttaacacatatagttcaagacggaagggcctacactgaagcagaaaggattgaggtttatcagcatcttcgctttgaggcctcataatgtacttcccatggactaaagttgttcactttctttagaggatattagctaaagatgtggtaaaaccacatttttgcagaaaagtgaatattcaaaaacaaatgtatatggtgattatttaatagttttcactccacttcgcaactcaacttttggttgatgcaagagggatgcgaagggagaattgtgcttctaattccagcattgtggtggaataaaagagcacagcattgcagctgttgaatataggcagttttttctttttataggcagttttaagaagaatgcattgattctacaacgtgctattgtgaagccatccgggactgttcactcactcatttaagaaaggtgtattttccacttgaggtgtgagagaaagtgtggtgttcactcattgctcttccttctggcttttatttttctcacttttagagaaaataagagaagtatccctgaaggatgaaatatcctcgaatatgaaaaggtctgctctctgaagaccaactgtctcagtctgctttttgctgctgtaacagaataccacagacttggtaatttataaacagtagaagtccatgtggcttatgcttctggaggctgggaagtcccaggttaaggggctgcatccggcaagggcttctcgctgccttatcacatggcagaaggcaccttgtggtgagacagtgaggaagggctgatttcactctcacaacaaacccactcccatgataatggcattaatccattcagcagggcagagccttcgtgaccccatcacctcttaaggctcccgctcagcatggttgcactggggttaaatttctaacacctgaactttggggacatgttcaaaccatagccagggccctgagaaacccatttccactgacttcaaaatagttcatgaaaatggagtgctgagagagcagcagggcattcacaagaatggttttgagaggcctcactgtgccaggcatggccctcagggcaggcagctctgcacagccccccatggcagcagctggtcaggctgcccaaactcaccactttggaatcacttcagcaccacctgtcttcacttgaaatcaattgtctgcagattttaaactcgtttctatgtgcccagtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaagtcccattcttccttgataggtctttagatgtaccagtcagcaaatgtcatccccctctgcattcacgtcaagctgtgcagggaatgctaaacagaggcagatctaaacttaggagttaggcttcttctccatggagatgtggatctgcacagacaaagtgtccaagtgggattttcctgctatttcaaggactgctgctgcaccctgctggctcttcctgcactccctgcctccaggaatgactgtgtctctttgagttagtgaagtcatcaacttttttttttaaatctcttattattattattatactttaagttttagggtacatgtgcacattgtgcaggttagttacatatgtatacatgtgccatgctggtgcgctgcacccactaactcgtcatgtagcattaggtatatctcccagtgctatccctcccccctccccccaccccacaacagtccccagagtgtgatgttccccttcctgtgtccatgtgttctcattgttcagttcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacattcgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctcatcaacctttttaaaaagcatttaggagctgctggttgtaaatgatcactgagaaatagtatttccctcacttgtagccatctgcttctctttttggttctggaacattctagaaccttggaaggtggctggggctgagtctcagccagcagggttgcccagtgccccttgtcaccccccgagcaacacaagccaggctgcggttactctgggtctgtgcgtctgggatcatagtttttaaatctgccccagggtcctccagtcccagctgtggaaagtcaccctcagagggtgaggcgggcggcgcgcctctgtgtgagtggccccatccttcacagcgagtttgtgtctactgaatcgcagactctgggaggctgaagggttacaggaggtcgtgtgtctcacgtcgccacttcacggttgaggaccccgtgacccgctttgctcagtggctgcgcaagatgagtaatgacctgaaacagggaaaatgtcttggatacatcttgcgtaatgaggagaaaaatgcagccatgttgcagcctgataaaatactctgccagtgtcctgccataaaatgacaggcgaattttcagtagcagattctctaatagttctgtggtcttctaggtgctaaactgtttaagtatctacattttctaagcccgcctaatgcaaatattctcaaaaaacataaacccttcattctttctcaaataggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtaacatcacatgatcgttcaaaaaataatcatccaagtccaggatgcagcatctgtctcagtttttggcataggatgacagtctgaaatacacttactgaatttgaataagaacgggctcaggtcagtgattatcgctagtgccttatcaacgccctgtggcttttcagcattagtccccatatcctcgtccggtgtggcactgagagcagctaactgttgccctcgttggttcccagttggcttccgtgactggtcagggtcaggtccactgccaacaggctggtgttgaatcccttggagaaacacagacattctgaccctaaattatgctttcaatgccatgtgttttcctatcacaaaaatcctcgttctcaagtttcttctttctttatttttatttcatttcattttttagcattcctccacaattcattgcccaaatctactttttactcaatttacttgctttggtcatttttcaatatagcactttaatttcttagacaaatattttcaacattctcctgttttctcaaggatgtctgttttctccccaggtatgatcctgtttaaggactggatttaggataactacttagaggttaaaagtcacaagggtgtatggatgaggctggagtgatctgggaccaaaggtatgggtgataaagcagagtatctaagcagctcctgggattggtgtctttaaaaaagtaataatgcatttgcttattttagagacagggtctcactatgttgcccaggctagacttgaactcctgggctcaagggatcctcccacctcagcctcctaagtagctgaaactgcaggcatgagccaccacactcaactcactatctttttttttggagacggagtctcgctttgtcccccaggctggagtgcagtgctgtgatctcagctcactgcaatctccacctcccgggttctagctattctcctgcctcagccacctgagtaggtgggattacaggcgtgcgccaccatgcccgtctaatttttgtattttcagtagagacgcggtttcgccatcttggccaggctggtcttggaactcctgacctcaagtgatctgcccgcctcggcctcccaaagtgctgggattacaggcatgagccactgtgccctgcctagctcactatctttcaatcagtagagattctttagttattttttaactccatggatcccaagctttgatttttgttttccaaacaaattgcatttataaataataatttttatttataatcaacagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttatt

SEQ ID NO: 1237 - DNA, 64665 bp, Homo sapiens
aattggcgtagcgcttgctgagcggcggcggcaaccgacgtacacaaggggcttgagcgttctgtggagagagtgcgaggtcaggccatgaacttggggtaagcaggggtaagctggggtaagctggggtaagcaaggtggtcgtcagcggagagggaggcatgtgtgtctgggttgtcccttggagtctttactggagaacgttcccaacctgcgccgccgagaggggcagagcccagttctcgggtagaagatcgaggcagatgggtcggcccttagcgactccacagaccttacgttttcacttaatgactagcattaaaactgccagtgatcccctttcggtcccttatttacctcaggatgaggagggaagagaggtgaggaggaaaggagagaaatgacgagacagttagaggaagcgtggcggctcctggggaggactcctggcccatgccccgggttcttcgccaccttgtttttggagtcttgcagaatgttgaaacgcccaaattcgttttaggcccacgaggcggggaaccaggcttctcaagaaatcgatgtagtaccagtgcctaacacctagtaggcgctccttaagtaggggtgaataaataaaaagggctggtgcatggtcttcatcactcgcaagtttgatattttgagaagatgagaagccaccaaactcagacctaactacacatcgttcagcaaatgttattatgttttagaatctggggatatggaaataaataagatagtgtgtcccttaaggagattacagtgcagtgcgtcattgaaggtactttaccattgaagctcttttctttcttggtgacgtttcaccaacataaacacgaactgttcataaccctacaataaggaaagccgtaaaacctattctttccagtgttttacctttaatagttaaggtgaggtaatttgatttcccctacctgagcaacaccgcaaatttcgcattcctaatcagacctttcccagcctctctctcccttgactggcttgctggatttaattttctctctctgaattatggactgtatgtatgggctgccatttttgttctcagtggagttttaggaccttaacagacgttcaagttttgttggcagtggctactgttactttatgcctttgcttctgatatgcacgtataaagcaccatactaaatatcactatgtattatttgaaatattgaaagtggtactctttgctcaagcagttactaaccttgatggcattgttagtagtcatatcgatgctccagcactccatagaatgttttagtcatgagttcattatgaaactaatgaatggcggttaaatatatcttgttcctttaacttatgtgaggagttttggtaacagcattattaaaaaatggtggtatgataacttaatttatagtttaccaataacaaaatgagatttcaggttaatgataacaatgcttgtagtattgaagagtttcaagaattttccccctgtagttgtgggttttatcttggattgcaaacgtttttaattaaaacactggttcgatgtgtacaagattcctgcataaattcaaaataatggatttattgtcaggttcaaatgaacatttctggttatttaaaatgttgcggtttgttaaaaatgagagacaactttctttttttattacagagatggtttaaagcttgaaactgaattactggatggaaaaaccaagctaatattgtctccatatggtatgttgtgttacagaaatctgaaatgttaacttttaaattcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatttgcccacaccaaaggggaaatttaattcacaaattgtagcatgcatttagcattttcctttaaaaggttgcacttgagcttaagggtaattttccttttaaattattttcccttatcagaaatctattgtgcttttttctacaaaatacattatcactttgtttattttaatttttgaggcagagtctcactcttgtcacccaggttggagtgtagtggcataatcatggctgcagatcttcctcctccagcctcctgagtagctgggaccgtgtgcatgagccaccatgcccagctaattttttttatttttagtagagatgggatctcactatgttgcataggctggaattaccatttaaaaaatttttttgaggttgggcatggtggctcatgcctgtaatcccagcactttgggaggccaaggtgggtggatcacctgaggtcaggagttcaaggccagcctggccaacatggtgaaaccccatctttatgaaaaatacaaaaattagatgtggtggcgctagtcccagctacttaggaggctgaggcagaagaatcacttgaaccctggagatggaggttgtagtgagccgagatcgcaccactgcactccagcctgggggacagagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgtttgtaatggttgatttttatcttctccaggctgatttgttatagaagccacatttgtgaagacattttattgtcattttaaccaactcagaacatctgaagatcccctttataggcctataataaacagaattactggtcttggatttttggtaggcctataataaagttactagtcttggacttttgattactagacttttaatcataaaattctatcagctatctaaaggtgttttagaattttttttttaagagtaactactgtgttctcaactgatgttgagcctaaattgtttactgccttaaagcaaattgtttgggtttatccccattgcatttgggacttcaaaatactgatgcaacctaagtttcccttctgtattgattgttttcaagaagtttctcttcccatattgatagaggttacagagatcctcctcatttcttttttgctcttcacagactataaacaccaaaatcagtagtattttcttccttttttgttttgttttttagtttcccaaatttcacagttctgccactagatgttgaattctcttttctgcaagttattcatgaattatctctgcatagtgcttttctttattccttctaatggggtaagctcctgagttactacaacacctacaggtctctttttttttcccccatttcccactggttgaattattgtaatctccatagtttgttctttaaacacagctgaactctatctcattatcatcaagtttaacatatatgtggtcaaagtgctttcctaattctatcaaaatctgtgcatttttcttttctttttttttttcttttttgaggcaggctctctctctttgtccaggctggagtgcagtgggacaattatggctcactgcagcctcgacctcctgggctcaagggatcctcctgcctcagcctcccaagtagctaggactacaggcgcgtgcccacaccaccaggctcagttaattgtttaaaattttttgtacagacgggagtcttcctgtgttgcccaggcttgtctcaaactcctgggctcaagcgatccttccgcctcagcctcccagagtgctaggattataggtgtgagccactgtgcccagcctctcctacatttttatttttcttcaatctgtggtaatgaagtaaacttggttactttcctaatttcttaggtttataggaagagaaatgggaaaatacagataatacagtatcataagtaatttattaaaataatggattctaaaactcttacacttaaaatagtctcaaagattagttgaactataaaacaataaaaaaatttttatgagtacctctgcacgtgagaatcagtgacatactaaaaggtatttgtaatattagtgctaggtagcacattttatatatatatattttgtttgttttagagatgaagtttcgttgttgttgcccaggctggagtgcagtggcacgatctcggttcactgcaacctctgccttctgggttcaagcgattctcttgcctcagcccctcgagtagctgggattacaggagcccaccaccacgcccagctaattttttgtattttttttttttagtagagatggtgttttaccttgttggccaggctggccttgaactcctgacctcaggcaatccacccacctcggcctcccaaagtgctgggattacaggcatgagccattgcaccctggcccacattttatatttaaaaatgttacttttctctgatttgttctggccttgggatcctggccccatataaattgtgaagtgagctgatattaaacaaatccattgaacattgtctttataataataaaaaatggctgggcttggtggctcacgcctgtaatcccagctctttgggaggccaaggcaggtggatcacctgaggtcaggagttcgagaccagcccggctaacatggtgaaaccccgtccctactaaaaatacaaaaactagccaggcttggtggtgggcacctgtaatcccagctactcaggtggctgaggcaggagaattgcttcaaccggggaggtggaggttgcagtgagctgagatcgtgctgttgcactccagcctgggcaacagagtgaaatgctgtgtcaaaaaaaagtagttaaaaaaatttttttaattgaaaaaaaaaaaaaagagataatgtaggtggtataatctaatgacataagattcaaagctggagtatagtggagatgtcctataacaactataataaaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttatagttgtgccatattttaaggttagtgttcagaatattaagaaacctagtttctgtggattttagaaaaaatgttagtacaaaaaactattattatacttattttagaatataggaggctttactcatatttaaaatagttatatgaaacattgtttaaaaacaaattacggtatttccagtgaaaattaaggaaaccttactatgactatttgacttgagttactgaaaaacattgctttcctggccacagcatttactcttcctgttcctcattccatgctaagaaatggcagtactttttttaaaaaacaaggttaacacagatttggaaggaacagtagagtgttacatgctttgtctttcacaagtcctggcattgtattgtgtttttaaaagccttctaatttccactttgggataaggaattgcgaatatgaagacaatagaaatatctaaaattttattaggcaatagtgaaataaataaaaaattaacagttcacatggagaggccccacaaatggtttggggacccattaactcctgaatattcccgtgatactcaagatggaattatttactctcttgttatagattattcttggtaaaatgagggagctggattttgtctttaaggctaaaattctagcaacaacctgcttattaggcataacgagaaatcatatcaacaaagttaaaagcagaatttgcctaatcacgtagactttcatgatttctttctcttcactgggagaactagcacattcaaaagaaatcagaacattttttgagccatcctgtgagccctctaaaacatctgattttgatattatagctgggcatagagacaattcatgaaaaggttttccactgatttcacagctaaataagaaaaataacgtcaaggtaatgagtatttatcaagatatttgtattcccctttaggttgtgatttgtgttataatttttattttatttatttatttattttttgagatggggtctcgctttgtcacccaggctggagtgcagtggcacgatcttggctcactgcaagctctgcctcccgggttcacaccattctcctgcctcagcctcccgagtagctgggactacaggcgcatgccaccacacccggctaacttttttttttttttcttttttttgtatttttagtagagacggggtttcaccgtgttagccaggatgatctcagtctcctgacctcatgatccgcctgcctcagcctcctaaagtgctgggattacaggcatgagccaccacacccagccatataatttttatttttattttttatttattattattatttttttagatggagtctcgctccgttgcccaggctggagtctcgctgcgtcgcccaggctggagtctcgctgcatcgcccaggctggagtgcagtggtgcgatctcggctcactgcaagctccgcctcccaggttcacgccattctcctgcctcagcctcccaagtacctgggactacaggcgcccgccaccacgcccggctaatgttttgtatttttagtagagacggggtttcaccgtgttcgccaggatggtctcgatctcctgacctcgtgatccgcccaccttggcctcccaaagtgctgggattacaggcgtgagccaccgtgcctggccagtttttatttttaaaagcatgctggcaagaggaaatggagatttgttttctgttgttgctcgcttgttttccttatttgatataagaaattgtatggctatggtcatgagcaagccatttaacctctgggcttcagtttcctttgttttgttttgttttgttttgttttgtttttttgagacgacatctggcccagactggagtgcagagtgcagtggcacaatctcagctcactgaaacctccacctcttgggctcaacccatcctcccacctcagtgtcccaaatagctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatataaaaactaaaataaatggccagatggctgacacttgtccaccatgttgaggttacagaaacaataggggttggagcatggcaaaacagattatgggagggggaggagaggcaacctggccagtaaaagtgtttttttgttttgttttgttttgttttttgagatggggtctcgctgtgttgcccaggctggagtacagtggtgtgatctcggctcactgcaagctccacctcccgggttcacgccattctgcctcagcctccccagtagctgggactacaggcacccactaccacgcccggctaatttttttgtatttttagtagagacggggtttcactgtgttagccaggatggtcttgatctcctgacctcatgatccacctgcctcggcctcccaaagtgctaggattacaggcgtgagccaccacgcccggccaaaagtggttttattatgtacatgagacctcaaaggtagtagccttcagagaacagatgacaaatgtttccttcagacctttaaaggtgtcagactcggttaatttatcctagatctggacaggggagaatcctcagagaaagcctggctgcgtcattgcagattttctctacagatgcaaatcttccccacaaaagacagctttgcaaggctacttctgtttgtaggccctctgaacagccatcttgaaatgtgtcaaattaatacattttggggtaaaacactgtagttccctttaaagtatagttatccctcagtatccatgagagactggttcaaggatagtcttcccacttcagggtgccaaaatgcacagatgctcatgtggaatccatggatatggagggcctactgtatatcttttagtatgatattatcaaaagtcgtattttataatatttgacatctagagtagttctctacaaatgcttaagaaacttagtggtttcataatgccttaggtcgtgtctttttgttactctgaagtgtgcaccaaaaacattaatgtcatcagtacattctgcagcccttgtaaggtcaaagatttgtaaacttttcccatttcctggaaatccttttttataatttttgatagcagacatcctatgcgtttaaggatggttttactaaaaactaattgatttcacttttttaaataaccaaaacattctaatgaagaagaatcattgttgtatcagacagtatgtattctagacagaaataagcttattgctttctttcagctttggaccttataacagaaaaatctataatttctgttagagtcttgaaatttcgttagtgactaagaaatatccattacttcttcgactaaacttggagtctgcgtatcacaatctgcaaaacatgtgacgtaacagttgtatttcttaggaatagctatgctaaaggcatgagatgggcttcaccctagttgaaaaacaagaaagtcttgtgaggccatcactaacttggctgggatagatgatttagaaaaagagataagcaagaccagctgagtggctcacatgtaatcccagcactttggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaattttaacccatagttctctacttcagaattctagcttttaattctcttaataataattgaatgaacattacaggaaactagaacctcgtgataattgacaaagtataaaataagttattccaataaaactgctccttattggtaattgtgataataaaattgtaccatacttaactttggttctgattaaattttttcttattctgtgtccctaaaaaattattctccactttgtgagttaatctccttcctaaaaaagagttttgattagatctgtgttggtatctgcattaagaaggtcagatttgtttacatggttctgtttttacagtttttgtacatttttttaaaaaggacattatttacagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaaaaaaaaaagttttttttttgagacggagtttctctcttgttgcccaggctggaatgcagtggcacagtctcagctcactgcaacctacccctcccaggctcaagcgattctcctgcctcagcctcccgagtagctaggactacaggtactcaccaccatggccagctaattttttgtattcttaatagagatggtatttcaccactcaggatggtctcgaactcctggcctcatgtgatctgccagccttgacctcccaaagtgctgggattacaggcatgagccaccgtgcccagcctatttaaaaaaacttgtcatatttttgggttttttgtatgtgtgttttttttaaaaaaagaaacagggtcttgctctgttgctcaggcaggtatgcagtggtgaaaacataattccctgcagccttgaacttctggactgaagggatcctcctgcctctgcctcccaaatggctggtactacaggtgtactccaccatgcccagctaattaaaaaaaattttttttagagacagggtctcactgtgttgctcaggctggtgtcaaacttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaaggagagaatctaagtcctccttatttttagttatcagttaatttttacttgagtgtattatgcttcatttgctatcccttcctccttgtgaacatttacattttagcaaatgtattctgaaaataatgtagtaacctgaagggatgattctcctaaagagatgattctggtggtagaaatttttggcactatggcctaattaggtaaatttcttatagaaacccttcaagttaaattttgtgcatggctgtctgttctgcttcatgtagagctgacttgcctacattgaatacttttgttgtctgttgataattttacattaacaaaaggaatgaaatctgaattgcatttgcccacaatcccaaaagcacattgactgaaaaggcaataaggttgtcttggtagaactcattttggaaaattctgtagctctgggtgataattttaagtgtgtaaagtttagaagttgtatgcagacaccgttaaaagttgtagctaaaactaagttttcatgaagttggtgaggatccgttgttggcttatttacttttcaacatcaggataaaaaatctgtaatactaaaaatgttaaataatttcagttgccaaattttcagttgaaatgtcaatatataatttatttcttaatttgcatggctttttaggtcatttattatctggggataatccataccatgattgttaatgcaagtaaagaaccatttgaggtgacatttaggttttaaaatattttgtatatattttttaatgatagtatttgtcagttgatgaaatgacgaggctcatgaatttggaaaggagaactttatttctcatcagcagttgcaacctgcagcatggccattctgacaggctgggaagcatagccttcggccaaccaggagccagaaacttcaaggtgttggggaagggaacaggaatttatgctgagtgaagtggctgaatatacgtatttaataagcatagaaggagtcatgaatatttatgaaaggagaaacatccatgcacaattgagttttatgccccttcatgggtcccatgtacaaaaaatgtcagcgttagcatgatccaagggtagagttttcagccctctgacatcaaaaagtaaagcagaggacacaaaaaccttttggacagaagcatcaggtggttggttggtatcagtgctgacatcttctgaagggctggtttctgtttagcccttaggctaaatagtggttagccagggagggaggaggtataatgtggtgtgtctgatttccccatccactcatggccaagaactcagttttcaaggcactttggggtccttggccaagagatccattcagttggttgggggacttagaattttacttttattcctcatgtgtatctttttttaaataactaaaaaaaaacaataaagttatttaaaaaatttttggaatcaaaagttgtgggggttgatgatgggagaaggactagaaaacgaaacacatgctatatccaggactggacaaccaagagttaaaagagtatgattattggctcattttttttactatttaaatgcagttttcgctgggtgcagtggctcatgcctgtaattccagcactttgggaggccgaggtgggcggatcacgaggtcatgagattgagaccatcccagccaacgtggtgaaaccccatctctgctaaaaatacaaaaattagctggacatggtggcacgtgcctgtagtcccagctatttgggaggctgaggcaggagaattgcttgaacctgggaggtggaggttgcagtgagctgagatcgtgccactgcactccagcctgggcgacagagcaagactctgtctcaaaaaaaaaaaaaaaatcagtttttatgtatttgtatgcgaatgtggtacaaaattggagagatgttattgagggaaaaggaatttgctgtgtaacaaaaaagccctcttctcaaataccttagagcagttgttttcagaaatcccagctgtagccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaaaaaactttctagatccagaagaaaattaggttgaatgaaaagagggccaatttgaaggtatatcataataagtttgcaaatatcaagaataaggatatacttcttcaagcatttaaatatgagaaaatgacaacaaaaatcaaagtaaccttagttttcttctctgtatatagtatagcaatatttataagggtttaataaatagagctaaaatatttaatgcctagacaagatgttcatttataaagagaacatagacatactcagacctgaataattacataaaatatttctcccaaatatttcttttaatacaaaagttcttaaagatcatttctggatcagaaaaatgggtcaaaattaaaacaatttacaagaattttgtggttagaaagtaatgagtagctgacacaaaagtctctaagacattgtgaaatgaaaagagtaatgcatatactataaccatatctatatttaaagaaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgagaccatcctggccaacatggtgaaaccccatctctacttaaaaaatacaaaaaaattagccgggtgtggtggcgcacgcctgtaatcccagctactcaggaggctgaggcaggggaatggcttgaacctgggaggcaaaggttacagtgagctgagatcacaccactgcactctggcctgggggcagagcaagactctttctcaaaaaaaaaaaaagaaaaaaagaaaactaaagtaatcattagtataattataaagagtatctgccaacatagtttgtacagtaaacatcaagataaatagtaatagcaagataacaagaatcaactctgaaaagtcaaaaatcctttgttaaaaagcagagatatgaaaactccaaagacttgatgcttaaaagagacatacttacaataaaattatacattattaaaaattatgggctggatacagtggctcatgcctataagcccagcactttgggaggccagggcagaagagtagctgccttgagccaagagtttgagaccagcgtgggcaacatagtgagaccctgcctccacaacacaaaaaaactaaaaaattagccgagcatggtgggatgttcctgtagtcctagctattctggaggctgaggtgaaggaattactttagcccaggagttagaggctgcagtgagctatgattatgcttgggccacagagcaagaccctgtctctaaaaagagataagatgccaatatattattactatttgtattggtggttctaggcaatataacaaggaaaataaatttcaagtcctaagaattggagaggaaaaaatgaaagtgtagttattcgtcatgtgtatagaaaccccaaagaatctatagatgaaatattcaaagtaaaaagtgagaattaataatttattaggctataaaagtctcaacaaatttcataggttcacattacatagaatgttatagtggattttattagtttgttctctcattactgtaaagaaatctctggggactgggtaatttataaagaggtttaataggcttacagttttgcagactatacagaaagcatagtggcttctgcttctggggaggccccagggagctttcagtcatggtggaaggcaaaatggaagcaggcatctaacatggcagaaacaggaccaagagagaagtagcagggagggctacacacttttaaacgaccagatcttaccatgaaaaacaatgtggagattccttaaagaactaaaagttaggctgggcgtggtggctcatgcctgtaattccagcactttgggaggcctaggcaggcggattacctgaggtcaggagttcgagaccagcctggctaatatggtgaaaccccgttccctaaaaatacaaaaattagccaggcgtggtagcaggcgcctgtaatcccagctactcaggaggctgaggcaggagaattgcttgaatccaggaggcagaggttgcagtgagccgagatcgcaccactgcactccagcctgtgtgacagagactccgtctcaaaaaataaaagtaaaataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcagtcaatgagtggataaagaaactgtgagatagatatagatatggatatatgatggaatcctactcagccataaaaaggaatgaatgaatagcatttgcagcaacctggatggagttggagagtattattttaagtgaagtaactcaggaatggaaaaccaaacatcttatgttctcactcataagtgggagctaagctatgaggatgcaaaggcataagaatgatacagtggactttgaggacttatggagaaaggctgggagggggctgagggataaaagactacaaattggattcagtctatactgctcgggtgatgcatacaccagaatctcacagatcaccactaaagaacttactcatgtaaccaaataccacctgttcccccaaaacctatagaaataaaaatttttttaaaaagtaattgcagttttacccattactttcaatggcaaaaaccgcaatttacttttgcatcaacctaaaaaataaaaagatctcatgagaacttatcgcaatgatagcaccaagtggggtgatgttaaactatgagaaaccatccctgtgatccagtcatctcccaccaggccctacctccaacactggggattacaattcaacatgagttttgatggggacacagaatcaaaccatataatggaattaagctagatatcagtaacaaatagtaactagaaaattcccaaatgtttgataattaggcagtatacttctgactgaaagagaaattcacattagaaaatatttttaactgagtgataatgaaaatattacatatcaaaatgtaggtttcctgtgctgagagggaaatttttcaccttaaatgcatctcttgaaagactgaaaatcaaggaatagtgacctaaagtattcatctcaagaggttagagaaagaacagcaaaattgaagcccaaggtaggtcaaagtggatattagtaaaactggaaatacctacaataaaattaacaaagccaaaagttaattgtttgaaaagttatttaaattgataagcccctcataaaatcgagatgaattaaaaaggagatattaccagagaatatgacattagaaagagaaggggattttctgaataacttcaccaataagttagagaatttgggcttaaaaatgagcaaattattagaaaaacatagattactaaaattgacacaagaagcagtaaatcagaatggtactatctttattaatgaaattgagcttattactaaaaacccaacaaaataaactccagaaccaaatgtgtttactggtgaattcttcccaacaaaggtagaagtgaaaaccttttaggttgtttataagggtagtaaacctgatacccaaaactaacattttttaataccaaaacccaacaggaaatataagaaagaaaaataaatacaagaaagaataataaatcatgatgagttgggtctattcaatgaatgaaagcaagctaggtttaacattcacaaatcaatgatagtcatcatatttataaaaataataggtaaatttaataaaagtggctagacacaagaattaatgtaccagtgtcattagcacaacattgaaaggatgatctgttaaaaagtaattgatgaatgacctaatcacaagttctgttcttggaaggttaaagttaatattataaaatagagggagaaaatgtttgcagattaatccttgataaaaggacttacatccagcatatatttttaaaaactaaacattcactaattagacaacccaatttttttaattggcagaattttaatagacatggctccaaagaggatatatggcaaataaatacatgagaaacggatttttagccatttgttaaacctctatgggccctctggttccagagggaatttaattaatttttaagttcaaagtaattttgttttttaaaaagtgatttcagctctgtgttttgctgctgttcctcctgtaaggtaatgaatggtctttgtaatccagtgtcccgacatccctaccacccacatgaataccttttctgcgtggccagtagacaaggtcggcaggtggatgttgtcatcttaactggggaatcatgaactggcaagaagggctgttctggcccatggcaaagtcaacactgagtgttctttcccaaagctgcatttttataagactgctttaaggggagaattacatgaaatggaaacaggcatctgtagtggaccatttgaaaagccctttattttcagttgtgacttaaccagctgccatttgtacagcatttgaatcaggagtgagactaagatttcctaacagaataatttgaagactgaaagaattacattaggactctgtaacatcaggaactattttaggggaaggttgtagtgggtttcctatgagttttcacacaaggctgtcatgtgagaataggccatgtgcagtggctctttgggagatcaaggcgggtggatttcttgagcccaggagttcaaggccatcctgggcaacaacatgataaaatcctgtctctacaaaaaaataaaaatagccgggtgtggtggtgtgcatctgtagtcccagctacttgggaatctgaggcaggaggatcacttgagcatgggaggttgaggcagcagtgagccgtgattgtgcactccagcctgggtgacagtgagaccctgcctaaaaaaaaaaaataaaaacacaaaagagaataggctccaaacacgtttaggaaaccagtttttatgtaggggaagtctcaggtcaataatagggagatagagtgaaaaagtcagttagcctgggaaaagaggcttctttctttaactgtatggaggatttagtgagagggaatgctagaagaaggtcaaaacaattgttacagtgtgtcttgtgttatacacaaatatgccttactcaccttcaactaaatgcatgcagtaaaccaaaaggaatgcagttctacctactacctctccccatctcccacccccatgtttttcattcttctaactgaatgcacattgggagagacttgtgaaaaagaatgtaagaataatgtaaagcctttcccagtcaacgacagaaatgaaatgcagttaagtggtagtagctttgtaagacatccttgagtaagaaattaaagactcaactgagagatctaattgttcagttatcttagggttatgaatatagataaaacattttgagtgtttaaggaatttttaagggtaattttaacttttgtctaatccctgaataatttgcaatgccactacactaaaatatggaatcagatctggttacatcaaacttaaacaaatatacagcatccactcttttagcttccctgggtcacactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacctcccgggttcaagtgatttgtgtctcagcctctcaagtagctgggattacagacatgcaccaccacagctggctaattttttttttttttttcagtagagatgagattttgccatgttggccaggggctggccttgaactcctgggctcaagtgatctgcccatgtcagcctcccaacatgctgggattatagtcatgagctgctgcatccagctgaattttgaaagtcttttaattgttttggagaaagaattttctgtttttcattagaaaattcccttcccttacacttagatatcttattatatatctctgatctagtatatttaaaatatgattctgagaatcagaatatatctacttaattctttgaattcaaattcgtttgaagttattgctcctcttacagataaatgcctcagtggattaaatctgtatgttactttggcaagatttgcacatattaagtgattagaaaaagagaactgaactttagatggcttttatggctgttgtttaggaaacagtactgctggagcaccctttcagtgctgtgaaacaagaactgcaaagaaaatggattgaagagttgaataagcaaatagaagatgaccgtcaaagaaaaatagaggaaaaaattatatattcaaaggtaacttatgaggttttgtggctataaaagaaaaaataaaatcaaagtctttaatcaattaaaactagaagtattctgaaactcttgacaagaccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttaggttagtactggtttttttttttttcatcaatttatttctcctgagttctgtttaagatgagaattcattctttgaatagggattgaactagaattatgactaagaaatctaatgcataatggccgggcacggtggctcacgcctgtaatcccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcagagcttgcagtgagctgagattgtgctactgcactccagcctgggcgacagagtgagactccatctcaaaaaaaaaaaagaaatctaatgcataatataagaaaggaggctaaaattaaaattaaaacttcctgtcctgattttagcctaatgctaaagggactttaatatctgcataattcttcaaatcctttgatatatgaatttggcatcattaatgttatgcttagtcagtgagcagacatttgcagagcatctgctacttaacaggcactatgctaagcactgagattatttcttcagttttttttaataccatttcctccagtagccctcctagggttgaagaaaaggcatgtagaacttgacagtacaaatgggagatgggagaaatgcattggaaatttgacatttccacttcacttatataaataatactttcagtatgctgataaaaacttatttctacagtcaccaaactaatgcttcatggattttaaaaattgatatataatgttttatatatttataggatacatatgatattttgttatatatgtagaatgcgtaatgattcagccagagtattctggtatctatcaccttgagtatttatcatttctgtgttgggaacatttcaagtttactagccaatttgaaatatataatacattgttgctgaccatagtcaccttactattgctatcaaacattagaacttattcctttcatctaaccatatgtttgtacccattaacctacctctcttgatcactaccaccctcacacacacccttcccagcctttgatacctatcattccattctttagctcgttgagacctacttttttagctcccacatatgagtgggaacatgtgatgtttatctttatatacctggcttatttcacttaacataatgacgtccagtcccatctgtgttgctgtaaatgacaagattctattctttctttatggccaaatagtatcccattgtgtatataccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggtctcgaccacaaactctataccagtgtcttgaagtgttttccgtatgttttcttctagtaggtttacatttttgggtcatacatttaactatttaatccatcttgaattttttttttttttttttttgaagtggagtctcagactgtcaccctggaatgcagtgacgtgatcagctcactgccgcctccacctcccaggttcaagcaattctccctgctcagcctcctgagtagctgggattacgggtgcatgccaccacacctggctaattttttttttttttttttagtacagatggggtttcaccatgttggccaggctggtcttgaactcctgaccttaaatgatccacctgccttgccctcccaaagtgctaggattacaggcatgagctaccacaccagcccttgaattgttttttgaatatggtgagagatggggctccaatttcattcctctgcatatagatatccaattttccaagcattatttattgaagagtgtgtgctttccccaactatgttcttgacacttttgttgaaaatcagttggctgtaaatacatggatttatttctggattccctattctgttccattgatctatatgtctgtttttataccaataccatgctgttgtggttcctatagtcttgtaatgtattttgaagtcaggtagtgtgatgccttcagctttgttcttttgatccaccttgatttggttattacggctcttttttggtttcatagaaagttttgaattttttctacttctgtgaaaaatgaaggtggtattttgatagagatagcattgaatttgtagattgccttaggcataattcttctgatccatgaacatgggatgtcttgccatttgtttgtatcctctttcgtttatttcatctgttttgtagttttttatgtagaaatgtgtaacccccttggttaaatttattcctagatattttattgttttgtagctattgtaggtgggattgccttctttatttctcagctagtgtatagaaatgctactgatttttgtatgttgattttgtattctgcaactttactgaatttattgatcagatgtgaggtttttgtggagtctaggttttgttttggggtttttttttttttttgagacagagcctcgctctgttgcctaggctggagtgcagtggcgcgatctcatcccactgcaacctctgcctcacaggttcaagcgattctcctgcctcagccttccaagtagctgggactacaggcatgtgccaccgcaccttgtaatttttgtatttttttagtagagatggggtttcgcagtgttggccaggctggtctcgaactcctgacctcaggtgatccacccgccttggcctcccaaagtgctgggatttcaggcatgagccactgtgccagtggagtctagggtttttaagatataagatgataacatcagcaaaggggacgttttgattttagtttgttttgttttgttttgtttgtttgtttgtttgtttgtttgttttgagacagctctgtcacctaggctggacttcagtggcacaatgttggatcactacaacctccaccttctgggttcaagcaattcccatgcctcagccacccaagtagctggaattacaggtgtgtgccaccatgcctgggtaatttttgcataggggactttttattttattttatttattttctattttatttattttatttattttctaatttaggtgccttttatttatcttgcctggttgctctggctaggacttctgttgctatgttgaataagaatggtgaaagtgggcatccttgttttgttttagctcttaggggaaaggctttcagcttttccccattaagtatgatgttagctgtgggtttgtcatatatagtctttattattttaaggtatataccttctgtgcctagtttgttgagagtttttattatttagtgatgttgaattttgtgaaatgttttttcttgtctactgagatgatcatatggtttttgtctttcattctgttgatgtgatgtatcacatttattgatttgtgtatgttgaattctgcctgcatccctgggataaatcccacttaattattgggtattagttttctcatgtgctgttggattgagtttgctagtattttgttgagaatttttgcatctatgttcatcaaaaatagtggcctgtaattttctttgttcttttttgttgtgtccttctctggctttggtatcagggtaatgctggcctcacagaatgagttagggaaaattccctcctctttgatttttttggaatagtttgggaagaattggttagttctttgatagtttggtagaattcattagtgaagttgtctggtcctggactttcctttgttgggagacttttttattaccaattcagtcttattactcattactggtctgttcaggttttctatttcttcctgattcaatcttgatagcttgtgtgtctccaggaatttatccatttcttctagattttctagtttgtctgtgtgtagttgttcataatagcctctgatgatctcttgtatttctgtggtatcagttgtaatttctccttttttattcctgattttatttgggtcttctctcttcggttcttggttagtctatcaagtagcttattggttttgtttatcttttaaaaaatctttgtttctttgatcctttgtattgtgtgtctctattttgtttaattctgctctagtgtttgttatttctttccactaatttggggtttgttcttttctagttccttttaggtacatcattagattgctttttgaaatgtttccacttttttgatataggcacttattgctaaaatttccctcttagcactgcttttgctgtatcccataggttttggtatgttgggtttaaattttcatttttttcaagaatttttttaaattttttccttgactggatgcttgttcagaagcatgtggtttaatttctatttattggtacagttgccagtgttcctctcattattgattactggttttgttccattgtggtttgagaagatacttgatatgaagtcagttttttaaagtttgttaagatttgttttgtgtcctaacatatgatctgtcctggagaataatccttatgctaatgaaaagaatgtgtattctcttaactgttggatgagatgttctgtgtccatgtgttctcatggttcaactcccacttatgagtgagaacgtgcagtgtttggttttctgttcttgtgttagtttgctgagaattatggtttccagcttcatccatgtccctgcaaaggacatgcactcatccttttttatggctgcatagtattccatggtgtatatgtgccacattttctttatcgagtctatcattgatgggcatttgggttggttccaagtctttgctgtagtgctgcaataaacatacatgtgcacttatcttttttttttttttttttgagacagagtcttgctctgtcgccaggctggagtgcagtggtgcaatctcagctcactgcgacctctgcctcccgggttcaagtgattctcctgccccaccctcccaagtagctgggattataggtgcccgccaccgtgcctggctaatttttgtatttttagtacagagagcatttcaccatgttggccaggatggtctcaatctcctgaccccatgatcgggctaccttggcctccaaaagtgctgggattacaggcatgagccaccgcgcccggctgcatgtatctttatagtagaatgatttataatcccttcggtatatacctagtaatgggattgctgggtcgaatggtagttctggttctggatccttgaggaattgccacactgtcttccacaatggttgaactaatttacgctcccaccaacagtgtaaaagcgttcctatttcaccacatcctctccagcatctgttgtttcctgactttttaatgatcgccattctaactggcatgagatggtatctcattgtggttttgatttgcatttctctaatgaccagtgatgatgagcttttctccatatgtttgttggctgcataaatgtcttcttttgagaagtgtctgctcatagtcctttgcctactttttgatggggttgtttttttcttgtaaatttgtttaggttctttgtagattttgaatattagccctttgtcagatgggtagattgcagaaattgtctgccattctgtgggttgcctgttcactctgatgatagtttcttttgctgtgcagaagttctttagtttaattagatcccatttgtcaatttcagcttttgttgccattgcttttggtgttttagtcattttgtccatgcctgtgtcctgaatgatactgcctaggtttacttctagggtttttatggttttaggtcttacgtttaagtctttattccatcttgagttaatttttgtataaggtgtaaggaaggagtccagtttcagttttctgcatatggctagccagttttcccaacaccatttatgaagtaaggaatcctttccccattgcttgtttgtgtcaggtttgtcaaagatcagatggttgtgggtgtgtggtgttatttctgaggcctctcttctgttctattcatctatatatctgttttggtaccagtaccatgctgctttggttattgtaaccttgtagtatagtttgaagtgagacagcatgatgcctccagctttgttctttttggttaggattgtgttggctgtttgggctgttttttgattccataggaaatttaaagtagttttttccaattctgtgaagaaagtgagtggtagcttgatggggatagcattgaatctgtacattactttgggcaatatggtcattttcacaatattaattcttcctatccatgagtatggagtgtttttccatttgtttgtgtcctcttttatttccttgagcagtggtttgtagttctccttaaagaggtccttcacgtcccttgtaagttgtattcctaggtattttattctcttagtagcagttgtgaatgggagttcactcatgatttggctgtttgtctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagagacaacttaacttcctcttttcctatttgaataccctttatttctttctcatgcctgattgccttggccagaacttccaatactatgttgaataggagtggagagagagggcatccttgccttttgccgtttttcaagggaatgcttccagtttttgcccattcagtatgatattggctgtgggtttgtcataagtagctcttattatttttagatacgttccatcaatacctagtttattgagagtttttagcatgaagggatgttgaattttgttgaaggctttttgtgcaactattgagataatcatgtggtttttgtcattggttctgtttatgtgaatagattacgtttactgatttccatatgatgaaccagccttgcatcccagatatgaagccaacttgatcgtgctggataagctttttgatgtgctgctggatttgatttgacagtattttgttgaggatttttgcatcaatgttcatcagggatattggcctgaaattctctttttttgttgttgttgtgtctctgccaggttttggtatcaggatgatgttggtctcataaaattaattagggaggattccctctatttctattgattggaatagtttcagaaggaatggtaccagctcctctttgtacctctggtagaattctgctgtgaatccgtctggtcctggacttcttttggttggtaggctattaattattgcctcaatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgttttacttccaattgtgtggttaattttagaataagtgtgattaagtcctcagaagaatgtagattctgttgatttggggtggagagttctgtagatgtctattaggtctgcttggtccagagctgagttcaagtcctgaatatccttgttaattttctgtctcattgatctgtctgatattgacagtgggatgttaaagtctcccattatcattgtgtgggagtctaagtctctttgtaggtctctaaggacttgctttatgaatctgggtgcttctgttttgggtacatatatatttaggatagttagctcttcttgttgcattgatccctttaccattatgtaatggccttctttgtctcttttgatctttgttggtttaaagtctgttttatcagagactaggattgcttttctttctctccgtttgattggtaaatactccttcatccctttattttgagcctatgtgtgtctctgcgtgtgagatgggtctcctgaatacagcacactgttgggtcttgattctttatccagtttgccagtctgtgtcttttaattgggacatttagcccatttacatttaaggtttatattgttatgtgtgaatttgatcctgtcattatgatgctagctggttattttgctcattagttgatgcagtttcttcatagtgtcgatggtctttacaatttggtatgtttttgcagtgggtggtaccagttgttcctttccatgtttagtgcttccttcaggacctcttgtaaggcaggcctggtggtgacaaaatctctcagaatttccttgtctataaaggattttatttctcctttgcttatgaaactgagtttggctggatatgaaattccgggttgaaaattcttttttttttttaagaatgttgaatattggccccaactctctcctggctcgtagagtttctgcagagagatccgctgttagtctgatgggcttccctttgtgggtaacccgacctttctctctggctgcccttaacattttttcctccatttcagtcttggtgaatctgatgattatgtgtctttgggttgctcttctccaggagtatctttgcatttcctgaatttgaatgttggcctgtcttgctaggttggggaagttctcctggataatatcctgaagagtgttttccaacttggttccattctccctgtcactttcaggtacactaatcaaacgtagatttggtcttttcacatactcccacatttcttggaggctgtgtttgttctttttcattcttttttttctaatcttgtctttttgctgtatttcattaagttgatcttcaatcactgataccctttcttacgcttaatcagtttggctattgatacttgtgtatgcttcacaaggttcttgtgctgtgtttttcagctccgtcaggtcatttatgttcttctctaaacggttattctagttagcaatttgtctaaccttttttcaaggttcttagcttccttgcattgggttagaacaggctcctttagctcggaggagtttgttattacctaccttctgaagccttcttctgtcaattcgtaaaactcattctctgtccagttttgttcccttgctggcaaggacttgtgatcctttggaggagaagaggcgttctggtttttggaattttcagtctttttgtgctggtttctccccatcttcatggatttatctacctttggtctttgatcttggtgacctttggatggggtctctgagtggacatcctttttgttgttgatgctaatcctttctgtttgttagttttccttctaatagtcaggcccctctgctgcaggtctgctggagtttgctggaggtccattccatatcctgtttgcctgggtatcaccagcagaggctgcagaacagcaaagattgctgcttgttccttcctctggaagcttcgtcccagaggggcacccgtcacatgccagccagagctctcctgtatgaagtgtctgtcagcccctactaggaagtgtctcctagtcaggatacatgggtgtcagggacccacttgaggaggcagtctgacccttagtagagctcgaatgctgtgctgggcgatccactgctctcttcagagccatcaggcagggacgtttaagtctgctgaagctgcacccacagccaccccttccccctggtgctctgcctcagagaggtaggggttttatctataagcccctgactggggctgctgcctttttttcagagattccctgtccaaagaggaggaatctagagaggcaatctggccacagcagccttgctgagctgcggtgggctctgcccagttcgatcttccaggccgctttgtttacactatgagggtagaaccacctactcaagcctcagcagtggtgggtgcccctcaccccaccaagcttgagagtcccaggtcaacctcagactgttgtgctggcagggagaatttcaagtcagtggatcatagcttgctgagctccctggggataggaccctccgagcctgactacttgcaaggctccctggcttccgccccctttccaggagagtgaacagttctgtctcactggcattccaggcaccactggggtatggaaaaaaaactcctacagttagctcggtgtctgcacaaacggccgcccagttttgtgcttgaaatccaggccctggtggcataggcaccagagggaatctcctggtctgcgggtggcgaagactgtgggaaaagcacagtatctgggccagagtgcaccattcctcacagcatggcacatccctcatggattcccttgggtagggaagagatttccctgaccctttgcactttctgggttgaggtggcgcctcaccctgcttcggctcgctctctgtgggctgcacccactgtccaaccagtcccaatgagatgaactaggtacctaagttggaaatgcagaaatcacccgccttctgtgtcgatcttgctgggagctacagaccggagctcttcctattcggccatcttgccaacaaccctccatcttctagaatttttatagtttcaggtcttaggtttaagccctgaatccatcttgagttgatttttgtataaggtgagagatgaggatccagtttcattctcctatatgtggctagccaattattccaacaccatttgttgaaaagggtgtcctttccccacttcatgtttttgtttgctttgtcgaagatcagttggctgtaagtatttgggtttatttctgggttctctgttctgttccattggtctatgtgcctatttttatatgagtaccatgctgttttggtgactgcggccttatagtatagtttgaaatcaggtaatatgatgcctccagatttgttctttttgcttagtcttgctgtggctatgtgggctcttttttggttccatatgaagtttagaattgttttttctaactctgtgaagaatgatggtggtattttgatggggattatgttgaatttgtagattgcttttggcagtatggtcattttcacaatgttgattctacccatccatgagcatgggatgtgtttccatttgtttgtgtaatctgtgatttctttcagcagcgttttgtagttttccttatagaggtctttcgactcctttgttaggtatattcctaagtattttatatatttttttgcagttgtgaaagggcttgagttcttgatttctctgcttggtcgctgttggtatatagaagagctactgatttgtgtccattaatcttgtatctggaaactttgcagaattattttatcagttctaggagctttctggaggagtcttacagactcctaaggtaaacagttatattgtcagcaaacagggacagtttgacttcctctttactgatttggatgccctttatttatttctgttgtctgattgttctggctgggacttccagtactacgttgaagaggagtgatgagagtgggcatccttgtcttgttcctgttctcagagggaatgctttcaacttttccccattcagtattatgttggctgtgggtttgtcatagattgcttttattacattaaggtatgtcccttgtatgctgattttgctgagggttttgatcataaaggatgctggattttgtctaatgctttttctgcatctattgagatgatcatgtgatttttgttcttaattctgtttatgtggtatattacatttattgagtatgttaaaccatccctgcatccctggtatgaaacccacttgatcatggtggattatctttttgatatgttgttagattcagttagctagtattttgttaaggattttagcatctatgttcatcaaagatattggtctgtagttttcttttttgggtgtgtcctttcctggttttggtattagggtgatgctggcttcatagaatgaattagggagggttccttctttctccatcttgtggaatagcgtcaaaagaattggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaattacaagtttgggagctacagtgttaggtgcatatatgtttaggattgtgatgttctcctgttggaccaggccttttactattatgtaatgtccctctttgtctcttttaaccactgttgctttaaagtttgttttgtctgatataagaatagctatcctgtttgcttttggtgtgcatttgcatgaaatgtgtttttccgctcacataaacttaaagtttaggtgagtctcctaagagggcagatggttggtaagttcttatccattctgcagttctgtatcttttaagtggagcctttaggccatttacattcaatgttaatattgaaatgtgaggtactgttgcattcatcatgctgtttgttgcttgcgtactttggatttgttttttgtttttgttttttaacttgtatttttgttttataggtcctcctgtgtgatttatgttttaaagagattctgttttgatgtgtttccaggatttgtttcaagatttagagctccttttagcagttcttttagtggtggcttggtaatggcgaattctctcagcatttgtctgaaaatgactatatgatgcttagttttgccaaatacaaaatttggctgataatttttttgtttgaggaggctgaagatagggccccaatctcttctagcttgtagggtttctgctgagaaatctgctgttaatctgataggttttcctttataggttacctggtgcttctgtctcacagctcttaagattctttccttcgtcttcactttggataacctgatgacactgtgcctaggcagagatctttttgtgttgaatttcccaggtgttctttgtgcttcttgtgtatgcatgtctaggtctttagcaaggccagggaagttttcctcaattattcccctaaatatgttttgcaagcttttagaattgtcttctccctcaggaacaccaattattcttaggtttggtcatccgagctctgaatttctttcttctacttgttcaattctattgctgagactttccagagcatttcatatttctaaaagtgtgtccactttctttgagctctaaatttctttcttctccttgttcaattctgttgctgagacttaccagagcatttcacatttctaaaagtgtgtccaaagtttcctgaatttttggttttttctttaagctatctatttcactgaatatttctccctttacttcttgtatcatttttctgatttccttgcattgggcttcgcctttctctggtccctctctgattagcataataactaacctcctgaattctttttcaggtaaatcagggatttctttttggtttagatccattgctggtgaagtagtgtgatttttgggggggtgttgacgagccttgttttattatattaccacagttggttttctggttccttcttatttgggtaggctctgtcagagggattgtctagggctgaagagtgttgttcagatttttttgtcccacagggtgttccctatgtattacgcttcccccttttcctgtggatgttgcttcctgtgagcctaactgcagtgattattgtctgtcttctgggtccagccacccagtgagtctacttggctccgggctggtgctgggagttgtctgcacagagtgcttatgtgaactgtctgtggctctctcagccgtggataccagtgcctgttctggtggaggtggtggaggatgcagtggactccgtgggactccttagctttgatggtttaatgctctatttttgtgctggttggcctcctgccaggaggtggtgctttccagaaagcatcagctgtagtagtgtgtggagagggaccagccatggtgagggccctagaactctcaagattatatgtcttttgtcttccgataccagggtggatagagaaggaccaccaggtgggggcggggctaggtgtgtctgaggtcaggctctccttgggtgggtcttgctgtggctgctgtgggggacggggatgagattcccaggtcactggagtagtgtacctaggaggattatggctgcctgtgctgagtcatgcaggttgtcagggaagtgggggaaagccagcagtcacaggcctcacccaactcccccacaaaccaaagggccagtctcactgtgtcccccgaccccctcaaacgcctgcaacatcccccgagtctgtttccaggtatagggcccagctatgaaagaagacctccccagctgcgaaagaaaacggctttagttcttcccccacctgtggagtctgcaagcccaattcatgcccaccccccaccccccacgcccagttctggcaaggaagcttctcgtcctgttcaagttgttacaaagttcatctagagaagtaattctccctgtggagttttaacccctgctcctctggccaccctcctgatggatccctgtggtgccaggcagggatgggatccttggggatcccacgagctcccagtgtctttctgctacttcctctacccatgtatttcactgggctcggctctctaacttgactcagccccaggtaaagtcgggagcttctcccgcaaagactttcagcttctccagtgggggtgtgtgttcgggagaggagggtctccctttcccacttccacagttgggtcactcacagtatttggggtgtctcccagctcctgcagcagcagtctgctttcttcagagggtcctctaaggattgctggtctgttcttgcagttgatctatagctaaaattcacaatgcaagcctccacatgctgctgtgtctggagctgcaatctagtcctgcctcccatctgccatggtcctcaactcctatttccttgcttttttacatattctgcaccttgatatctgcatatctggtataacgatcacttcttccgattttttgaatttgctttcatatctatgatggtggttgggtaggcactttggctttgattctgggtatgtgcagtagtgtaatctctatagacttttttttggccgaaaacagtatctgtggtatctgtaatttccttggtggcttagggtgcagttgttcgtggaggctgtggtaaagttttgttgtgaacggggacaccaaatggaccagtcgttaggttgcaggatgctagcagtaggctgagcatgcctgtccttgggccccagggctgtatacactggcatcagtggtagcaggtcaagccaggccaattattgggcttctagatggcttgctcaggtgctgagaatggtgacagtgggttgggtgggtgagtaggttttcaagccactgggcagcaaacatgggcaatggcagtagtagtagtgggacaaccctctgggatccaagcagccagtggtggtgttggcggtggctataatgggctgcgtgggccagtccccagacttgcaggtggcatatgagggtgggtgccagctgtgatggtaatggcaggttgattgggcccatactctaggaggagtgctcaggtgccaatggtggtgtcctgggcagggcagtccccaggtccctggaccaatgtgcttggttactggtggagatgcagcaaggctgggcagacctgcccccgggttcccaaggtgttgtgtgcagtgctggctgttgtaggcaggggtgggatgatttcccaggccaccagcagaatgcttaggttggggcagtagcagctgcattgtagctctgctactagggagggtgggtttgctttcagtgggttgctcttgcagatggtgaatgtcagtggggctctagggatgtggagatgcaggggctgttgggccccagagcaagatgcaggaccactagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaagctatgtatggaaatgtcagaccttcacataaagttagcaaagagagaagcttgagaaagttttattatttcacatgatatagttctcaaatgttatattggtttggctttttctgttgaggaggtcaagatgaattattacagcacaaagcaaattacctatgtgcttcatttttatctactcctagtttttttgcttcatttctaagcaataattattatatcaataattattctaggtatgttaagagaaatgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgccttcagatgactctcccaccttggcctcccaaagtgttgggattacaggtgtgagtcactgcacccagcctaaatgattgcctatttttaataccttcaatatacctactattcttgtaggaatatcagactttaaactagtataattttataaataggaatgcttaatttatgtggaaaattgcaataaaagcagaactaaaggttaaaatgtgttaatgttaaaataataggtaaaatgtgtactttttgtgtctatttttaccgagaacaattattaaatgatctccctaaattcagtaactgataggaatgtgggtactttttgtaagaaaatttttattgcagtgttcattctgattaagtgaaaattattgtatttagttgctgctatacataatttttattaatattccttaagtgttgttttatcaggtgatttctctttgccagttgatacaatacaaatggaatataatgcatctaacatttcaaattcaagacatgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggttcggttttgttgaaaattaatgaaagaaaaaagtcttagagggcaataattgtttaatgttttggggaaaattatttaatattgaaaattttgtttacaatttttaaaaatcatttgcaacttttttttagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaaaactatatctattccattgctcagtcagtacctgttattcaaatattaccctcagactatttcaacaagtagccctaaaaatatttgtggggacatgtgaagatgctatatattcctttctgcatttatctatccatattttaggaagaagagcctctgaatattcattcattcagcaaggaaaggtaagtatgcatcagattaattccgcagctacttaatgctttctatgtgggacaaaaaagggattcaagatctggacagcatcatatggtatatgtagagaacaatcagaaagggtgtggcttccaggtgagggttagaggtttaagggatagtgtggcactttagcaggagcttgaaggcccaagttggactgggcctaggcaggaatgtagataacatttacttttatctctagacttaactaagtgattttgatattccaggtatgtcattagcagaataggcattctgctttgggaggagggatggctgggggctgtgaatgggaagaaatgactgataaggacaatgagaaattcagtcagttaatgagagatttagaaccattagaatttttattctttgtgcatgaaccagctggtttagttgtctcagaatggggctctaaaaacaagtttcattcaaatggtgagtacattattgtatggtgaattatctaaggagaaacagtaggctcagattaaccaagccagcactgttcctcaggatctaggaattaaatttctcccttgtgctacagtacacataccatagctagtgctagtaaaaacataaatgaataccattctcttccccggttttatggaacaatattatagagttcaggcttctatgcatacattcccaaaggtgttacaggtacatttagaataaagtgaaatgggccaggcatgtggctcacgcctgtaatcccagcactttgggaggccgaggcaggtggatccacctgaggtcaggagttcaagaccagcctggccaacttggtgaaccccgtctctactaaaaatacagaaactagctgggcactgtggcgtgcgcctgtaatcccagctacttgggaggctgaagcaggagagttgcagtgagctgagatcgcgccactgcactccagcctgggcaacagagcgagacttcatctcataaataaagtgaaatgtgattaaagagatatacttaatctaaatacacaattttttactattttttttttaaataggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacactgccgtctttgagtagttctttccagtacgaaatcatcagacagttctaaaattaagacaagtttattgagtaaaaaaatgcatacattggaacggcaaaacatcaataaggccctaaaacaaaaaatacagttatgctttaacaaattcttagcaatgtggcccacgctttttaaaaaattgacgtgttggcagtgtttgttagaacattgacgtacatcccaaatagtaataaattcagtatgaaattatacgcataaccttactcaccatactactttttctcccaaactattgtgacttctttttgctctctgattaaaacaaacaggtaacatccttacacctttgctccatcccttgggctttaaaaagaatggctgtagttagttttgattcactatatactctctgtacttgaggaagagtaagctgtgtttaaaagtgcccttttccatgtcgtcatgtaccaataccctctgcatttcaaaatgttgactcagatgtttttccctctacagaactagaaaattgtccccccactttggtctatttactcatttgaagacaaacagggttactaagagttttacataagttatttctttagagtgacgaagtgttagtttacttcttgcttagtggagacaaaaattgtgagataaagaggaaggaataggatgtacacatttacccatcaatatagcacccagtgttatttcagcaggacccttctgttagcatctaaggtaaggttaggacagtcaagataaaatactggatgttggccaggagcagtggctcaagcctgtaatcccagcactttgggaggctgaggcaggcagatcatgaggtcaggagatcaagaccatcctggctaacacagtgaaaccctgtctctactaaaaatacaaaaagttagttagttagttagccaggcgtggtggtgggtgcctgtagtcccagccattcgggaggttgaggcaggagaatggtgtgaacctgggaggcagagcttgcagtgagattgcaccactgtactccagcttgggcgacagagcgagactccatctccaaaaaaaaacaaaacaacaacaacaaaaaaaaaacactgtatgttaagggagactccttcagtatctaagagcacttgggggtggactgggggagaagggatgacttcatttacccccatagttatggagtcttgagttctaagaaaattttcatccctattgatttttatgctaaaaacagaatcttacaaatgtgatagctatatatccaaatgaggtggtctagtacaagcatttctgaaaaaatttttgaatgacaaaattttatcctaagcgatatgttttccaagtgaatataattctagtttaacacaacattgcaagtcaggtgtgcacattttactaacaaacatatatcaatgtgatttcagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaa

SEQ ID NO: 1238 - DNA, 64665 bp, Homo sapiens; identical to SEQ ID NO: 1237

SEQ ID NO: 1239 - DNA, 64665 bp, Homo sapiens; identical to SEQ ID NO: 1237

SEQ ID NO: 1240 - DNA, 1468100 bp, Homo sapiens
tgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggtaagaaagtgttggtgcagctcgtggttacttttaccgtttcagttctcaaatgtttccccttcgctttccccctctccggtctctgtgtgtcttgttggaggtggcttcagttcattgccccttcccgctacccttccctcacacttgctcagttttctgaaaggatgtggatgctcgaacctcgactgacttgtgctgttgttttgcagtgattcgtggaatgtggctggatgcgtgggggtctcgagttgacctgagtgtgagtgtgtgctgggaactgcagggggattctaagtgtgtggggaaagggagtttaattgactcttatcttccatattttttttcccggatgtacatttgctccatttaaaaatttatctttgggggagcagagaagctgtcacctgtgagatgaaaagaactgggctggggggtagggggagctcccttcggatcgaacaggtggttttgcaacgtgagccggctgagttcgccgcagcttagtgcgatggtgacgggggtgccggatgcgcccccagccaccctctcttctcacatcttcttggctttatgatccttgcgtgtagtctttgagacggtggcaggaggggctggcggcagtgtcgccaaggactgattgtcgcgtgcctcgcctcctcggacacgctcccggggcctggcgcggcggcgaaactgaccccggggcgcttgggaaacgcggggaagcgaatgcgcgcaggctgctcccgaggtctgcttagcagatatccgccttgcctcgcctcgcctcgcctcgcagtcaactccgagtagccgcgcaaggcagacagcgaaggcgccgggactactgcgggccgcgactctgagaaggactgccgagcgggctccgagatgctggtggccccacctattggcaaccagacgggccgggactggccgcggcgagcaggggcgggcggggggctgcgcgtcattatcatgcacagcgctcgcagcttcaggctccaactctactcacttgctaatccgtgagagctgagcgggagacaggctcttgcagccttttctgcgttaatgcgacgatttctttttcggaaattcgcttaccgagccagcaaggtttctttgctgggctgcagagaggtccctttgggggaatttttctgggcacaggacttttatctgtacgcatggcttggtgttctgcaaattgaggcgacagatgggtcacagcttctcccctttctgtacccctgcttctccaccgcacaacacgcatacacatacacacacgcacgtacacatactcctggtaggggaatctgctgcaggtggcgattgtgcccgcccaagcgagggatttctgtctagcgtgcgcgcccacagtggccagcccctccgctccagggggctccctctcttggtctcagaggctgtctttgtaaacatgtctgccattctctatcatttatatcagtagaactgtctgtctctgtgcaaggggtaatgaggtcaggattcagaaaacctagcgtttgtgcattaagtaagtcaagcactaatagcttgcctgctggatcccgttttgcctgggggctaacagtgcctacagattcagaacttttcagcaagaaattatggtctcattgagtggttcagcaatgttctgatagagttcagaaatgaactatgctccttttagagaaatggcatacatttatatctagttgtaaatgattggagcaggaatgcagatatataatcataatacctttatattcattgtatgattagggatttctgatgtaggctcctcatctctcaggagggaaagcctgtggaagaatgctttttttaaatcgcttattctgtggtctgcatgataaatacattatttacaaatacctacagcttttgctatcccttactagttaaatattattttgcaatgcagtctggacatctgtttcaaaatagaacaaaactgttgtattttttagtttgtatactgttgtctgtcagagtggctataatcacatttaaaaattaactgtgtacaaattacagatttctttagaaagttggttgtatacattaactgtgtatatcctactaacagatatagttacttctgagacaattaatttgacttgaatataattagtacattagatgagataattagctgttttatagactacctaatattgtcatgaggctagcaaattgtttcaaaaactttatcttttataatatatcgaaaaacattaactcctaaattaaaaaaataaaaaatgatgacgggtagtatgtgtgtaattcagtgcctccacccctactctcagcaaaagtatagtaaattcaaaaccgaatgtccatattaaaattgtaaagcaccagttaacatgaattggattagtttccttacttgtttgaataggaaaagaattaattttctttaggaggtgttgccttcatttaaatatttaatgtgagaaatatgtttctggggaaatatattagttcaggactgaaggaatgaatgtgatgaaactggagggaaagggaatatttcacctctagcgatggaaggagatatgcagaaatgaaaggttttcccagcctcatgtgatgtgttcaagcagaaagtagctgcaatatgtagttcaggcaaactggaaagatgaaaagacactgctctaagaggctttttatatattgaattattttggtattgaaccaacttatatatacatgaaaatcatctccttctttctctctttctcttcagtttttacctcatgccggtagtttaataaggtcaattacacattttaaactctaatatgttttgttaaacatattgattcactacagtgatgaaacataatggttaaaccataatgattgaaatgaaaatgtatttattttagtcaaaaatgcacaattttatgattactttgagtttcaaatatttaaaaatatttaatcattacgtatatttttaatacacatccacacacagatacacaaccatatagtatttaaaaatgaatcacttccattgtgatcttctttgccccaattaaagaaaggtcttttgacatataaaaactatgcaattttgaattatgcttctactttgagcctatgcattgattgagtaatttcatcagacccacattacttgattgcttagaagtttcctaatgatctgcatgctgtaggaagaaccaaaaagtcgtgagtggaatggcaatgatactgtgttttatgaggctattcagaagtcgctctgatttatgtagctagaaagctccaaagtctttgagattagccacgctgactgctattttcttcatacatcagtcgtcccacactctttactccctaaacacaacaggagtttagagcactgctttaattcagcagggattaggtggcatttccagtcaactgcacagtttgtgttttgcttcatatcaactatggaagatctcatgttttaacagtttaatatatgctcctttctttatctggttcctgtgctcacagaactgattgtaaattagctgtcctcagttatacatctctacaagggaacactcaaacagtgtacttattcatatattatacaaatcactagcatatttttgttgttttcagtcatagtaaaataccttatgtcaacatggagtagaaaagatgcatttattcatgtttttctcacaaacagatgatactttatcctctgaaatcataatcagctgtgatattatatttgagaaacctaagataatccacagaatattttcactatgagaatgttcaaattaaagtacaaaatcgggtaaataaaaggtgtcaacacattaaaaacaataatagattgtaaatgtaaaataccagttattcttacttctgcactaaggattattttgacaattacagcatataaaagcattcccagaagatgtgctgttcttttaccatttttttttttcagttgactacatgatttgcattggttaatgataacccccaggactcctcaaggattttttggattgtgtaagatgtctcaatgatattttatcctttttctacttatagtagttgtttgttcctgaagttcttgataactgtgtaaacgtctagaatgtactaagggacttggctttactattcttctctgtatcattaatacagttatttgaagcacaattcaagtgtgtattaagttagacaatgttgttattaatcaaagataccaactatgacatgactaataagccattacactaagggcctttgctttctacgccaggtgaaatgtacatccactaaatatctgttataaattttaagccaaataggaataaaaatccaggtgattaacttttgatttattaaaaaataaaagccaattgaaattgttaggagtgatggaagatacattttattccattctgatatctcaggctaattttatcatatggtaattttatcttaaagggccattgcaatttcaaaagcacactttttaatccagaagttttttttcttcacctacacctacgtatatgactttattttaaaaagtaagatattcacatttctattggatcatcatgatattttagattacagacagcatattggtgagtagcaatacttagaatgtattactatagtataatgtttattagaaaatacatttatggcctataaagatatctttgccattaggtgtcactgcattctgagctgtatttttttttttagtactacttgaaaaccacatgaaatatttttaaaaatctcagaaaaaaatgtcattttaatgaggtttgtgatgctgtaagaaaataggtagtttttattttcaaactagaaaaataaatatgatccctgtctcttattcttgtaagaatttaatgctaggacatatcaacacacctgataccctctaaacaaattagattgctagacctagtgatacaattttttttcttatatttaaaataggagagaaatatcttcttaaactaatacttattctctatgaataaaatctaagacacctggaaggatgcaagtgtgtttaatactgctggagtaaacacacattagtgaataaagtagtttgttaagcagcttctaacggtggtagctctgcttacctatgggatacttgaggtcccaaactgattgttgtttttgagacaaaacatatgaaaatagagttgtggggaaaaaaaaacacatggacacaaatacatctaaaaataatgtcaaccattgagttttatgaatgaccatatatgttttcagataatttttgcctggttaattgtatgcattgtatcgattccttgcatagttgcacctccaccactactatcactacaagtaccacaattatagggtttatttgttcatgtaaaactcataactattctcacatagtaatttatttgttttgtaaaaaggcactatcttccttctagcatatttcattataagaataatggaggatgaaatttagggcaacttttaatctgataatttagttttaacattggcaaactcacattattagagaatgcaacactagtttaactgaatgaatggtttgtcttatgttagattttgccctatgccaaagttcattaattattggaaaattaaatgattagacagatgtctaaaagataagaaaaaatactaaacagttctggaattgattattagaacatctatggattcatgtcattaaattggcaaattttagcatattgatgtggacacacatttcagagaatttgacaaacatatgggcaatgttaaggtataataaaaaaaagtattctggattagaatttagaaggtattggactaaatctcaatttataaatagctaattgaatacattggaaagttatttaatttttagtcttcatttttatcaaccctaaaataagatttagactaatgttcatttaatctctaagattatatgaactaaatggagaacaattgctatatttaaggaggaacagaaaggaattgggagaagagatacagtcaagtgtggctatatttaatagctgccttagagtgaccttcaaaaaaggaaatacaaggggaaataaggaacatgaaatcttaattacacaagttaagaactctttaaattgaagatgtctttgttgcaaacaagaattatgtacatttcttcatcaggtattctggataactagtatctgattgagagagctggatttgttttttgttttcgattttgttttcgttttgtctattattagtaccaaggtgttacctacagcatcactcctatagaacactgcaaaattagtgtttaacactaattggagggatgaatagtcttatgtatcaactatcattgtgtatgtacacttgcctttagaatttgcaaactgggagtgcatcaggaatattaacatatgctttatatcactacaaacaaaagtagagtataaagaaagcaaccaattcaaagttcttcactatcctggactcctgcttcaggtttttatgcttttatcctactgttgttcaccaagtagtcatcaatgtgaagctgaggctgagttgaccccgaaagcttcttgagtagatacagggaagccaagtgaacaccagaagctaagcaccaaaggcctacttatggtcttaaatattcttaaatcactctgtagtcaagttccttattaacagatttttaaaatgaaaaacattaggtagtaaattatattacaatagcaatttgcatatgtttttctttaaactaaaataattaaaagtactattttaaaaaataatctcattttattgagcagagtacctgatttttttcataagtaagcttaaataagatatttgcttcattaataaagtcattataattctagaagttaatattcctgaaagtatatggtaatataagcattactaccaacatgtagtatgtgtgctaattgggagaatattcttttattcagcaaacattttattctgaatttactctgtatgaagcattgcttttagtctctaaaattaaaatgttgaaccaacaagctatgtttttgtatttaaggaacttacattctcatggaagaggcaaccagataagaaaatatatgatgtaatgtcaaatattgataaatgctatgaagcaaaatgagggaatgaagggtgacaaagtatgttttcattggaacagagacttgatccaaagaaaggatgtgaaccatgtggatatctgatgaagaataattcagtcagaggatatagcaagaatgacggccatgagataagacactaagaaaatctgcttagtttacttaagaaatatattcaaaggcaattggagtatagttcagtgagaaaagcaggaagtggaagtaaatggggtctgagagggcactgaggaagattctgtagggacttacaggccatggtaaggtatttaaatcttctaggtatatttgggttaagataaaatgtgtgatatgaaatagtttgtattttagaaagataacattctttgcttaagtgcactggatagagtagaagtataaattgacaatagcaaattggatcaaggtggtagcttagctaaatgtacagttatcagattgtggacataatgtgaagatcggaaaaacaggattttctgatagatgagccaggtgggagagatccagagaaagtaaagaggcttccaaggtattttacccaaatacatggagtaaatgtgttactgttgactaatattcggaatatgggggcatgagcaagtttagggtacaaatcaaaatgtgcatttattaaattttgtattagacatcaaacttgagagtttaaattggaagtttattatatgatcctgaaattaagaggtgagtttgggatttgagctgtacatttggggaatatatcattgtaaatatagactcctgtaagaatagtcataatcaaagaatcaaaaaacagtagatgttggcatggatgtggcagtcagggaacacttctacactgctggtgggaatgtaagctagtatagcaactatggaaaacagtgtggagatttcttaaagaactaaaagtagaactatcatttgatgcagcagcaaccccactactggatatctacccagaggaaaagaagtcattattcaaaaaagatacttgaacatgcatgtttatagcagcacaattcacaatagcaaaatcatggaaccaactcaaatgcctgtcaaagaatgagtggataaagaaactctgatatgtgtgtgtgtgtgtgtgtgtgtgtgtgtgtgtgtgtgtgtatatgagatggaatactactcagccataaaaaagaacgaattaacagcatttgcaatgacttggatgagattagagactattattctaagtgaagtaattcaggaatggaaaactaaacattgtatgttctcactgatatgtgggagctaagctatgaggacacaaaggcataataataatacagtggactttggggacttgcgaagaagggttggtggggataaaagacaacaaatatggtgcagtgtgtactgctttggtgatgagtgcaccaggttctcacgaatctcccctaaagaaacttacttatgtaaccaaataccacctgtaccccaataacttagggaaaagtaaaattaaaagaaagaaaataataataaaataaataaaaataaaggaatggaggggaagacgtgcagagagagaagagttccaagactaggtcatttagcattccaaaagtttgagtccaaggagagcagcggatgcaggaaaagagaaatattagtagcctgggagacaggaggaaaaccaggagtacatggtattctggaagccatgtgagaaaagtaattctagaaggagaagtgagaaaccctgttgaattgtatgtatgcaaatggagatttgattgctgggcttgaaaatgttgaggacaaagatgactttaaagaaagtgctcttagtggactacaagtgacaaaatactgattgtagagaacccgaagatttaatagaatatgaggaattctatgagttttgtcataagaaagtggtaaggaaggggatattaggttaagggaaggatttccttttacagctgggcattggtatatatatgtaattttctgaatattcagtcctaagagaattatcagtaaaatgatttaaaattgatacacctttttctttcaacttatataattcctgagtttggatagaaaacgttcaaatagaaaggaaatctgtttttttttctttttctttttcttttataaattggatcaagtgacaccaggccaaacacactgaaattaacctgagagacaagtttagagtttagatttcatttagtttcccagattgccattcaaatttcatagaaattttttatctgaacttaagagcagattacattttacatagtattgctataacattacaaatgtcataaatatttagtcatttggtaatgtactaattccaggaacacacaatatttctattctgttagtggtattaaaatgcataaaattcttgttataatagacaaatttaaatccattgtaaatttcctctgagtgcattctgttatgaatttgatttgcttcaaacatcactttggaaacatttttttaaaaagtttttaatgtgtagagggacaaaaaggatatatgtgttgaggatacctaatccagaaatctaaaatccaaatgccccaacatttgacacttttcaacactgacatcataacacaaatagaaaattccacacctgacctcatgtggtggatgcacaaaattatagaaaaaagttgtatgaaattatcttaccttctggctatgtgtgtaaggtatatatgaagcataaatgaacttaatgtttacatttagtactatccccaagatatctcattgtttatacgcaactattccaaaatctgaaaaaattctgaaaaccaaaacacttcaagtcccaagcatttcaggtaaaggatactcaacgtgtagtaattacagggcaaagtttatcattgcagcatagaaattaaatagatacaataaattcatttggcatatcatattcatatgatttctgtgacacatttaaatatttccttttatggatcttttacttatttgtgctaaacaatggatgatagattttcagtcataggtggacatgaggaaaggaaatgttctaaatttagtaacctcagaattcagccttttgaatatgaatcttagttctttcattagtattaatataaccataagttgtgtattttgattttgcacctaaaataataatatctgtactaaaataagcatgctaatagcaggtgaattatattttttgtgttctttgttgttgtaagtgttatgtcctctataaaaacatttcatcatatggaaacaatgtgatatggatgtcagatggttgtttctgctctgatacatctgttaattgatatgtaaatatggaatatttgaacaatgagagggtaggagtcttatagtttgagaatagcaatgactcacaaaaaaagcaaattgtgttctggctggagcctaggaacttaattgatgaaatacagaacattgaaagatattttctatttactagttcatagcttcttggggtggtgaaatatcatttgaaggaaatgctgcgtggacttaaatccaaacttaagttggaatgaacccctaaaactggtgaagtgtttactatatataacttcaacatcattaaaatgtcatgtcattgattgacttagtatcttaaaatccaaagaccaggtaataccttagtagctttggtgagacaagagaacttagtcctggccatgcacggtggctcacgcctgtaatcccaacacttcgggaggctgaggcgggtggatcacctgaggtcaggagttcaagatcagcctgaccaacatggtgaaaccccgtctctactaaaaatacaaaaattaactgggcatggtggtgtgcgcctgtaatcccagctactcaggggctgaggcaggagaattgcttgaacccaggaagtggaggttgcagtgagctgagatcgcaccattgcactccagcctgggcaacaagagtgaaactccaactcaaaaaaaaacaaaaacaaaaagcaaaaaaaaaaaaaaaaaaaaagaaaagagaacccgttctgttgttctgttgtatgacatttaaagcgaattaaaatccagaagactgattcctgcttctaataatctctgcaatctgacaaccaacaaaattgggttagtggtttagtggcagttgctgtcttgctactcagaatccagatattctttgctgcttctgtgaatggaaataacagaaaccattgaattttctttttagatataccaacaactctcagcatagcccagtagaagcatggcctatataagaaccattatacatttcttcttaaatggtttttcaatttttaacaccttattaatgtgggtgatgcttcatccacagatgtaagagggactgctcttctgttctcttgtggtgtagtcatggtgagttttggacattttctataatccattaatttcaagctgagaaattatgactcaaatctcatattccatttgcagaacatatcaatttagggttacatgaaaccataacgtgacatttttgggtgtgtcaccagattttttttacacctattgtgtggttataagaatacagatcattgaaacaagacacgtttcatatccttagaactttcaggagtatctgccttctaagaaaatattataacattaggaagctgaaggtagaacaattcagaactcccagctgaacgactgtggtctactatggcactggagattgtgataattcaataaatgccatttttatagtagcctaaaggtgccataaaaacatatatttcagaaaaagacatagaaatgggatcaggaggttatcacatacaaatggtctttatagtagaaatctcatttctcagctttctgatggttcaccatattgtagctataggctacaaagtaaatacaatcatgccaatttcagatctaaggaagaattttttattattttaattcttttattttttaaaaatagatgtcagtaattctcatgcaagcttaagtaatgaaggaggaggcgttaagatgtggttatttggtaattaattaagctaatgagatcttttctaaatttaatactgtatatcagatattgcattaagcatgatttcttgggtatagaaaaataaaattgccttttttactctcacttctgaagttaatagtacactgttctttcatattactaatctatcctcactgctgtatgtataaaacatcagtgaaaatgacagttttatgacatttgacatttatgacatttgacatttatgacttttgaccatgacagaataatctacctcatggcagaagtaaaataaagtttctttacaagtggcataactattattaggaaaacatatttatatagacttttaattatataggtgtaattgaaaacagggaaaacattgaaaactgaacataacagattgttcgcaaactaactgtccagtgcttctatttttctccacaagagttcatgctgtggttaataaacagttaataaatagcaaaactggctgctttgattttttctttttatttttcctgtctacccttcagtggcaatactaatgagcagtgaaatggccaaaagcaagaaaaaaggagcaaagggttttagataatctataaaccagaaaatcagtccctgactgctcgtatgcacaggcttgctgagaagaaatagttttattttctcaaaatatcacccagattctgaagatagaacttgctcttggctgctgagttagtgagacaagtgaagcttttgggccaccaaagaagaataagctgaatgacactgactgggagcaaagtgaagaatattatcactgaaaaaaactgccctccaggggtaatgctgctgacaaccagggccccagtgattggctcagttgcttgcatcatatttatggtgatttttaaaaataaaatgcaatataaattgcagctatactacttaaaaactttagataattatgtataaactgggttgtattgatattcctgtcaatacacattgagtcttgagcatctacattgtatataccctgttgacctcctgttgatggtatattatagaccatgaagaggaatttgaatattgcactcttaaaaaggaactgtgaagcacatgacaatgataaatgcaaaaatctgactagcaattaatagagggaaaagggaaggtgatgtgatggagaggtacatagtttcaacattattgatggtgttttatttattaagttgggtggttgtttcacaagtgttggatatatatgtgtgtatatatatatatatatatttttttttttttttttggtaagcaatattatatctgttgttactctgctcacagagaaatcgactggttcagttcacttccactttagttagggaataagttgttttcttttaggcccctccatcaggtaggttggctaagtttacaaccctctttggagggaaagagagtgcatactatatgcctatatgccaggactttttttttttttttttttttttttgagacagagtctcactctgtcacccaggctggagtgcagtggcacgctcatggcttactgcagtcttgatctcctgagctcaggcgatgctcccacctcagcctccctaatgtttgtattttttgcagagggaattttctcatgttgcccaagctggtctcaaactcctgagctcaaatgatctgcccacctcagcctcccaaagtgctgggattacaagcgtgagcaccatgcccagccagcaggactattaaatagcaagtcagagaagaattcaggagtctgtcttcaagcacagtgatccctgtggtggattcaacaatccagttgcctttcgctaccatttagaacagcatctttgaatctttgtttcttatttggtgtaggcagggagctcccttaaatgttcaaatcaaagagaagagaggaaggaatgtacagagggaacaactggtttgatgctatgagaggtggtttggcatatttcgtgttttgaatatttcataatgcgtattttaaatgagaatgtataatatttttgttagtgatattacactacaattattaccttctatctcactcttggataagaaaatatgaacaattattttataatgtatccttagagatacttactcctaagaagtgaatttttcctttatcttatatgcatgttattcttggtttgattaatcaagaataattgataatgagtctaatctacctaaatgatttcttgatattttaatattatgtgtcattcactcccaattcaaagtaagatgtactgtaatgatgaaagaaaaaataccttcttgcagccaattgagcttcatgatgtggcccttgattgaatttccaatggaatagttcattttaatctgtacaaattggaagcaatgagaggaagaaaagtttccatgaaacatccttagaggcagcaaagaggttcttttagaatgtcaggtcattcaggcctttggcctgaggattagcaggggagatgcctagggaagctaataggttctcaacgctgccagaatctgcctcttggaaaatagttatctttaatttttggtgccatttaacaaaatgttgtatcttttgtgcttcctgtctggacaaagcagagaagaaataatactgtcatataagaaggggacctatgtttgggaagtcagagacaatattttacatccctgaatttcaaggactaattcagtgtctggcagaatacatacagttatgaaattttacattgtttgtcacatgtccatatttgctttcaaatcttagtttttcagttttaatcaggaataataacaatagctcccaccttggctgggtcatttttaggataaaaagtcattatgtctgtaaatatgcttattgaactctcaaatatgctgtaaatataagagaagaaatattggaatactgcatttgtggtggaaggtgttgcttaggagagaggtgagagaggttgcagccagtgtactgatcattcttttgaagtgggagtaagtacagaaaattcaatacaggaaaccaagaaagagaaaccatttcgggagagaaatggagttcagttttgaactcaaaatgattttggcataactgtgaagtgtatatctcagacagtggtttcacaatgatcccctttcctgcctcagatggagaaaataaagattatttttcatagtggtcaattctattttgacctaaaaaaggaaacagtgtttttctagtcatctttttctagcttttcctcaaattcaacgttaatagtgtcatttcctatttaaaatgtgaaccatttaaagtatattcagggtacttatgttcagaaaatactaattctacaccaggaggcttatgatctttagttcctgtgtctacttatgtctcagtttagaattaatttcgaataatattacctacttttttttctcttttttttgagacagagtctcactctgttgcccagactggagtgtagtgtcgtgatctctgctaactgcaacctctgcctcccaggttccagtgattctcttgcctcagcctcccaagtaacagggattacaggcacacgccaccaacatgcctagctaatttttgtattattagtagaaagagagtttcaccatgttggccaggctggttttgaactcctgacctcaagcgatccacctgcctcggcctcccaaagtgctgggattacaggcatgagccaccacccccagctgatattacctacttttgaaaatatttcttttttcttagtatttctgttttttactataagtgtacattttaaaatcaaagtctggtcctaatttaagagaatggcaccattaatttatttgctgttgatttccagtcaaaagagttttaaaacagaatgatctttgatggaatcttaggttgtcaaatataaaataaaaagataatttttatttcttgttcataatttcttttatagtttcatattgaatgtataattctcttacataaattaatagaattacatagaaggatcgaaatatgttttatagaattttgtgttctttagttacattttctctgaaaacataattagctagaggaaaggaaacttgtgctccaaggatggcagaagtaaagcctgaagtgggacagagatcccatttagaaccaaactaaaggaatcttgttgggacttcgggcctcttttttccacctcccctagaagactccaccttcattgttaaggacctgtgttttctgataagaaaagacatttgcaaatactgatctgcagatggaagaacgtgaaagcagaggcagtgtgcttgtgtgtgcgcaaaaacactgttcaaactgagaagtgggatagagtggatccacgtaagccaagtgttctttctgtctctttgcatctttgtttagagtctagcttttcagcatgttttttctaatatgtaaagtcagtgataacttcaataaaaacaatttaggtatgaaattattggaacttaatttgaccatctcattcttttttgctcttaataagtcggtccattgtaaaagagccaagagtggaaaattgagtgctccaatgggaaggaagggtctcagcatctttttcttgctcccaggcagtctaatgaatatcaaggtagattaaatataagaaatttagaatcaatggagcataacttgaatgagttgacccagtcaaaaattgtgatgattggtcatttttataaacagtcagagtaggatagagtaggaaaatataagcgttgtatttgatgtcaggcttatatgttcaaatcttgccttggtctttttctacttcctggctgtgaagtccttggatgagtgatggaattttcaaagtctcaaatttacctgctccacctcatctgttatatggatacattgcaataaaatttaaaatatggacttatggactattgcaaataaggttcatatttcaggaaattgaacttgcaacttacatgtactgctaatcagggtcctagattaggcattagaaagtgacatgagaaacatgagatcaaatagggttccctgtttatccctgttcctgaaagatttagatttataactatggcttttctacaacatataaatcaaagttgaaagcctttctggtaagtatgtggatttaaggttaactgttctttcaaagatgatatctcattataaatttacatgaagtagatggctaaaatgtttgctagggctgattctgatgtttagctctgtcttggtggcgacactcttttcttagctttggtctaatataggatgatctcctaaatgtattgtccagtttattgtccaaaccaggactcctttcggaataaaaaggataatatactattaagatagctcttggcaaaggaaaaatgcttgaggtgatagatatcccatttaccctgatgtgattactacacattgcatgtgtgtatcaaagtatctcatgtaacctatacatatgtatacctactatatacccacaaaaattaaaaagtgttgctgttggggtgaaaaagacacatttggactgattggaggcaaactggggcaaataagcaccctagtattagaatactgcctatgggcctgtgatcagcttgaagtttggctcagcctcaatgttcccctaggtatattctctttcaatcgccaataattctgtcttagcagcaggttattctttccttttatgctgattaaagaaacaaattatattttgttttggctatgttttatttttaattacttagaggacttttactttttccttcacaggcagcagaaaaaaggacaaatagctaagtataagttgtcttccttcatataaacatatttaactgatttttaaaaatcagaatctagtgcctgtaattgctccctttattattatttttttgtcctttctccctatctgctaattgagtgcaacttctagcagaactgattggacattggcaattgcatgaattcatacccaacctcaaatgcttttacaagtattctcacatggagtgtactgttttttaaaaatgtaaagatagtttaccaaaaagattaaaatttgctttaccttgagtcccaagaggagaaatcatcaagtaaccaacagttttgatcatttttattttttacagaactctattataaagtaacaatgacttcaaataagatgttagccttaacggttaaggtttcataagtgtatatacatttttaaaaggctatttgttatagataataactataagatattgtcttgcatttttgaattaattcttctctagataccatgttatctaatttattcaacctctacaaacttttgtctcaggtgtgccctttctgtttcatgtagaagtcattagattctcctaaaagttttttttcctatctctgttccaaagtccagttttacctgaagaaatgattgtgtggtagcctgcattggtctcttcccctcattctcttgctctttcattgctggcctactttatgtaaaccttactccttgttttacttctggcatcccaggttttttgtggtcttatcactttctatgttttccacatgaaactggctttgagagcatcattctcacactgtgctctgaagcttgccaccttcctcctttcttcttctctggtgattttggcctgatccttaagtcactttcctttagaaattacatgatcataggctcattcatggaaagactgttagagattgtccagagcctaggaccctcttttgctcatgagcacattgagaggttaagtggctcaaatgcttcacaggtaggaattttttgaatactctatgaatttttactaaaaataggaattatattcatatcatcaaagtaatattaatgtggcctattaatgtgggctatctaggagatagaaatagcccgattatgtagaatttgttaattgttttcattacatgggatccatttttacctgtgctctactatattgtattagagtacaataattaattcctttgaagcctattgaatataatgtaagaggtaactaacccagtgtttggagaactattcctacaacctgctaggtgcagtgaatatatcatcctctaggtttctcacagaatttagaacccagcagagtttactccagttccaaatcctatttcttttcatgcagatccaaacccttttccacagcttgcactctccactcttctttcctactgtctctcctgcccatcctttctctctgtccccaggctcagattggaactcttttcttcccagattaactaaaattaattcagtgtctatcagaaacatgtcactatgtatacatgtatttgcttgggaatattttaaattggtgctaaatgataattttgtgttgtaatcctcttatttgcaaaggctacataaaatattcttgattatattcttgcatagcctataacatgttcttaggtttcctatgctatgtttatcctcaataataaacttttatatacacatacatacatacagacacacacacacacacacacacacactgactttgcacagcatcttctgtatcactgtaggaagccttaaagtaatactaaattaacaaaaagatgtgtatattgcaaatgcaaataacatctctatgatttattcaaattatagtgaaaatctatatatgctgatatggatatgcatttgtcaccaggactggtttgttgaaggttttaatagtcaaacatagtttgtaattatgttaaaaagacatgagataatttttcatagttttcacatatcatttattgaacaaataccattgtaataatattagtggaaatcagagttcaaaattatcacactatgtaagaaaaatctcttccaaaaatccaactatacaaaaaataaatcagctttgcttttacatatttccttctgatttcagtctttgtgcatgcacaactgagcatgctgtaatatatatacagtatatgattatatgttatatttaggcacccatctctatcattatttcagtagatgttactaatcttggagctttaattgttaattcattgaactaaaagtcatggagcttgtcacatgtgtctcagctcaaatgccattttacccaaattttagcacttatggacaattaattttaaccttctttaccgtagtgtttttatatgtaaaatgtagatatgaccacctagcttgaagggtcaaatgaaaaatacattaagtaaatgaaacagattttgaaagaatgaaagtgactggcccacaatgaattttcagtcagtattagctttccttcccctttcttctgtgccttccctcaaaacttcataaatataataaatgtaatagactttatttaaataattgtacattttacttcagtctgttttgtgcacatttgccaaatatcttgaggctagagttaattgatttttgtaattatgtcaagtgaagaaaactgcctatgaatatatgagttatttatattcccattttcaaactcaaacaaagagatttgctattagtttaacatgacagaaaacacctagtacaaatttttgttattttttttattctttctccttttggcttcagaactttcataaaataggaatctttccagttactgataaacccataatctttttactgcttggactcattttaagatataactcttctttcatgaccatttaactttatacttttatatctttaaagtcataatctcttcaatctatattgttttctgatttttaatgttcatgtttcagcaatcaattcttaatttcttaatttcttttaactttatttaaacaattatccacattcccgggtctactctttttctaaaacttctaatatatactgtactgaaaagtttgttttctcccatgtttatgtaagataattctacacatgaaaagtatgcttacatgaaaaaaaatagagggagatagaagttacagggatttaggtaagcatttaattctcctggcagttttacatactggaactgatttaccaactgttcttttataaaattaaactagacttgtctttcagaattgagctatcactgcaattttaatcaacaaaactagttcctagatttataactgattaaaggtcagtaacttattgagacatttggaggcaaatcagaacaatgagcataagtacactgaacataagtccacaatactaatttaaaggcattttaatgaaaaatgacttttattgtattgtagatttagaattattattactaaaatacagctaaagtatttctatggtgtataaaggattactgaactagtttgcccacctttggtgccactatcatgaatgtaataaataaatacagtctccttaaccctactttatctgttagtaaaaatacccagtgggattctatagaagtatagaatatatagaaaggataaagtgaaaatgactacatccataatctgtaatgaaaatgatttattacttgttattcatggtcacctataaaaaccaaataatcagagtaacatttattaagtactcacaatatgccaatcattgttgcaagcactttctaggcattatctcattaacgtgtagcaataatcttaataatgctggtgttatacccattttgcagaggagataaaggaagttaaacaatgctatataatttgcataacttctctgaggcacagaagataaataatactgtccgatatctgtgcttatttgtccccttattaactgtgtcaagaacagttttcactgggtttgtatcctttccatgcatcctctgcacttcttttttcctcaggtagtccccttgccaacaagaagccacattctttcctagagccctctctgattttctgatcactgtgatccaggttactccacacatttctactacattgccacattgtagtgtttggcacctctttgctgccagccgtaaaaaatttaaaaaaggcaaaatatttcttctactgagtggtcattaaaatatcctagtttttgtttcttttttggtgctttacaaatagctataattttaaggtagcttttgctgcatcacacaatgtcagtgattactctgaaatcactaataggctcagtgtctacccctttaagtatctgttcacttctctccagtttgtcagtatcaagtagttgaagctagcatgcactttatttcacattattcctagataattaaatatcagtttttaacaacattcctgcctgtaatcctagattttgtgtgtgtgtgtgtgtgtgccttctcaatctctagtcccaagttaaacaatttcactcagatccccattttagagtgtaccacatggtagggagtaactacacatatgtcacatgtattctatgttttatctttctttctaactgagagataagagtgcttagttagccatgattccttggcctagtgttatggaaatttgccagatctttatagtaaactagcccagtcctacataaaacatttaaccaatattcttcccttattatgaaaaaaagattaaatttaattatttcacagaaatatttcaactgttatagtttcacatttttaaaaaataaaatttttagaacatatgtttcaatgtgtttcttcctgaaattttgttgtcctctaatccgcaagacatttcaacattgtttctgaacacgtattctttggctgttcccctcacgtagagaatagaaagaaactaaaaaagaaattaacaatgattaaaataatacatgaaataggaagttaagactatagtgcattatttacagtaagtcatttttatttggtaagatgatgcgctgtgttaaggtcatcaggaaaggaaaaaaaggaaaacataaaagattatttttaccattatattttcagtttgcttctaatatatgttaatgtataaagtgataaatgctcattcatttgaaaaggggctatataagatagagacagggagaaatgtcaaatgtcaaataatagcaaaaacaaataatacacacattcaagagggagaatgacctttagaatgtctaacagctgcatgtggtctaggtctctgctggaacaggataaggactgcatcttatgccatgttaaatgttcttctctgcaggagtaccagagcaggggaaaggtgcaagagagtgacaggtcatttcagctaatgtcagccagatatgtggactttatcactaaagataccagagatttatggaatggaacactttgaagttcagccagagtggttgaaaataaacattcagaagtaatcacagcataacggacttgcgttcattaggaaaatgatgacaacttgtttctgttatatgtggttatactcctaccatatttgcattaacctctgctagcttctcaagtaatcatgccaaggacactggtatctctttcactagagacgatagattggattctaaatttactatagcattaaacttgtatttttccctggattgttcttgaattttcttgttttgaaaggtaattttatgcccgtgatcacaaacagcataataaaatgtaacctgagaaaaacctttgttagcttaaggaactaaaaacaacattattttgtttttgtttctgttgggtgttcggaataaatttaaaaagcagaagtacctgtaagaaatgaatcttttaggagtgtgcttttctaactgctacagctaaggattagttaatacctactgggaagtgttttctcaatattaatttctgttttcatgtttcctctttatgtccttgtaaattatttgttcatttttatttttagcagaaaagagaagattggacttgaagctggaataaattattatttcacattatttttaaataatttactctctggatgtccctagtctcctgggtagagtttgctctgtgtgcacgtgtatatatatgtgtgtgcacacgtgcatgctaattttacttcataatagtcattttttccatgtctagctttcactattcaagattattaaccctaaattgttaatattccaagaataataattccaaatggttaagcatcacaagtggaatagtaccaaaattcttaaactttttttttctgaggttctgatcctctaggaagctgatagtacagaactgtgcttgctggcttctttttaagccctctctatttaaactttggagtttattataaaaggaaagaaaaccaaagatgacatctacatactttatttccctattttagcttccccagagtcatgctgaattgcatgaactcaattcaatcatattgatgtttctccctgcttgctcacttttaatactcatttacttagtgtctgtcctgttggtcatttgtaagataaaattggcagaaaattttatgtaattattatttcattgcatttaaatctcatcctgtctactttatagagttgttaggaggcccaaatgaaaaattgcaaagcacaatgatatatattgattattttgatatttagcacattttgtagaatatctacatatgccctgggtaaacaatgataaacaaaatagaaaaaacactcaaaaatcttgtcttcctgcagcttacctctaaaatggaagacaggcaataaaggaatgatgacatatggaggtctatgaagaaaaaacaggagcaaaatggggtagagagtgatagaggatatgaatttagattagggggccaatgacattgtgtctgaggaaatgacatacaacagagactaaaactaagtgattattcaggaatagattattctagtgggaagaaagagtaagggaaaggagagaagagagagagggaagagaaaggagaaaaaggaagaggagtatgggaggaaagagagagagagagagagagagagagagagagaaacatgctagacattttgaagaaccagcaagaatgttagtgtagccaacagtgaggcaggcaaaggtgagtaaggtagattagttcagggaagaaaacataacattatttaatccattgtgggccacattgcactatgataacactatcatgtcatagagtctcaccattgtttaagatgtttaaattttttaatacgaatatattctcacaccctccgttttttagtcaaaaacctctccctgaatatcctgacaacatgacagaggatctgctgttcctcttcagagttagtttccttgcttggaaggctccttgacagcagtaaccagaatcttgcagtggtttggatggctggttttagtagtagtgacctctgtacaagcgtgtctcactttcaatggaatgtccacaaggcacagattacagattacctctacatgttaattggatctatcatactacttgggcaatatttataaatagagttggtaagatttcaagaattcctcccctcaagaaagaagaatgcttagataaatttttattcatagagacaataattggaaacgtcttattcattattccaaaaagaatcttcttgtggtttctataaacaaagtagctaatataatataaacttaagtttaaacttgactttatattatttcttttgtgaaaaaccattttatatatatacatgtcattataaaatatatatataatcatatagcctgtgaattacagtggaaattctaagttcttgaaacaaatttctagctagtaactaaagagaaattagaatgtgaaaaagttctgaatttttttcaaactcatcttctcaaatgtatatgaaaatgatctcaaattaggatatttacatttctaggaaaatgtggtgtcctttaaaagtatgcactggaatttcacttatcaaaattcatttaaaaactctttattgagcaattactactctgttcaaggccatgtgttattcactgtggaggtactatattaaataaaattgtagagtttgtcctacttgtagttcataggagattgagatgtataaagaattgttgcaaaacacagatcatgcagtttgaatcattattgccaaataatgtgtcagactgaccttgatttactttttgaataaagttttaaatggttaaaatatattttaatttctattaaagttagcacaaactctatatattatttttaagtagaaaggcaagagaaactatgtgctaaccacaaaaagtgccagtggataagcagtctgaaatttagacattagaggtgaaattcaggttacggcacttagcccgatctgtcttactttagttagctgagcattgatctgtcttctagtatttgtgttaccccagaaggaaaagaatttgccttacatattttgctgctcccatgaggaatggcgctttgcttttcttttattgagggtaagcaaatacttgtgaaataatagaaagataggaaaggaggaaggaagaaagggaatacatgcagacacacagtatctactagtttttcatttgttatttcttctaaattcagaaaactggaatgactcaatagctgacacaatttatataaaaaacagtcaaattgctactgtttagagagcagaccctattgagccagacaatttttttaaaatcctggtttacataacactgtaatcttctacattttaatttatacagtagagttaattcctatttcattggacttttaggcttactttgaataagatgaggtatttacaaatctaacacacaatagaggcaggaacacctgctgcatgatttcctagcattattttcccctacctctttccagtatgtcctgatttcactgtggatatctacagatattgctgcactaggagtacagcatgtgacccagccttcattaaaccattgcatgtgattctcttgtcagtggtagttggtaagggggtcacacatgtcctaaactggcagagtttcagagagtctcagaaattatgcttgaagcttagaaacttgaacacacgtttacccattttcagtgatagtacttttctcagtccctttctgctgctataggataatatcacagactgggtagtttataaggaaaaaaaaatttacttggatcatggttttggtggctgagaggtccacgattgaggggctgcatcttgtgagggtcttcttgcagcatcatctaatggcacaaggcagaagggaaacagggcattcgtgagagaacaacagattgaactcacagcctcaagccccctcataatcagcattagatcattcatgaaggtggagccctcatgacttaaacacttcctgttagaccccagctcccaccactattgcactggggaataagtttccaacacatgctttctggggaacacattcaaaccacggcgttccacccctggtcccccaaattcacatccttctcaaattgaaaaatatattcatttcatcctatagtcccccaaatcttaacccattctaatatcaccttaaaaatacaaagtttaaagtttcatctaaatcaaatatgagtgagacttaaagcatgatttattctgaggcaaattattttccatctgtgaaattaacaagttatgtgcttccaaaatacaatggtgggataggcatagggtagacatttccatttcaaaggggagaagcaggcaagaagaaaagaataacaattcccatgtgagtccaaaacccaacaacgaaaacaaaattcttaaagctgtggaataatctcctttgattccatgttgctcatcctgggaaaactggggtggggttggcccttaaggcctcaggcagtcctgtttctattgctgtcctgggctcagtccactcagcagctctcacagatgggagttttgttcctgcaagtctacttggctggaattgtactctgggggctgtatagttctggggtcttgaaggcagccctgcctcccatggctccactaagcattaccctagtggagactctctgttgtggctctattcctgtaacaagtctctgcctggtctcccaggctgtctgagacatcctttgaaatctggatgaaggccagaatggccccacagatattgcattctgctcatctgcagagtcagcaccatgtgttgcttgtgtgtacgtggtgacacaagctgcagctgagcccactggagccacgattaggggtcagttgagccaatgttctggtggccaaggaacactgcactggaatgtagtgggcagagtaccaagctggccatgggcagtgaatgctgaggccccacaggtgcctttctggaaactttgtcctcaagatcttagtttgcctctaagatctcagaaatgcctttagggtcattctcccattatgttgaatagcacctgactgccttctatttgtactaatctttttagcagatggttgcttggacactcttggtttgctctcctaaataagcctttttcatctttacatggccaggctatgaattttctaaatttttcccttctgcttcccttttatttataaattatatctttaaataatttttctccatttgcatcttactatacatggttaaaactagacaaacaacttcttccgtattttgtttagaagtttatcccaccagataccctttttaaaaacatttcatttatttagttagatatggggtcttggtttgttactcaggctgaagtgcagtggcatgatcattgattagcatcaaattcctggtttcaagtgatcctcctgcctcagcctcctaagtatcttggactacatgcatgtgccaccacatgcaactaattttcttttcattttttagagatgaggtctcactatgttacccaggttggtctcaatcttctgggcccttgcaattctcccatctcagtctcctgagtagctgggattataggcacaagctacctagactggctcccaccaggtatcctggttcactgctcttaaattctgccttgcataaaatcctagggcctggacacaattcctccacattctttgctactttataacaaggatggcctttactccgttttgcaataacttgttcctcatttctgtcttagacctcattggaactgcctttgccatccatatttccaccaacattctgattatgaccacttaagtaatccctaagaagatttaggctcttgttacagctcttgttttcttcttagcccttgctggaattgcccttaatgttccatttatagcaatctgtgcttttgttagcctactccttcaaattcttcctgcctctatccattatctagttccaaagtcacttccacattttcaggtatttgttattgcaagaacagagatttatttcttatagttcttcaagttgggatgctcaagagcatggtggtggtatttggtgaggacttctgtactgcatcatcccacggcagaaggcagaagggcaagagcacatgagaggaagagagcaagaggagtctcaactcgtttttttttttaacaagcccactctggcaataatgaacccactctctttataatgacattaatgcccacaaggtagagctctcgtgatgtaatcagctcttaaaggtcccaccactcaacactactacaatggggactaagattccaacacataaattttgggggacacattcaaatcataacagtactgtatgtggatgaaaaacctacacttgctctctctatcttggctttcagcctgacaacaaagccagcatgcagaacagagctgagccaagaaaatcacagaggaacagagccaagttttgatagtactgtgaacctctggatcaaattgtgcctggagcctgccctccctctagagttttcattatacgagccaataattttctgttcaaagttgatttagttttcttttttattctacattaagaatttgaactgatacaataggtagtcaataaatctcagcttcatgacctcttcagcagttgactactatattggaaagggtcacattccttgtggctttttatcttgttgtttgaaagaactgtggtctaagaaaaattatgtttaaagttttaacttcagagttagcatcaagctacaccctttgcagaataagagtggtatattacaaagtttggcatgaagttactctcagcctgagtgggttggaatcccaatccttttagacacttgctgtgtgacctacagtgatttactcaacatatcagaacttgttttctcatcacataaaagatcttggtattcttttctcacagatttattgtcaaataagagaattgctgcaaagcactgagagatttgcccagcatgtaatgaactctcagtaatcattaatcattattatgatttatttttctttcagtctgactttggggaaaagttatgttaggaagctgctgaatctcaattatgattttcagtattaagcaaagaaatcacaggtatcttgtgttatgagtaagtcaatgcatttcccaattgatctgaagcactttttcttacttatgcaattaaaggaagtctaaagtatacaataaaaagttatttgtattttaaagggtataccattactggggaatattttctgccaaataaaaaataatgagttactcagagagatggttgaatgactagacttgaatggtaataaaaagccaaatgccaaatttgcacataaaaatcatcttagaagtgtaccctgagtgattgattccaagcattggtttatctgatgcttgagaagtcaataattgaatagtttttaaagagctatgtggtggtccatggaaggaaagtcactgttttttactttattttatgaggacaaaatttatgtgtatacactgacaaacttacaaatgcaaaaaaattaaattgctgcataattttattatttagggataagaatggctaacattataatgtatggccttgattttcattacatacacacaaatatttgcggtaatgtctatgttatacaagtacatatgtgcatgtgtgtacacatttatttgtaagtaatttagtgttctggcttcatgtatgcttagtaattcttagatgtcataaggacaccataatcttcatatatttagaactgatatccttttctaacccctttttcactcaaagcttcattatgatgtctgtttcagtgacaggcaacaacatctagcagttgggaaagccagatccctataaaaatgcttgaagcctcctttattctccaacctcctaaccaattaaacatgagtcccattgtttctgcttcctaaatatctcaaatctgtccattcctccacatttctacacttgatcttagccaaaaggttaagaagcaatcgttcctccacatttctgtactattccatagccagagttcccatcatctctgactttggctgctgcagtaacctcaaaacttgcatattggtgtccactacccctactcacctattctcctcagagtaatttgagtaatattttaaaaattaaaaataacatcatgtccctactgtgcttaaaatctgtatcttactatttggcctccatgggtcttaagataaaacagtaaacgttttacatgacttataagtctctagatttttagatctctacctcctcaccaaccattgctactcttatcttttgcttttttagtttctcaaaggtgtcatgctgcttcttcttcaggaccattgatttttttgcttcctatatctagatgactcttgaaacatcacacccatcatgccccacgattctaatcaaatgttatttcctcactggagtctttttggctttacggaccaagtcaggtctttcgttgttgtttttttttttttttttttttcatgaattttgcttatacttcacagcatttacctcagtagaaattaaaatgtgggggttctttgaaactttatataatatgtctctcatgctactatatacttcacaaggtcagggactgtatcttaacttgtcagagccatatctccattatttagcatagactttgctcgtaagactgcacataatcttttgtccttttattgtttcataaactctgtcttatcttttctaaaataatgtttttaattttggattgttgtttcactgttaagatagaaaacggtttatttaaccaagccccctgttattggacttttaaattatttttgtctacttattataaataatattgcgatgagttcaggaattcattgaattaaaggcattgtagcttaagttctctacaagcagagcctgagttggagattcttgggtaagcaatttattgaggaatgtgcccagaagaaaagtgaactgagtgaggaaagcagaatagggcagaggtagaagctaagtgtattagtctgttctgacactgctatgaagaaatggctgagactgggtcacctcagaaaactcaacaatcatggccgaaggcacttcttcacaaggctgctggagagagaagtgagcaagagaggagctaccaaacacttatgaaaccatcagatcttgtaagaactcactcactatcagaagaactgcttgggagcaaccactcccgtgatccagtcacctcccaccaggtctctcccttgatacctagggattaaattgcccaaggagatttgggtggggacacaaagcctaaccttatcactaggcaaataaatggttccagaagaagtctttcctgagccagattccaacgaggtatctggagtgaaaatagcaccacagtagttatcactcttagaaactaagcatctaggctgttacatccattattctttggccatgaactgcctgcgtgtgtgcatatgtgtgtgtctgtgtataagtgcacaggtgtaaacttacagtggcttgcctgtacatgggatctagaagaagcaccaacagtatctggtacaaaaaagaactagggatgctgcatggaagagatttttcttaagtattaagccttgggacatggtaggattttgatatatacttcagagggaaaatatgttctgaagagaaaaaacaaaagcacaataaggaaagtgctgagcatgttttagagaaattgaatagtttgttataaataaaatagaggtaaagtgaggtgtgagtatttggagacaaaaattataaagacggattgtacctataccataaaataacttaaattttaaactttatagaatatacattgtgaacagaaaagtttttcaatgaagagtattcacagatacattgcattcgtataattttgggttacttttaaaggtctaaatattgtctactgacacatagtttcttacagtattaattgagaaattatgatagtttaagtaagcacaaaattatataacattgttcctggtgttgagactcttacaatataggaacatacacaaaaacatacacacatatttgcatatatatagtatctctcagttttatgtgtattaaattcatgatacaaaaaagaattgttctgaaacatagctatctatctaaaacattgtatggtaaaaattcataaaacttacgtctatgttcctaaatgtcataaaaacaattgaaaattcatttttaaaggaaatgacatgcaaaatagtgtaaagaaaagcatattttgtgtacacgtagaaaatcttgtgttcataaacattatttaaaatcttaaattataatcttgactcctaaaacataaatctaatatttagttattctcaatttaatttttctcatttgtaaaatgctgttggacactctttattttacaggaggtgtggcaattgaagttaatgagttaatgtttatagatgctttttgaggcctttagatgaaaggtacaatataaatccaaaatattaatctttaggtgtgaaatactctaattacttcccattgccatagggacattattggagatttataccttcctctaaaatacctggaacaattgttatatgagaaagcataattttaggtgaaccattataattctgtagtcattaccatgtatcaaaaaataaagtatatgtgttatatattcagcaccttcttatttcccattattcatttattgatatacaaacattaagatgactcggaaagctgatccattatgctgttctatctatgttgctgctagaatcttttttatatacagaaataaggggaaaatatttttaaaaagaggttgagagagcagctactgtactccatatattggttttaacactagaccaattcaatattcattaactatcctatgatagcaaaggaagaaaattcgtcattgtagtagtattcttatatttaagtaatgaaagtggtaccatttatcgactatatatatttaccaggcatggtgcttatcatatttcatacattattatgatcctcatagtaaccctataaatggagatggaactgtggaatttaaacatgagcaaaggagacaaacaacaggtaattaattagctcaaggtcacagaagatttaaacccaggcaatgtagaatcctgagttttttctttaacccctgaagtatactaatttccccaaatgctaccactttattattctgtttatttcactgttatggatcctactgaatctagactgcacaagataattttaataacgaaataaaactcgaagaagttctcaccagaagcagaggtttcccttgccaagttattctacatgagctgcttatctggtttcttgccaaaccaatatgcataaacactgaaattgcagaaagaagaatgcaaatcacaaagctcgtttttattaggctcatgttgaaaacacataactgagcttagcacgtgtaaactgagtttaagaatggttgtggcattttcttgaaaactgggaaaaaatattgtatatttatactccacaaagtaaaccaaaaatatccctttgaagtatttaaatgaacaataaaaaataatgtattatttaagataattataaaataaagctattacttgtgaaaatttggagaaattatgattctagtttaaaagtggtatctcctttctcctttctttctatttcgctctcccacctcacccccatcatctcccatatacttgtacaatcacaatcaccgttcatgtaaatcaaatttctgaaaccaaaaacgaggtcttattcctgctcagtccaatctatttgccacattttcccgcatgagtgtcccaaagtaaatttgtatgatgttatttacagcatctcagagactccatcaacattcaattctgatcttggtgcacaaagcccttcttgatttggcacttgcttaatttccagttcactcctgccactctcagatgtgcttcctgatctttgactttccctgtagaaatgctacctgcttgttcatggcttggtgcctttcaccatgttgttctctctaactggaattctacatgatgaacacctactcattgctcaaaattcaatgtaaataaatagttctctgagaagtgtttctgaccttctccaaacagaaggatgatcacccctgtctagacgcttgcatagcactctgcatttactatattgaattataatttttattcagcatattgcattgcaattacttattcactaccatatttattatcagcctattaaaacctgtgcctgtggcttattggtcttgtttaccatgactggtacagtgcagagtaatgtctagacagttaaaatgggaacttctctgtctctgagtttttttctgagaccacaaagcagacaacagtatgggtcaagtatttttacattttagactgtctatatgagcttgtaaagggggttcttaaaccattcctgcagttttgtgataagcaaatattataaataagttaagttctaatacaatatcacctcagtattatatacaaaagggcagtatctagtatataaaatataaaatgtgtatactatacagtatatggtatacagtagatagtatatataaaagcgcagtaagctgctgcccttttttatttaatatatgtggcttatacatttgatggtgttaatttttcaaatcaggttagaaaatcttatcagtctgctagcacacttcagttttgcacctttattacttctgtcactgccatgttatgttactattgaaaataagccctgtatggtccaatgtgtcctacctaatgtggatcacttgctagtttagattcctacagcaagagatggcagttctccactgactttctaaggcttcagagatttttttcagtttatattcatatgctcagctatttcactgaaaaatgatgccactaaagtctagagctgcttctacccccatccacagcctacattgcaatccagcttccccaaggccactcaataataaatgtgatgataaatctgttacaagcagataaacacttgagaatcaaggttcatctattggacacctatggataaatgagtatttggggtatttaaaaaatttatgtggcccagcgtggtggctcacgtctgtaatcccagcactttgggaggccgaggcgggcggatcacgagattgagaccatcctggctaacgcacggtgaaaccccatctctactaaaaatacaaaaaaattagccaggcgtggtggcgggcgcctgtagtcccagcttcttcggaggctgaggcgggagaatggcatgaactcgggaggcagagcttgcagtgagctgagatcgcgccattgcactccagcctgggcgacagcgagactccatctcaaaaaaaaaaaaaaaaatgtttatgtagcaacttgaggataccaagatggtcatccattgtaccttgctggataatttttaaattgaggaataacaaacttatttaacattttattcattaattaaaaaatatttattattgtactactgcgctgggcactgagaattcaggaatgaacaaaatattccaagttgctatgctcagggaacttacaatctatttggggagacaaaaaatgcactaaaatgtaaatatgtatgtgtgtgtatatatatacacccataaatatttatacacatatgtatgtatatgtcaatatcatcaggagacttaacatccagttggagaaaataagttatatgttaaataaaattcaacagttaaataatgcatagaaatataaaataataattaaaagtcccaagagagaatggattttggtgtatttgtttaaatagtgaaactatgaattaagaggatgtgatcactctagcttgaaagggttattgaaggaaaggagacttgagcctgaagaagccatataattagagaagtcagtgatctcatcaatggctcattttagttaaagcatttagaagcaacagtcttacattagaactctagaatgtttaggaagatttactcataacctatacatatcaatagaaaggtgttcttggaaggaaattcattaaacaaaatctgatacatcaactaagactcaattctgagtgttccttcatagatttctgcctaaacaattttggtggagggaattttcagtaacaccataaagtgagtatattgattgtcactgtgaagaaaagcatacagattttcaggcaatctgttcattgatagatgtcttaataaacttcaaaactggcagctgcttcccaatatcctaatattactaattgtgctatattctcttcgtcacaaactatatcctgggaatgagttgacaacctatagaaagataaggatctcggtcccgtgtgttcactgtgtacaccacgaatgaatgggcaattgtggcatagtgtaataggcattcagtgaatatatttgttaagtgaatgaaatatataatatgaactgaaagatataaactgagtattccctatagtcctatggggaaatttgacatatttcgctataatgcaaaaataaatttaatttatcatttcttatttaagcttattatattctcaatatttctctcctgcttatctattggagttcctctgtaaatttaacttttttgtaaaacttcgattttcttctctgtgtgtttttttgcatggtgggtgatgttaccaactgcaaaaaaaaaagctcaaatcaaatcaacatatatatgtttgtaattatacacatgcttagtactattattatatatgtaatatttacatactatacataaacatacactatacacattataaatgtacactctctgtatttacaattaacccttgaacaatgtggagattgtggtactgaccccctgtacagtcaaaaatactcatataactttttacttcctagaaacttaactactcatagcctactgtagactggaagcctaactaatagcataaacagtatatataatgtgttatatataaaaatatgtgtttttaaatatatgtgtttatattatatatatatttggagatggagttttgctcttgtagcccaggctggagtgcaatggtgtgatctcggctcactggaacctctgcctccgaggttcaagcaattctcctgcctcatcctcccgagtagttgggattataggcacccgccaccatgcctggctaaattttgtatttttagtagagacagggtttcaccatgttggccagtctggtcttgaactcctgaccttgggtgatccaccagtcttggcctcccaaagtgctggaattataggcgtgagccagtgctcccagctatatatgtattatatactgtttccttacaaaaagtaagccaaagaaatcataaggaagaaaaagtatattttatgttaagcagaagtggatcatcataaaggtcttcctccttgtcttcacattaaataggtagaggaaaaacaggaagaggaggagctggtcttgctgtctcagaggtggcagaggtataagaaaatctgcatataagtggatctgtgcagttcaaacctgtgttactcaagggtcaacttataatttaataattataatacaatatacaatttttttaatgctaagatgaagccaggcgactgagctgatctgagactacattttctgtaggcatgccatctgggtttctttaagcacacctattccccttcctcaattttcaatagaaatgtgttatttgcccattatttgtaaataaaagtatttagagtataaaattaattgaggaccactgtgaaagggcttagaaattcttaactaaccactttcttccctatgagttttacatgtattgcatcattatatttccctttattacctaacatttttaagattcttggtttctattcaagttatcttttgctgcaaaatatctttttccttacaaacttagtggctcaaaacaagaagatttattttgctgaggaatctgtgatttgggcagtgctcgacagggacaactattcctttcttcactcggattcgagtggtgtagctcaaaggctacaggctagaattttctgccagcttgctcattggtggtgaatgctcagatcagttggaacctcatcagggatggggctagaatacctacctgtggcttttctgtaattccacatagtgtattgtctgaggtctcaggtgaatgtcccaaagagatagagggaagctttattgcccctgaagtcacatagccttccttctgccatcttctgtttattagaagcaagtcactaaggctggccttttttgaaatgtagggagttagataccacctttaaaaaaaattatctcaatagttttgtgggtccaggtagtttttgtttacatggataagttctttagcagtgatttctgagagactttagtccacctgtcacccaagtagtgtacactgtacccaatatgtagttgtttatccctcaccctcctttcagctttctcccctgagtcccaaagtccattatattattcttatacatttacaactttatagcttagctccctcttataagagagaacatgtgatgtttggttttccatacccgagctacttcacttagaataatagcttccagctcttataagagagaacatgtgatgtttggttttccatacccgagctacttcacttagaataatagcttccagctccatccaagttgctacaaaagaaattatttcattccatttatggctgagtagtattccatagtgtgtctataccatgttttctttatccactttttggtcgatgggcacttagattagttccatatctttgcaattgcaaattgtgctgctataaacgtgtgtgcatctgtctttttcatatagtgacttcttttcctttgggtagatacccagtagtgggatagctggatggactgatagttctacttggaaacttcgtactgttttccatagtggttgttctgatttacatttctaccaggagtgtaaaagtgtagacaccacctttaatggttaaatattgcagaaaatcatctcagctttctaagtcataaatgatattatggtaaagacaattttgaaatttcacagagaattttttaaaaattatctataacgatttcctgctattgccagtttctggatatcttctgcttatttaaagatgaaaaaagcccccaatacttttttgaccatcacacaaactatcttgaggtctcttgtaaattaaaacacaaaagttcttgaaagtaagcatcgttagccttctccttttggtttcttaattaaccccataatcagcatattcaatcatcaatctttttagtatacaaatgatacaaagtgacttatcaaaagtgttgttaataatttacaggtaatagagtaaatttatatgtttatgtacctcactttacttcttgggaaagacatttcgtgtcaaaaagcataatctgaacaaacaagaagcaccactactgattgggaaactacttactttagtgctaccttatcagctcttacctataagccatgtcagctcctcactggttttcatccctaagtgacatcagcagcagcaacagctattgtgttattgatttaaatccttctgagatcaattcaaaggaggagaggtctcatttccattggtttgtcctgtttatcttgtgtagggacacaagtctgagaaatcaaaattttattctcttgtttctaacaagccttacaacattatatttcattcatggtataatttgactcatattttattttctgaactttttttgttttgttttgtttgcgacagggtcttgctctgttgcccaggctagagtgcagtggtgcagtctcggctcactgcagccttgacctgccaggctcaactgctcttcccacctcagcccccacaagtagctggaactgcaagcaagcaccaccatgcctggccaatttttgtgtttttctgtggaaatggagcctcactgtgttgcccaggctggtctggtacttgaactcaagtaatccacctgccttggcctctgggattacaggcatgagccaccgtgcccagcctatttcctgaactttaaatacaatatcagggagaaaatcaacaatattttgcagtaaaagttcgaatattcatgtaaacatttgtactcttttcccattccattggaatagttaataaaatcagaatataaaaatttcatatgcaattaaaaaattcatgataagttaaaggagtttccatcttttagtttaatgatttaaagattttacttctaattattttagttgcaagtgatatgtatttatgcatatatctatctctcattatgcatctgtctctctatctatctcatcatcttttgatacttctcctaggctgaatgtttcacattttttctcttagtccagaaaatatgttctgctttcctgcttatatggggaaaatgaccactgccaatagcttcaagtttatttctctcttattccagaaggctggcagattgagattagaatctctcatccaattttagtttctgaggagcaactgatttgccaagctggtgtcagctttttagccctgaaccaaaaaattgtggccaaagaatgatgagttcattttaaataaatatatgactagaaatagcattcaatattaggatagttcagtgtggaatagagataattattccctgaaattataaagtgtgtgtgaggctatgcacatgcaatatgtgtgtgtgtagatatgcctccatattgtggtatggcagtggtggcttatttgctagtgagataaacaatatgtgtccactttgggatgttacatatatgcctaatcaatattttgaggatgagcctatttacttctctggttgatttaagtacagaaaagtgtaatgaataatacttggcttgaagatctagctatacttagaataggttgacagaaccattaatttcaaatgaatatggacctttattttgggtagaggattctattatatatttgccaacaatgcagaatgttgtttcttaataatagtattgagatctaaaaacatttacactgtactgtgtgctcagaaattacataagatgaaacattggtataacctataggaaggcgagattgagggatagttgttataaataagaggcttagcttgttaagaacaaagaacagagtttttctgttctttgagatgatttatgaaaagagacacctttcatacattagtgcattaatatatgaatataatattatattgtaatattacgtaattgtaatattacgttttatgaaataagctaatcatctctgaaaacagcagcagctttataaaataagtaatagtagcagactttaactgttttgttgagaccgattatttgccctattgccaaggcaggagtacagtggcatagtcatagttcactgcaacctctaattcttgggctcaactgatactccttcctcagcctcccaaatagctgggaccacagtcatgtgccaccatgcctggctacttgttttactttttaaaatttttagtggagatgaggtctcactatgttgctcatgttggtctcaaactgctgggctcaagtgatcctccctccctggtctcccaaagtgtagggattagtcatgagccaccatgcctgaccagactttaatattttaggcgaatccttctagttcttaacgtttcaaccttatagattttatatttccaagcattttacataaaccattttcagtgaaagagattttcaaattatttccttgacagggatgtagaattagtattcatttcacagaaagaacaatgatatgataacagaagtattcactgttagggaaaaaagttggaactcagagttcctgaggcatgtttgaatttattcagttaaattatgtttatttcagaaagactgaagagctaaaagagctagtttcagctttcttataattaaatcagtgctttatacctgttaggctaggtgtaaatgaaagaaataggggtgtagaaatacaaggtatgttaattacagttcattcataatgcattgcaaaggatctttcctaattgcagaagcatattttaagaaagtttcaggtattaagacatagtttatgagatcttgcacccaaacacataacgtctccaggccctaagcaaggtaaagataacaaccaaaagttgtccagtttaaattaagtaaacaaactctgtggaattatagtagaaagaaatttaatagcagagggtagataacaaagagattgaagataactaattacaatattaattagtacctttgttggccttaaattggtggacctaagagagtactctgaaaatgcaacatgtattaattgaacatgtgggaaactaccaatactagagtgcttttttttttgagtgcctatgattaattgtaatgggaagatggagaggttttattaatgaccaccactggctagctggctagtaagattcttgataaagaaatgttattattcttggctttttaaactacacaccaagctttaatctgaagtatatttcaaaaagttaatgttaaacaatttgaaaatgtgaaacatggaaaataacacaattatatgtttataagagatagggtagttttaatgacttcctaagcagaatggactaaaaatgactaaaagtttgtctaactctatactatcacaaaataattgacttgtccgtttttaatgagtatgcacgtgatcaattgtcaagttaataatgccaattattatctcagagatgtcagtctattattaacctgtgacagatattaactatacatattggtaaataataaagtgtgcaaggggaaattaattaaactaatatataaatgtgagtaaaggggagatgattgatatttttgtatatcaagattttacttttatttaaaacatattttatttttaaaataaaatgaaatttaaaatattttataataagcaactcaaataaatatatgaagaatacattttagcgcattattttgagaaatttatcatctgttattaaagattttaattagggaaatatttttaaaaatagatggtattttaatattttgtattcctataaaaatacaattgaggatgtttggaataatctgcaggggaaaacatttttaatcttttattataaagtaaaacacagataatgaaaaggaaacatgaaaaatgaaatagtttaaaaatttattgtaagccaaacactttcataaccacatcaaggtaaataaatggaattttaccagtaacccttaagttcttccacctgcttctatcccaatcacaaatttctctctgaaaaagtagcattctccctcttttttatggttctactatatgcattttgggaaggcatataaccattacatattacaatccattctaattttcattttcctttagttctataagtgaccgtaggtcagtgctcacaaccttttcatttttctgtgtcttgctactcattttgattgtctgaatgtcagttgttgaagtcattttttttagtatcatgcatgtattacctcattttttcatggcataaagcattggtgctgaaaagtctactcataatctgctattctttcccttataactatattgctgtttcctccaacaaatgcccaaaggatgtattgttattctttaatatccactactctctctctttctttataaaagaatttaacttgatatcagtctttctggatacttatttcagatagatagtgtgctcttcaatgtacaatttcacatttttaaaatcacttcagaaaagttttcttgaattataattttaaacatttgttctgtctccttactttcattttagtctccagggtaacataatatatgtatattgaatcttgcttgcctatcttcaatatttatctattttgaatctgttactttttatttgtttgttgacgtttaaaatttccttccttcttcccttctatctttcttaaagcataatatgttgtgataaaaattacattttcttaacagctttattgagatataatttacataccatgtaattcacccatttaaaatgtatactgcaatggtttttagtatatacatagagttgtgtaaccattacttacaattttagactatgtattcactccaaaaggaagtctatacttaatagtggtcactccaattttccccaaatgccccaagccctaggaaaccactaatcgactttctgtctcaataaattgcctgttctggatgtttcatataaatggaatcatataatacgtggtcttttttgactggcttcttttacttagcatattattttcaaagttcatccgttatgtagcatgtatcagtacttcatacttttttatggccaaataataatttatcatatggatataccacatattgttatccattcatcagttgatgaaaatttgggttgtttccactttttggctatcatgattaatgttgctattaatatttgtatacaagattttgtgtggacatatgttttaatttctcttaggtatataccaaggagtagaatttctggttcatatggtaactctatttttaacattttgaggaagtgccaaactcttttccaaaacagctgcattattttatatttctacaagcaatgtatgaatgcttcaatttctccagattctcaaaaaaacttgatattacagtcctttaaaagctttatttaatttgaattgacatgtaataattgcacatattaatggggtagaggttgatattttgatacatgtatgcaatgtataatgatcagatccaggtaattagcataaccatcacctcaaatatttatcatttgtttgtgttgggatctttcaacatcctctcttctagctacttgaaaatatataataaattattcttaactatagacaccctacagtgctatgaaacactagaactttttcctcctatttagctgtaagtttgtagccataaaccaacctctcccttctcttccctcccatttactatttccaccctctaataatcacagttctgttccctacttctgtgtcctcaagtattttggcctccacatatgagtaagatcatgcattatttatctttcagtgcctgatatatttcattaacataatgtcctccaggctcatctttgttgctgcagatgacaggatttcctcttgtaatgactcagtagtattctaatgtgtatatataccacattttcttatccattcatttgttcaaggacacttaggttgattccatctcttgactgttgtaaacagtgctacaataaatatggggggcagatatcatttcgatgtacttatttcctttccttcaggtaaataacaagtagtgggattgccggatcatatggtagtttatttttagatctatgaggaacctccacactgttttccacactgggtgtactaattcccatcaacagtgtattagatttcccttttctccacatcctcggcagcatttattttttgtcttttgataatagccattctaactggggtgagatgatatggcattgtggttttgatttacattactcttatgattagtggtgactatttttttcatttacctgttggctatttctatgtcttcttttagaaatgtctattcagatcccttgccaaatgttaaattggattattttattattattattattattattattatattttttgctatttagttgtttgagctccttgtatcttctggatattaatcccttgtcaggtgaatagtttgcaaatatttttcccattctgcaggtggtcctttcacttcgttgattgttacgttttctaggcagaggatttttagttttatctaatcccatcagtcaatttttgctttcattgccaacacaagttattttctgctttttgtgtttgttgtttcattatactaatccacttaggtgtgaagtggcatttcaagtggatttaatttgcatttccctaataactaatgatgctgaacatccattcatgtgcttattggtcatttgtaggtttattaggataaatgcctatctaagtcttttgcctatactttaattgggttgtttaaatttgttgttgttgagtagcaggtgttctttgtctgttctggatggtaaacacttttgcttttaacagattgattattaagtgtcttggtttggatctcttcaaatttgttctagtaggagtttttttcagatttctagatgcttttgtgtcttccatcaagtttgagttttggctaaaggtttttgttattatttctttaaatattatatctttctctttctcttcttctgatactcccagtaatctgtatgtttgtcctacagtttccttaagcttttagtttactttttctttctgctcctcaggcatgatagttcatattaacttaccttcaagttcactaactcttttgcctactcaattctgcttttgaactctttcatctccagaatttctttttggttattttttataatttttatctctttacttttagttttgttttgttcatacatagttttcctgattctctttattgctttatcaattttttttttcatttttcaacttaattaaagacagttgttttaaagtctttgtctagtttttccagtgtttgggcttcattagtatggtttctgtctatttactttcttcctttgaatggctgcactttcctgtttttatacactatgaggttatttttgttgaaaaattgacttttaaatattaaaatgtggtaactgtggagattaaattctcctccttcctcagggtttgttgttatttttgtttttggagtctctaatcatttgtctagtgacttttccaaactatttttgcagagaccatatttctcgtcttgtgtgcctccttgaagtctctgttccttagcttgtgtttaaacagaagttttcttgaacaccagtaattaaaatctaaaacaaataaacacacaaatagccatctttaccagcctttccagattggctgtgtgtggggcccctccttcaacgcttaaccagacttgcactgaacatatggatcagcccaagttaaaagcttaacatcttgttttgtcatttctcaacatgtgtcatgccctggtcacgcacatgacttcctaattgccctttccataacctccatatcgattgccctaatttcccaagaaaattccctctcagattttctgccaaagccttaagctgtctattatatttctcaaccataaacttttgcctcaggcatccgcagaatgttttgcagccttgcaatgttttcaagaaatgccgaaacttttccaatgtgagttccgatttaggcaaaaagagagacaaatgccatgtgctggctcttcaggtagctcccagacaggttagaacatatctacacaataatttgtgaaaaagctctgctctgctgcctccagaaccagggaccagcgttcctcactgggaacatgggctaatatcttcaagactgctacccaaccatcaatgagtggggcgaggacagataaatatgccatagagcttccctactgtttttaagttgactttttctggtttcagcatttacttggttgctgtgaacctttgactgtcttatagagttctgacaaatttggttttgatagtttctgctggtttttttatgtttctgtggggtacatgagcttgtagctgcctactctgtaattttgctgatatcactgaagtcttcatttctgaaatggtatcttatttttttcctgagtattattacattgtttctgtttttgcagtcagaatttctggtattctttcatgccttttactttttcttaatgttttagctaattttaaaagaatatattactcttctctgggtattattttgtttttcagtagtaaatatgaattagttttgttggagacatagattttatacattatacagattgtgtcagcaagtcaatcagaatttattatatgccaactgtatgtcaattatatagcatagaaagtaaaacaaacttggttcaattatttatgattaatgttgccctagacctgtctagacagttagaattagcagatactgctgtgatgattgcctaacataatacagacaaaatggagatgagaaatcttaaggggacttataggtcaatgaaacttttcttctgaacttaccacctcccacctttattacgctatcatttagaaaattgcttatgaagttcttctgcgcaaagtttatttctgaaaattgtgccctgcttgaaatccttgttttaagatctttacatgctgccttattcttgtcactcaataatcaattcagatgtcactcactcatggcgactcctcctcattatcctagctcaagctgccttttctaatcatcaatatatgatgctgttttttgaaatgtatttgttttcatgcttatcatctgtattttctctctagaatgtaagctcctttaagttggagatgttttcagccatggccacattacgtatgtagtttctaaaaagatacatagctcagaatggctgtagatttttctcttctttgaaatggatttttttttacctcattatttccttggactaattgataattttacataggcactgtctacataggcatgcaaaattttactacttaagtagtaagctagagttatattgtgtgcttgagcaattattagcatttagactatagatttttatgaagtaaatatttaaaatgttactacaactataattaaataattgaattttaaatttcttttagggtgactttcatactatgaagaaaaaaaggtcataagggtaatgtgtgctaacagagctgacttactctcatacactatttaactttacgttatgacatataagccaaaactctaccctttttcaagctgctttcctaacagagtgtttttcaaaacaaacaacaaaaatatttggaacaaattaattctcagtttcaatatttataattattccccaaatatagagaagttttaagatacgtaaaatagagataaaaactatgaagggtttgcctgttctctggaatttattgaggtcatttgtacttataggatatcaggtatgtgacacagatcaattctcttatatgtatttcaacttgttttcacaaacttctcattcagccctatagccatgccagacagtaaaatttttgttaactatatgcaaaagttgatctccatgtgcagattgttgaaggagaaaaaaacactggttataattttcaaaaactaaaatgctaaataaaatggcatttcattcatccattcattcattcataatattttgaaatctagatcttatatttatacttggtcataacattttatttcttttattgaggatatttctttgtattaagttggggaaatttatttgctaactttcatattttaaaaaaatgtgtcttcaaataaaattttatataaaatgacagagtaaagaaatttcctccaaatttattggggttttttggttcttctgaaacaatagttttattgtatttgatgcaaaatttaaaattctgctttgtatatatattttctggttttcttatgttagagttcactattttaagtgcaaaacaaactgttctttgcctttagctatatatttatatattttttaaaaattagaggtttaggaaaacgttctattttaatgatctcttttactaacttatgcattccttatatattaaaaacatacatgcccactgatttatgagattctcagccataaaaaatttatatgcatattacatatatgctacatatatgtattaaccatatttatatgtagataaatactctgtacttgtgtgtatgtgcagtaaacacactcaagcacataccgcatgtatctatatatgtatagatgtttatgcatgtatatatatcatatagccagacacacatacacctatatgcatatttaaatatattgtctactgtgttttgctgtgtctactatgcttttcatatttcagtgacattgtttctatagtaactaatgcactgaaaaaatcaatgcaaaaaggattgaaattttacaaaaagccaacccagaaacatgcttaaaaattgatgtgcagggggaggtatttgtcttgggtcatacattttggaagtgaataaagcaaaatgaaatcattactctgtaacaaactatgatctagcaaggttggaataccatattcttttctttaaccagcaaattaccaaattattatggtttctaagagcaacatgcacggatccacaaaacctataggcagtgtgaatctgtctatattagacacagtgtaaagaggattagggtaatggtgccaggctgagacactatttccaaactttggatcaagtgtctgtttaaaaatacttctatttggaaaaaaaaatgcctttctgctaaattttaaatgaattatacctaacgtaaatggtaagtgcctgggaagaaggtcaatttgcagttatttgctgcaattttaattctagacatttaaatcattaggaaaaactagaacattaatatttcatattttgttaaaaccatattcaagctagagtttaagtatactaatagccaaaatgtttatgataataaaacagatctgagttaaacaaacagaaacacaaaataatatttaaaatttgaaaataattcaaaatctgctctcttagctttcccaggtaggttacctgtatttcaaagtactttcactctgttggtaaggaaaaggatatacagttgcttttgtaatagccattcatacatataatttgatcatttagtatcaatgatcatttagtatgttacacttgcctgttatataattttcacattattagttaaataaatacataatacaagctttttctgtatgatgacatgaacagttagaattattttctataataaaaagattaattaaaggcttatttataatataaatacattgagtagttgactgttctttctcttgttagttctttgagtcacagtattttaaaatatgatattttaaatacagttttaaaatacatatttatttgacaaatctatattgaacaagtcattaaaacagagctccttctggacctctattaagacagggctgatcacaaataacatgatcacaaatagttataagacatatttgacaagtttcattacacagttatagacaaagtattagatgaaggaaaatctgatgtgattagaaatatttcagtgtatttcatggtgtaagtaacattccagcttacttcatggtataactggcatttcagacaggacttaaagtgtgagaagggatttaatgaggagaaaagaagaaaataacagaaggaccagcacaagtcaaaacagagaggcatgatgggttccaggaaggctaagcagtctgtctgggatgcctagagcatagaaggcatatcagataaaggcaagaatgtgcaaagcactgagagcggtaatgagctttcatgttgttcactggagaggaattacatggttgcatctgtattgtacatatctgatcggacatactatatataacatattgtggagagttagttggtagaagaagagattgaatatatagaaatttgggaagagttaataaaagcttagctatatgagtatctcttgcagtcctggcagtggatgaactcacttgggaaaagaataaaaagaacacagaaacacttggggaacaatattttagaaattcttcaaggaagaggaattagggaagtagaaatgggaagaaagtttagagataacattgggaacttaagggaaatatcagtggtacttcattaatactataacctaaataaaattataatatggttattgtgaattatatcaaaagggataactttgtgccaattgctagatttttatgcagatttcattagtctactactaacttattaccaatgaatttgtgttccttcaaacagaaatgtggtaaatgtaatgatgggaaaaggcttttctatttcatttgatgataagaaaaatcatgaatgttagaatatatattctaatatacatattagaatgtaaggcatatatgtgccattctcattagtatagaagtcatatatgtatgctgtattctaatatgcatacttttttgcattatgtacttgcatgtatcaactaattgcaatttcatgttttgaacaatagtaacatacgtctaaatacacagaaagccttacataggcaacatttttctgtatggaaaacaatgaataagtcccttaaaatgtgtagacaaatattgtagttaaattttttagtagaggaaagctgatatcctgtttggttggccttaactaactaccaaatttttaagtagtgaagtttttgttctttgttcttctttcacgattttatggtccctcttccttcagtactcaccaacatgtagtgttctcatgtgacttctattctttctcttaccaaagcatgcttccttccatctaatgatcagttggaaagcttaggaccactgtgatcaaaaagattgaaaaaataactttataaagtaatagcatgaaactagttttgagtcatacagtcctaaagttaaattctagctccatactgaaatgattgcatgaatgttggcaagttacttatctgacctataactttttcatctgttaatcagataattagatataatttatagggctgagtttaaggatgtaattcacaggaaaagcccagcacaatgcacaggaaaagcccagcacaatgcctggcagtttgcatttactaaacatgtgttatgcttactctttctccccttcttacagaggtttgtgcatttcaatagagcatagcccctcaacactagggaatgcatctctgctccagaaacatcaggcgctactgagaggcaggttagacgggtgtttaggaattggaagcctttctaccatctctgaagtggcacacctgctctgcttgcttgggaggccagcatggtctgtctagttgccaactcaatgaaaggctttaaaagcttgccaaaacattttttcctaggcaatttcccttaggcttctaattgcaagtgaattttaaaatatgtgacctatgatattgactatttctgaaaaaaaatctttatagttgggtaccagaggcagcagtcctgtgattctaaatcccttactgagcagagaattctcatctatctgaattgtatttctttgtaaactacctttaatggtttggtttgggcagcctaatctccctctggagataagaaagaaattctatgaatacagcaagtatttgaagacaggaagggagaaaaggagaaatatttaattaagcagagagctttacctagttttcccttactgttatttataagcaatacattggctctagatttatacctatgcagttccacaatctttattctggctcaagcttctctttttaatctcatactattccaagacaacttgttggaggtaactgtgccctacctctctcttttctgcatctttatccttcagctgggatacacccccaccactccttgtcctcttcataaaattgttttgattcttctaggattagcctgtgtgctgctgcctctgcctgtttatgcattcatgagttcgaataaaaacacaggcagataaacaaaaccaaaccattactgagtgccatatgccagattctagacatagaataataaaaaaaaatgcggttcttttcctaaaaaaattcatagtctgatgggaacacctgcatgcatatcaacaaatttaaagcaatgagagacaagtgaaagtagagtcacattccacagccacccagcattgttcaacggtatcatggaggcttcataagattagtgatgtttgaatggagtcttgaaagataagaaggaatatactaggtagagagtggaagggattggggcagaagaagcagaggtatggaagaccatattgagtctagggaatcatcaggtctttcagagcccatatctcttaaaaaatcacattggcaatcctgattcaaagtgatctccacaggaaacttttgtggggttttcccccttttatatcaactgtaagtcttcatttttatagataagatatagatatttttctaggttaaatatttgtgttctattttaaattgcttggtgactgataagttgcttgagggtaaggactaggtctcttctacttttttattctttaacacacccataactgagttttgtaattatttttatttattgtttactctgtaccaaggactcttaagaaatgtggttttatatttctttaactccaactaaaactccattaggttaggtactattattaccctcaatcacagttaaataaggcaatgcttagtgagatcaaatgacctttctaggaggcaaattgaattaaaagatctgatatcagagccataacttaacaaatactttatttaaccttcgcaggtaagtcattctacatgttcctactaaactctaaatggacaaagcaattctgaaattaaaaataatagttcaattaaataactctacgtgaagacagtgtatcagtatatggaaatattcaatgtaaattgtatattagaaaaaaaattgtgtatgtaaattgtatatcagaacaaaagttctggaaagcctttatataattgaaacagtaaaaatctcaaggatgattttcacaaccttgtattgctgtatctagtacatatttttaggatccaggtgttcatactctgaaggtgccatctggcatggtcatttctagaaaacagggctgctgtagctaactctacctggacaatctcagaggaagtaggttgtgatgggggaaggttggaaaggtagttgcgagggtcagtggatataaaaaagtttgcccatctgttgtaaatttttttaagtctccaaattcctttgttgccagtgtcctggttatagtggaagggcctcaagtacgcatgattcttgtaatctgggcttctggcttccataaatgccagagaatttgcaacagtaatgtggtatactgagcatctgccttttaatgcagcttcctctttccattctaggatcatcaactcagttaattagaggagtggcaggggttacaatgctagcaaattctgcagtattatgttatttgtagagagtgccctggaaatataatgagaagagaaaaatccaagtatttctgtttctcattcaaacccagatggaaaaatatgaggtgagacacttagaaaatcagagtaattgaacaacatactcagactggtttattggcatgaatgatgtccccttcacagtagttatcataggagccaaacaatacaataatgtcaccattgctcatgctgtttgggctcttgtgttggtgttatctttggattctgtgggctgtactatgaataattctcaacagtagcaaatcttcaaacagaaagagtctgttctgtttttgctattagcagaagttagaatgtgccaaatttggtgaataaagtgggtgatcaaagtgggaagtatgattttttttgccaaaaacaaagtagattgcaaaataatgaaacatttttgtcttaatgtggcttaaaacaagctctgtttattccaaaaatttttctaaaattattttgaaatactgcagaatgtctgtagcatgtattttccaattatttaattaaattaaatccacagattctcataaatatatataaatttcagttttctttgtaaatgtatagttacacctattattttacatttttgttgttgaacagcattacaaatattttaaatcttctcatttaaacaatcttaaactaaccaaaacaaacctatttcaaactaagttgaaatattttcagaagttaaaaaggatattttttgagacctaagaagttttaaatcaaaacaagaaaagattcagaaaccaaacacattgtactcatttaggataaaataatttgaggtaattatgaagtgaggagtcagattcgtattttctgaatttaattgtgtcattgtatatattattttttacgtcgtatcacagccctgtgtagtagatattattttaacatttggtcgattatccaagtttacagtcaatattcaaagttttgtctgactccacagcttttatccagctctaatacaagacttcatatattcccttcttcagaagagagaggagaaaaaaaactttgagtgacaattatttttaatttttacactgttaagtgaatatacctgagagggcattgctttcaaaatcttactactcagagtatggccagcagacaacactctgtgtggcagcatcagtgtctcctggtagctgactagtgaagtagagtattagatgccacaccagatgtaccaaatcagaagctatattttaacaagtccccccatgtgaattgctttagagcagtgatcttaagcatatctttggaagtcttttaaacaatattctagtgtcttctgcattttttacaggctctcaaacaggacaaaatttttcagctatgaggtgtgtctaaaagtatgaactcattttgacttcagaacaataagaactcttgaaggtcacctttagcgttttagttaaataacatgaaacttactattaaggaggacatgtttgataagagaaaaaaaccactactgcctaagtagtcatacactcttcaaaattgatacacaatgactgaaaggattattaaactatggtcaattactgatgatttataacacacaatttacggtgattcattttttttctggatacctatctttgaatatgctatttttaaaaattattttgtcatttagacttctattttatactgaattgaaataacatactatgttcctaaaatatcatatggaaaagggtttagcttagtgttcattggttgtgatattttttaacaaaattttcaaaataacacatttttaaagtgaattttattaattactgtgtctagaattaagtttacttttttttttttttttttctgacagaatctccctttatcacccaggctggagtgcagtggcatgatctcatctcactgcagcctccacctcctgggttgaagcaattcttgtgtctcaactccccaggtagctaggattacaggcacccgccactatgcccagctaagttttgtatttttagtagagatggggatttcaccatgttgcccaggctggtctcgaactcctagcctcaagttatccacccacctctgcctcccaaagtgcagtataatgtgtctaaatatcaaattataaaaaagtaaaaagattatcatcaaactacatttctacactcatggtaagatttttcataatttttcttatgaacatgcttaagcattttaaacactgcttgtagcctctgcaaaagttagcatgctaaatgtatgtttaaaagaactaagaaaggaagggaggaagaaataaacaggtttctgttatgcaaagttgagtgagttcaagatgtttatgttcatcaccagaacacgtgtaaaaatagctgtaattcattcataaagtcaattcttacctctgttaactttcttaaagcatagttgttttgatatagattatttcccttcaaatttatttatgtggaataattatatccaatacagaatagtattattcaataacaaaaaatgaatgttgcaataagtcattaagggtagagattattattagctaaaatcaaaagatttttttttcattgaggagaggtctagtatagactttaaagggtgaatcactgttggctatgtctctgtggttaaagagacttactgatgataccacctgtgttcagcagaagtagagagtagttttttgtggtagtaacagagggaagtgcagagctccaaaaacaaagggaaaatatttacttatttcgtctggatttctgccataggctatgattacttacctgtcaagattttctatcctgtcctaaatatgcatcaactctctgagtgagactccccctgtaatcccggttcaaagtactgatacacagaatatattttaaaactgatacattcaagtctgtatctaaactggctgttgacccactgccctgtttcctactacattccttcatcaatttttaagagtagtggtttcccagcaaaaaataagcagcataaataatgtggagagaatggaaatctactacattgttggtgggaaagtaaattagtatggcaattatggaaaatggaggttcctcaaaaaactgaaaactgaactaccatataatccagcaaatccatctcttggaattccataccaaatcagtatgttgaaggaatatcttcactcccatgttcattatagcattattcataatggccaagatatgaaatcaacctaagtgtctgtcagcaggtgaaaggataaagaaaatatggtacatatacatagtgaaatatcatgtagctttagaaatgggtgaaattattttatttgggatggcatggatgaatctagagaacattatgctaagtgaaataagtcaggcactgagagacaaataccatatgatctcatttatgtgtggaatttaaaaaacattgatttcataagaagtagagagtagaatgagagttaacagagactgggtggtgctggtggtggtggtggtggtggtggtgagggaatggaaagttcctggtctaaggtaatatgtctcagctagacaagaagaataaaatttgaaatctattccacaacaatagaatcaataatattgtattatatatttcaaagaaactaagaagaaagtaaatttcaaacgtcttaccacagaaactgagtgatgcatgttaatttgcttgatttaatcattccacattgtatacatacatcaaaagatcacactgtattccataatgtaatacaattatgacttgtttataaaataatattaaccaaaaataaataatcagcatataatagtgcttaagatgggtgattctggtgtcagctggatcagagttgtaatcacttctctgccactcactggtattgctacctttattcaacctcatttacaagagctgtttcctcatctgagaaatgagaataataaaaagatgtatttcaaagaattgctgtaaagattaaatatgaaacacttcatctatattaagttcataacaaatgttggctactgttatgtattattactatgtacttcccttgtactttgctcttatagacactatgtcttttttatattaccttattttaaaacttgcttatcatatcaataaaatagcataatactttcttttttgtagatgaagaaacaggctcagaaatgttaaatttatatccccactatcaagaagccagctaagtgccaatcttgcacatttaaatcctccatgtttcttagtttcccatattacattccttatctcaactccttggaatcagatagaatggtgtaagatctctaatttccttagttcccttgagagctagaaaacatttgacaaactaaaaacaaaattatctaaacctattttgtgctcttcaaaaataggcataatagtatacatttaacagggttgtgaggaataaatgaggtaatccatacaaccagcttagcaaagtgcctgccatatattacgtatggcaggcactcaaggaaaactgactactattagtatctaccaccttgggaattagtagttcccgaaaatgttgctgttgtcccaaaatgttttggcattattattatctagaattacatcaaaatttactttataagctacataagaaatcaaatcaccacatagaaaaatcaactcagaaatggataaaagacctaaaggtaagacctgaaactataaaactgtgagaagaacatatgagagaaaagctcctggacattggccttggcaatgatttttgatattgtaacaaaatctcaggctacgataacagcaatgataaataaatgggggcatatcaaactaaacatctctgcacagcaaaagaaacaataaaataagacagcagcctgtgtgctggaaaaaaaatatttgcaaaccacatacctaaaaatgtcttttatagaaaagtaaataaaagatcatggggattcattttgttgtcatacctctatagtccttcaatttcgaatatttcttgaattctttttgtggctcctaccattgacattctgccattaattttgtagaatgtcccttaatttgagtttgtctgttatttccttcctcatgattagattcaaattatgcactgttggcactgtgtgattacctattactcttcagacttttatccattagttttaacctccatggatgatttctacctgaattggttgatagttggcaaatggtgatcttctaatcctataagccttgctacacatgttagttgagacttaatttataatgggaaagagaacaatgataaaataatgtgcatgtacatcaataaaattgcaaaattttcagtgtcaggaaaaatcaatggatggatgttgagcatggtttgggggtggtctgattctgagagtagtaggaaaagtggtttgatatttcagctgagagttttaagaatcagaaggagcttgccatggaaagaatgagaggaggaatgagaggaagggcaaacaaagggaaagagaattgctttaggtaagaaagatctacatacaggggtgactaaaacaccagtctggcagcatatagtgggcattgggcagaaagggcaagtttccgttaaagggagatgtgtagctgtgatcacttaggatacataagctatggtattttcatctaagtgaagttggaagtcatttaaagatttaagcagagaaatggcatgataagatttttaaaatgtgtctctttgtagagaataggccagaagggggcaggtgaaaaatctctgtttgatctgtgttaactactagcatcattacttcagctactctgatctctcattggactgcacatatataacttgtcttcttagacagttctgtaaattccaaatgatctcttgaaaatgaaaattgtagcaccctggaccccactgaccaggagtgctagttgacagcaagaggagaggaagagtgtaatataatcacatgttgtgagctcaaagagaaagaagcgatagtagcctggaatcagcaatgagaaataagtaagactcagaagtgaaatgggctagaacatgagaaagtggggtcttgggtaactttaggcccaagtatgggtgcgggtctcagagtatgggtaataccagatgctgagggacacatgccttttggttgtcatgaagtagagaatgaagagataagctgtaatagtctcttttaagaggctaaccagcagtctagagctgtattcctaaatgctattctctaaggctcaggacctagagttgtccttgagaagcattaagaggtagggagtgaaacaggtgaggcattggaaagttttatgcctgagactttccaaatatgatgggcctttatttttaataaataaaaaggatttttattggagactccttgcgctgtctcatgctgtaatattgacaattaatggctcaacgacacaataacaatatatttaaagttttaataaatgcactgtgatgtgaatcattcacttttattttatttattacttgcttacagcttagttttatactcactttggatttttttaaattctgtggtttataggaaacctaagctcatgaagagtttataatctaagtataatcctatgaagggcattatgtgagagattattgtgttttgttggaggttgtattagatgacttctaaggtctcatcctactcggagtctatgatttaatgtttctagcatgactttgtatcaaagaatgagccagaaaattgaagggtgtttaatatgacctgaaggaaaaatcaagaattctaataaagtcaagacacgtataatgtgaacaattcctaggcttttgatcattcagtggaactgacacttatgtagctacagatttatgctggttttaaaggcatgtttcaattgaatgagcaaattgtgaaaaaaaaaaaaaaaagtattaggtaacaggatttcaaaagaccgtgtgagatcttagtccatccaattattttactcttgctgattaaataaatctgatataatcgccctaaaaatttgatcagattactagctggtaaaaaccagcttttgctcattgaaataatgagccagtaatatacttcacaaaaatatagctaatgataataaatatatgaaatatattattttttcctaggtgccaagttacatcttttgactcaatgacctaataatagactttctatcattttaaagaaagaatttcccctcatacatgtccccttcacagagattcccctaatgttagactaatggtcctaactttaataaagtgttagtctgagtctgtggaaaaagacatagaaaggtgacttatctgagatcataaccaattcaattgttaaatattgtaatcaagcaaatacaaaccacctactccttaaatatttgtaatttttcaaacacttttaatcagatgctctgggccaaaggacagatgcttgtttacaaggctgatttagttactttaaatgctgctgactgaactatgtacctgtaacatgcttcagctacaggccatgttcagaaaaatccttgcatatcactaccaacacacttcagtatccagctagctaatatattgcaaaaactaatttattcaaagcatatggtctagcaaatgttgactgcattttcagatgatgttgtacatttaggatcttggaaagttgtagattcttacatagaaccacatagaattgaggcactttggggaaaaaggccaaaaatcttatttcacaaatatgggaaatatttttactataagaggtaggaaataactaaacaaaatatttaccagttaaaaaacctcaatcagaaatagtaaattgaaacatttgttcataggttctttttagatatctaatatgaatatatatttatgtagcaaacactggggctttaaaaataaatacaggcatatcttgttttattacacttcactttattgcactttacagttattgtgtttttttcaaattgaaagtttgtggcaaccatatatcgagcaagtctattggcataattttaccaacaacatgtgctcacttcatgtctctgtgtcacacacattttggtaattttctcaatatttcaaacttttttaattatcattatatctgttatggtgatctgtgatcagtgatctgtgatgttatcattgtaatttatttagggagccatgaatttcacccatgtaagatgataaacttaataaatgttgtgagtattctgactgctccacattccagacattcccatctctctccctcttctcagttctccttagtccttgagagaaaacaattttgaaattagaccaattggccgggcacagtggctcaagcctgtaatcccaacactttgggaggctgaggcgggcggatcacgaggtcaggagttcaagaccagcctggtcaacagagcaaaaccccatctctactaaaaatacaaaaactagccaggcgtggtggtgggtgcctgtagacccagctactcagggaggctgaggcagaagaattgcttgtgagactccatctcaacaaaaagaaagaaaagaaaaagacattagaccaattaatactgcaatggcctctaagtgttcaagtgaaaggatgagtcgcacatctttcattttcaatcaaaagctaaaagagagtaagcttagtgaggaaggcatatcaaagctgagatagtctgaaatacattttgagttgatttttgtatgtggtgaaagataaggagttataaaagtagacttcatgaaggtagaaagtagagtgatggttaccaaagggtgggcctggtagtgagttagcaaagttgtaaatgcaaatgaaaagttctagaaagttctagaaaacggaacgttctagaaagtgcttcttttaagaacacctgaatgataagaacacaaaacagccttactgctgatatgaggaaagttttagtggtctggatagaaaataaaaccagccacaacattcccttacaccacaatttaatccaaataaaagacctaaatctctttaattctctgaagtctgagagagataaggaagctgtagaagaaaacttagaagctagcagaggttgcttcatgaagattaaaatgaaagctgtaaccataacaaaaagtacaaggtaaagcctcaagaactgatgtagaagctgcagcaggttatccagaagacatagctaaaataatttatgaaggaggctacactaaacaagagactttccatgtaaagcaaacatcttcctattggaagaagatgccatgtggtacttccattgctagagagaagtcacttcctagcttccaagctttaagggacaggctgactctcatgttaggggcaaaggtagctggtaactttgagtggaagtcaatgctcattcaccattctgaaaatcctaggggtcttaagaattatggtaaaatctactctgtctgtgctctataaatggaacaacaaaacctggaagacaatgtatgtgtttctagccaggtttactgaatttttaagctcactgttgaaacctactgctcagaagaaaagattcctttcaacatatcactgctcactggtaatggacctcatgacttgacggctctgatggagatgtacaaggaggttaatattgtttttatgcctgctattacaacatttattttgcagcccatagatgaaggagtaattttagtttcaagccttattatttaataaaaacatttcataagactatagctgtcatagataatgattctcataatagacctgggcaaagaaagttgaaaaccttctggaaaggatttaccattcaagatgccactgagaacattcattattcatgggagaagatcaaaatatccacattaacagggctttggaagaggttgattctaacccttatggaagcatttgaagaggtcaagacttcagtggaggcactcactacaaatgtggtagaatcagcaaaagaactataattgaaagtggagcctaaagatgtgaatgaatcgctgcaatctcatgacaaaacttgaatagatgaggagttacgcatagataagcaaaaaaatgtcgtttctttggatgagatctactcctggtgaagatgctgtgagcattgttgaaatgataatagatttagagtatttaattaacctaattgataaagctagcatggtttagagcatggactccaattttaaaagaagttctaccgtgagtgaaatgctatcaaatagtattgcatgctacagagaaaacttttgtgaaaggaagtatcaattgatgtggcaaacttcattgttatcttgttttaagaaattgccacaaccactccaaccttcagcaacgggcaccctgatcaatcagcaaccattaacattaaggcctgaccctgccccaacaaaagattctgactcacagaaggttcagatggttgtctgaaattttaaaattaaggtatttaaattattgttttagacataatgctattgttcatgcaatagaatatagtttagtgtaaacgtgactcttgcatgtactggaaaacctaaaactttgtgtgactgactttattgtgatatttgttctgttgtggtggtctggaaccaaacctgcaattcctccagtttctccaaggtatgcctgttctgttgttttaagtcacttaacaaatacacatactttttttccccctatttttatatgatagttactatgcccatttgtacaagagaaattcagaggaatttatgatttagaaattaattgactctgatgctgtataagttatactccagaaaattttaaattattaataagaacatctgattccgaaaattattattcttaatgaaaaaatgccaaaatgcatgacactgctctcctgccgatgactaccagaaactcatctttattcaaacaagttggttttattggcacattgcaacaaaggaaactaacacaaatgaagaataggtgcttcagccagagagtgttagaaaggacgtattataggatacaggttcatgctaggtaatttgggggcatattcaaagcagtggtgctttgtctgcattggataatgtcaggaagcaggggtaattctttgtttgtgaatctaaacaattccttttaaagcagaaattctgattggtaaagaatcagcactcattggtgatagccaagataggggaagtgtggtcattttcgtagtttgcacaatattcttgttttgtctgtgctcaaacatttttatgtagtggtctgatgttgtccagatccatcatagcaaggagtggctttgtctgatgatggtgttctatgaaattatctgtgtgcagtaagagaataccatggcccagctgtgtcagcccaacttctaacaatgttgtagcctggctgatagtgccaggccagcttccagctgtgaggggctttttctctttctcatgtgtaatggcaaatacttctaactacaaatgtcacgacaaaataatttcatgccggatatgaatattttctagctcaacatcttgctttcaaagttctttaatatcaatcctcatcactggattgtaaactccacaaaggcagagaccatgaccttttttcaagagctaaatacatcctaattattagtactactcatacaaattgaattataactaatatttatcaaacttttacttatatgtcagttatacttttgtgggttttactttgcttgtcaccctaatatgcacagaaactctctaggatgagtacatactattaatatctccattttataaatgagaaaatgaaggaatagggaaattaggtgacatacaaaggtcatacagctagtaaggagcaagtacaggattctaactcaggaagtctggctgtagattccctatttttcatcactgtaatgggtttgatacatatgtgttgaatgcatgtgtaaaccaaaaataaaattcaaagcccccccgccctgccaccccaaccgtctaaatggacctcctcctcagcaagggctcttttacaatttaatctgagagactgtttctttcaggccatgatgggaagtgggggttgaaaatgcctcattatgcttcccaagcattaatatcaacacagactttaagtctgataagaaacattttacaacttattctctttaaagcctagtacctaaaggctttccctgcaaagaagaacttgggtctccataatcctttatcttaacccaggcattcatttctattaatcccaggtctttagataaacttaaccaactgtcaaccagaaaaaattttaaatctacttgtaagctggaagcccccactttgagttgtcctgcctttctggaccaagccagtgcatttcttaaatgggttttattgaagtctcatgtctccctaaaatgtataaaaccaaggtgcaccctgaccaccttgggcatatgttctcaggacctcctgagggctgtgtcatgggccgtggtcactatatgtggctcagaataaatctcttcaaataagtttcttccaattgtttacagagtttgactcttttcatcaacacattatgaatagatgaggaataatttgatgattttgaaaattttgggtaaaacaggtaacttttgagattgggtattaacctgggataagagtagcgcaaatcttaacttggagttattctacaagcacatttttaataggaattcttgaaggggatagagtcaagtgtagggaatagacctgaatctggatctccataaataaaaggttaaatataaagtagaaataaggatgaaacgtggtaggttcagatctgtggttatcaatctgaatatgtggatataatgaaaagtgtaaacataccatacctgagacagacttatgtaaaatgaatagccaccttacaagagaataaaccagacagcaagaggggtatatgtgagtactgcaatctttgaccctaaaataggcagccatgacagtgtagagtgcatccttagagttttaaatgtgtatcaggaaaatgaacctaaagcaagttttcctttaatattttaatcaaatcatgggactgtggaccagaaaggatgttgtttaagtataacttaaaattgatataatttataaacttaaatttataccatttagttttctatgttctgctcagaatctataagaaagacatagaatcatgttcatgaaaccatagaatttttgcacaaacgtttgtacaaatttgcaggtgctaaaagaagtgtgcttaacatctttttagcccttgtaatttgtttgttgctattattcattgcatcttgtgactaggtatgtcttggtgaatttagtgtgtaaagctttgaaaattatagtatcctctacaaaaacaaggttctactattatcagtattcattttgttaagagaaaaagagaggttactgattaatgccattccatgcgtgggatctcttttcatttattctcatcttaactatctgcataaataagaaagtgagagaaaaggagaaactgtttaatgccagtaaaggtatcatgttgaacacattttttttgtgctcctcatttagctacattggagatgttggaaatatcacaaattaataaatattcaatcttctcttcttcctgtaatcccattattcacacactgcatcaactgtgaaataggctggactttgttggaaatccaaaagcatgaggaaatgtgctcaaagttgcatattaggttagaaaaaatgcctgatgaatatgcaatttaataggtaattgtattatgtaagaacatacaaaactaatataagcacattattgtattgaggttgtattttattaaattgcttactgatatttttttgaaacaagaaagtaatgtaaattgagtaattctgaataagcgattcagggcacatatatcatgtttctccataaaagaatttttttcatttaattaattgtaaggaagtattattggattagcccttcatgaaaatactagggcaaaatggggaaaaaattatatatatataaatttcaacacagtgataccctgtatctactaaaaaatacaaaaaattagcccggtgtgttgtcgggcacctgaagtcccagctactcagaagtctgaggcaggagaatggcatgaacccgggaggcagaggttgcagtgagccaaaattgcaccactgcactccagcctgggcaacacagcaagactccatctcaaaaaaataatatattaaaactcgaaaatgacctccttcatatctcacatccaggtcatgctgatccaagagatgggttcctatggtcttaggcagctctgtcccatggctttgcagggtatagcctccatcctggctgatttcatgggctggcattgagtgtctgtggcttttccaggcatatggtgcaagctgtcagtggatctaccattctggggtctggaggaaagtggccctcttctcacagctccactaggcggtgccccattagggactctgtgtgggggctctgaccccacatttcccttccacactgccctagcagaggttcttcatgagaggcctgcccctgcaacaaacttctgcctggatatccaggcatttccatacatcctctgaaatctaggcagaggttcccaaaccccaaatcttgacttttgtgcgcttgcagactcaacaccacatggaagctgccaacgcttggggcttgcaccctctgaagccatgacctgaggtctgaattagcccctttcagccaaggatggagtagctgggacacagggcaccaagtccctaggctacacacagcatggggaccctgggtctggtccacgaaaccactttttcctcctaggcctctgggcctgtgatgggaggggctgctgtgacaacctctgaaaagccctggaaatatttttgccattgtcttggggattaacatttggctgtttgttacttatgcaaatttctgcagcctgcttgaatttctcctcagaaaatggaattttattttctatcacattgtcagcctgcaggttttctgaacttttatgctctgcttctcttataaaactaaatgtccttaacagcacccaagtcacctcttgaatgctttgctgcttagaaatttcttctgccagatacccaaaatcatctctctcaagttcaaagttccacacatctctgggatagggacaaaatgctgccagtctctttgccaaaacataacaagagtcacctttcctccagttcccaacaagttcctcacttccatctgagaccacctcagcccagactttattgtccccattgctatcagcattttgggcaaagccattcaacaagtctctaggaagctccaaacttgcccacattttcctgtcttcttctgagccctccaaactgttccaacctctgcctgttacccagttccaaacttgcttccacattgtcatgtatcttttcagcagcatcccactctactcatagcaatttactgttattagtctgttttcacgctgctgataaagacatacctgagaatgtgaagaaaaagaagtttaatggactcatagttccacatggttggggaggcctcacaattatggtggaaggcaaggaggagcaagtcgtgtcatgtcaagtggatggtggcaggcacagagagagcttgtgcaaggaaaccccaccttataaaaccatcggatctcatgagactactttactattacaagaatagcatgggaaagacctttccctgtgattcagttgcttcccaccaggtcccttccacaacatgtgtgacttcaagatgagatttgagtggggacacagccaaactatatcactacccaatatttcaacgtatgtggttagtagaattttgtaatactgttttgagctcattagtttttttacttagatatctaaagtacagcaaaaattactgtctttttgtatcttagatcatataattttagagctgaaagaggctgtagagatcattaaaaaaaaaacttagatattagaaaaatgatgcctggagagatgttgtatgacttttccaaggtaaagtacttaattaaaaaaactaaaaatttaaggggattttaagtcatcacccccagccctgtagattaacttaaattttatcaaaagattagacatattaaactattaagtattgcttcaaaccactctcagagatttattttaaaatttgtgcactgtatatgtggttgtcatataaaggattgacaacacttttttgtgtatgtaaatgaaaattgtattggtttagtgctggatttacagtttaaggattgtatttaatgaaagcctctcaattggtatgtccttgacataataaaaattttcataatttaggttttaattttcacattatgttgaaaattcaaattatttccaaatatcctgtgtttatatttactatattaattcaatcaaaaatatactagttgaaatttggactattccctatcttgagcacacaacatgcacacaccccacacactttacccattaacatggtgtacacaaagaatcttagatattttattcttttcaaagttgagaaatgcttgttaatttttaatcaagttgagctattattcaaccatttaaatttaccatcaacatattgtggaataggataccttatgcctaattaacaacataagtaagaatcaaaatatttcatttgctacctgttaatgctgtcttatgattttgctcatgtttactaatctcaattataaaatatatttttatgtgcacaaaccagtatattttatttattttgccttcatctaccttaaatgttaaaatttttaaaataaacctttatatatttatttacacataatttaataattaagtttatcaatatttctatttttgtaaaggaaattactccaggacccatttatatgactatttaggctaaaattgtattttccatttttttaaacaaatatttggtaccagaataacaaggtatgcaaaatgacaactaaatttattattcaaatcaaatatttaaacatgtacttgtatgattattggcataattatatataaaatgattatgtacataaagtttaattttttttacctgttgtcttcaattaatttagagtgttctccatttatcttgcgtcttgatgaagggtatgggggatccaagatgatgtcaatagctgtttagatgtttttgttgccatgagtttgggctttgtgtaatttcttggcaaaatatatggagatatggagagtgcattactccctgatagacacttataatgatggaaaagaagcaaaaaagtttatgtactttcagctgttgtacatagatgctaaatattactatttattacaatgataatttttaaaacaaatatcttctgtatacaaattacattccaataattaaacctcatgttaatggagatatatggcggggttgaacagtatattttataatctattattttacaagaagaaaaactagatcagttgcaaaatatattaaatacaggctctgaaaaatgaaagactaaggatgttaggccccaaaaaagatacactggagttaacaaatctttattaatgcatgaggcctcccatgatgctggtttctgttctttaccattgaaaactgatcattgcttctggagaaggttggaaagatggctagagcttattttaatagccttacagatagctaataaagtttcatttattcagtgtcttttaaattatatataggtattaaattgttttttaagccattcctgtggtatagctgtagaggtgccaggctgcacaaataataatcctatacttgttgctttggagaagaaaatatcgtttgttgtaagcaaaattgtccaacaggttaaaaatggtctaattatgtgaaaaaactattttagtttaaagtatacattcgaaagtgctgatctttaatgtggtataatgggcccttgatttgttagcatcagcaaagcaaggctaacaatgaagtttgggaagcatttttactttttttttgtatcacttagccctttgttttagatatggtaggtccttgtgtgtgttgatttttttgtgtaatgatataattgaaagattatatcttttaggagaaagagtacatctatttgaaacataccatttctattccaaatgaaaaaaaaatcctttgcttccttagcatatgtatttttgaagacattgcttactagctcttcaaaaaaaagttatttagctttgttgatcctcaggttgttatctgtgaaatttgtaacacagatcttttgtgaagattaaatgatatcaggtatttataatacaaaatttctttcctcccccaactccacctctacatatttgatttggctccatttttgtctcatttttctatgtattttaagtatattttgttgacttatgttgcatatatattcgttagctgcctcaagtatttctggacaaaaatatgtatacttatagattaatacaaattagttcttcgttgaaatccttttgtttttgttttgtttttcagattaccaaatttgttaaatggattaaagtgtggagtcatatgatgtagttgcttctggctaacagcgttagttcactcttcagggtacaattttgcttctctgaaaattagttggtcttagttgtaaatttgactaattaaattatataaccaaaatggtacatataatactatatctcctctgtaagtgtaaatttgactaattaaattacacaaccaaaatggtacctataatactatatctcctctgtgagccctcaataattactaaataatatactttgcaatatcagaaatataaagtttttaagcaaaaagccccttttccctccaatattattttttccaatattaacctgttagtgtctctaatgtgtcatgcaatcttaagcctctttgaaatatagtagataccatacattattttaagtgttttatatgtgtaatgtactttaatcatcataataacctaataaaattggtaactattattatccccatgtgtagatgagaaaacagaggtacgaatcattaataaactcagctaaggttgccaggtgacggagtgactgaaccaaaatctgaagttggcagtctggccccaaaatcaacattcttaattgaaattctatatcacctcgatcactcgatcacttctaatatgtactttacatgtggggaaaagtaggctgctcgtgtgctttgggtgactttcctagtacttgtaatttcactgaatgatgacaaatttcttcctgatcccttgaagagagactagcaactgagtgattatttgtatgtaaactctatggtaatataaaagaagtgtttttttttttccagcaatgccaataatctaaaagacgctgggaccctactaatgtcacttgctcaattccatctccacatcagttaattcatttgggcagcacactttttcaccacaatgtaaaagtttctcttttctaatgcattctttgcaaagaattaaccatcaccatatggaagtactgtggagtttaatttcaatgtgttaaattttgatggtggaacatcagtgaattgactttgaaatctgaactgaactctggttcatttgtcagctggtgtaaagattcatgttctcttgtgcttgtggtcttacatctaccctgtggttttaattttggcaatgattagttagcatcccacttcatttcatacttagtcatccacaggaaatgataaagacaatgaatctcagatgtctacagactagatattgatttattactattttttcaagtttttcatgatttttccccctaagtggaaataggatttttgaaaatggatttctggctctgtgtaattgctgtatgtcagtgagcattccattagtattaaaaacatagtagatatgtccacatgttagagttttgaatatatttatagttacaccgagattgatattaaagatttgaaatttagtaaaatttttattacattaaatgactgtattgagcccataaaattatgtgttctcttaaggtggtagaaaatactatatttttaaagaggagctgaaaaaaaatatagatatagctatatccatggcaacagcatagcacccatacaaaagaaagccagggtgtgcttgttggatagctgcatagcaacagcagagttcagtatgggaggaggaaagaaagtttagaaccaagactatagtgtgctttctgaatgtattgcattgtgctgtcagtaagcctgattaatgtctttttgttcttgttcgatattttacatattatatttgtgattttaatttcaaagaatagttgaaaaatgtaggtgtatggtgtaaaatcagtaaatttgcacttaagttttgcattaatatgagtatgtgctattggaaattaaagcacattgttaagaaataaagttaatagaatgagttattgattatatttgtgaggaattggaatatgtattctataataaattcactttcaaatttagaaagggatgacccttattttataattatttttgttttcaatatgagtatgctagtgttcaaatatatattttatgtgtagaaaatagccatgctacatacttccagaaagccattccattcagttagtcatatgttttggacactgtacgagatagatctaagcattttgtattagtccattctcacattgctataaagaaatacctgagactgggtaatttataaagaaaagaggtttagttgggtcatggttctgcaggctgtacaggaagcatgatgctgacatctgcttggctcctgggaaggtctcaggaaacttttactcatggaggaagatggaggagtagccagcacttcacatggccagaacatgaggaagagagagaggagttatcacaagatctgattgttttaaaacaatcactatctcactcactatcccaagaacagcaccaaggagactgtgctaaatcattcatgaggattccgctcccatgatccaatcacctcctaccaggccccacctccaacactgagtattacaatttgacatgagatttggtggggacacagctccaaaacataccacattgttagggaggactacagcaaaacttgtctaataaactaaatagacatttctgaaaattaaaattcttagtttctaagtattgtaattcctttgtaaatctaaaccaaatcattaagaatcacatataagctccaaaggcctaagacagaagttgttaatacatacctttcagcccaattctaccttactcctaacgtaagaaacatgccagtacagccttttgtcttccatgtaaaaggctttggaatttatcccaggggtaaggtatagaaagcccccttaaaagataatgggactagttttcccagtattctaaataacatagtatgttttcggatcctttgtgttgtattcatctatgtatttgctctgtgtatgttttctttctctttttcttcctcttcctcttctttcttttcctctacctctccctcctccaatgatgctggatttactacctgaattatttcaagcttcactataaagtgtgtatataatattcaatagtcaacagtcagttggctcccaaataatatttctgcttaaaatcaaaattagcttcatgatatttaattatactttaagtctatacattgttccttgttgctgttaaagtttatgacatttcttatccactctttgctcccaaagatagtaaattcttgtctcttaatggtatttaagatggtaaagtagcctttaagatatttaattgtcaaaacctttcttaatggaaatatcttaagcattaaaaaacaggagaataaggatatattctagtttggctgacaatgtgtgagtgaagtagctatgaagaataaagaaatattctaatttggcagtgtgtgtatatgtgtgtgtatgtgtgggtgtgtgtgtgtctgcgtgtgaagtggctgtcaagttgcaaccagaatgtaactctactaggacttttggtgatttttgtttcttttgtttactgctgtatttccaatgcatggaagggcacttcaaacaaagtagtcgaagttttccctcagccacaagagccctttatgtggggctttatgtggagtacagttttaaaagtatgtgtctacattctgtgaatcagccattgtggataatgtcatatatactaacagaggaaagaagtgtacctgtgtgtgtgtaggaatatatatatatatatatatatatatatatatatatatatatatattatttatatataataaaaatatatattatatataatattatataatataatatataatataatatataatatatattatatataatataatatataaaatatattatattatatataacataatatataatatatgttatatattatatataatatatattatatataatatatagacatattatatacatatattatatatatataatatatatgagacatatggatgtttgggagccatataaatattttacttgctgaattagtaaaacttctgataaataagaagatacttcaagataataagtgttaggtagttttcattctctgaaacaatggaaaaacgcttgaattttcagacggtattgtccgtaaagattcacgacgcattctaggtgttccaggatggccttggaagcagtcaaaaggagaatgtttatggagctgaatcagaaaggatagattgcatcaccaatatacacaatgggcttgtcacatttactgatggttccctatgtactgggaaatgtcaggtgattcacatataatttgtcttttaaaaatataaaaatatatctgctggaaaaattgcaccaggtcaaatgtattttagagtatctagtgttataaaatagatgtgttaagtttcctgctataaatgttgatatttataatttcatttattttcataaacagttaggatgcacctattcaagctatcctttattataatataatttagatataattcaaaatttagctataattccaaattttgctcatttctagacatgactatatgactgaattgatgctgaggagtttctacaaattgtcagtgttttgttgttagtattatttgctattttcaaaaacattttaaaatttagtcaattttgcattagatattttaattgtggcaacacagagtatcaactggaatttattaaaaaaattattaaaaattgactcatgcttatatagtctaaggtaaggaaatcaaaccattttttttttcctacaaccatgttaacgctatgaaaactctcatgtcaagatgtgctatctttagaacaggaatggaattcataaaatagctctttgctacagagtttttcagctgcattttcaaaaccaaataatataatttattttaaatttaaattttaggcattttacagtagaattcatgaattattaggtttctatacatttgtttaaaaaacaaataggttagaatacataaacatttgtgtcctacttttgtacatttgtaatatacctttgtagttctacttttcatgtattgttttcaattatgaaataattaagttatttggatttaaatatagaaaaaatatttaacttttgttgtgaagaaatatatataatatacgtgtgtgtgtgtgtgtgtgtgtgtgtatatatatatatatatatatatatgaaatacacagttcatttgcccttgaaataagtcctccaataggaaaaaaaatatgccctttgtgaaatgtcgtctcctcaccacagataatgaaaggattgctttgtgatttgacaattaaaattcacttttatttgtcagtattttgtatgatattctgttcaatgacaccctccagttaaaactctacaatgtagtaacattgtattctgaatggtaatgcctgcatcttattgttgttatttttaaaaagtttaaagctaattaggagacacatctattattttgctactttatcattattcccttcagacctatgagctagattttatcaggaatgcatactgtatattcactctcagtttattcatgctgagggcatcgctaatttgatcatcaaagtgtatgtaccatgtatatcctacagtagattccttaaaggaaaactagggctgtgctattaattttaaagtcctaatgtatggctgttaaaaattaagctgtcaacattctccatttccagcagtagcacagtaatgacaaagacatattatggaaataaatagtaattaattttaataagtagcattgtacttacagcattgtcaacaggaaaaataaaaaatcttttatggagaaaataaagttgtaacatcaaaaaatatgaaaaagcagaatatatttatgattaaattaaggcaattttagaaattaaaactctcatttagcaatatttgataaagacatctgtattgcttctgaataagatatgtattaaaattattcataagacaatatggattaaaaacaaacttctggcttcatgatacttatttattgagtaatttgcaattaatacaaaatatttttactttctagggacaagagaagaaaaacaggcaatgctatggaggattagaaagctgattaacttgagatacatagcctcatgtttataaatttgacagaaaaaatgattcacattctatatatcagtcattaatttggtactgatgataatgtgcaatgtataatacatatctgtgtttactctgtttcttgattgcatatgtaatgtgctgaacaaaacctaacagaaaagacgtttttggtcaaatatatcaaattaaaagcacactattgatggtccgaagctgtttaaacagttaatagaattatctgttgatttcacctgatttcaattatactaatgtaattcatgtaaaaccttatatactcaaaaagtaaggaatttcccatggttttaagaacatcttaactctagaaacacagaaaaggcagagaaaaaaaaagatttggagttgttatctagaaaaatttcagtggtaaattctgatatttttcttcttccttacatgactgaattatttcacatactttttattgtgtctaagagatgttttgaaaaccaaaataacaaacagcatctatgcataaaataagagccagcaagttgtgtggagaatgtgaggtactctgcaaagtgtatttttataagccctgattttgctttccaatatgctccttaatgaccaacaaagagggatatttcttgaggatgacttcccttgacctttcctatttgtctagagtatttgaccaggatagatgggagactatgctgtgcagtggtaactgtacccaggagcaggaacatgagtaagaatgtacttgatggagacaagggaggaaggaagtgtaagtggctctggaaagctccctctggtggagaatgtcttaataataattcagaagccattactagaacaaggagatgatagattacctatttaaaggactttctcaatgtagaaggggccttcctaaaatttcttgttatctgttttaaagtctgtggtagaaataaaaattccattccctaattcaaaaattcagcattcttccattgccagccaaattagctaaagttcaaacataaaaagaatcaaagatctttgggttccatattttccttattcccttccaagtctagctggatttcagagatacatttattactgtaaaacaaatgctcaataatagaataacagaagacaacaaatcttccaacattttgtttgatttctaaaatttttgttaccgttgttggacataatattttacatttcctaccagcactgcctgctgcttaaaaaggttgtttgctcatcttctgctagagaactctaaaaggggtcaatttttctccgaaatcattctgccaagggcagtcgttgatattgctgtcagaagaaagaaaaagacaatcttatgtaggtggaggggttttaacctttttaggtcattggctgttttaaaaatcagaaaaaagctttggattctctggctcagctatatactcataatattttgcatgcagttgcagtattttcctgaagtcacaatagtattcccaataccacggttacaatagtatccctggctctctctctggtgagctaccacctcatttaccttcccactgcctcctacaccttgccatgactagatcttctgaaggttaatgtaattcctcaccccgaggaaggttgaaagtacagtctacataatcatgccccacaacggctatctttagcattaaacaccctggctctaagactctcatcttttatcacaggaattctgcattgttttccgagactggttcctactaagaaattccaggttatggtactccagtaatgaacactaaatattgagaactccctacttccgtagcattcatttctcacaccgccagttaatcagttcctgaatccttgccttctatgattgtgtttgtgtatatatatgaaatagacttgaccctcagtcctaatatcagagttgaatccctgttacaatttttttgttgataaataatattatctaatcacaatgactactgtaagtatacaattgggaaatgttaacaagtgctatgcaattaaaaaaaggttttgtggtcaatgaaatgtggaaatattatataccgcattctctttgggagtttacaacgcctttcaacatacactttaagtagcatcacagtaatggaaaccggcccttaatactggttaacccaaagtttgtcaaacatatctgcatacataacaatttctataggacagtagttaataacataatgttgatagtttaggaagtttggtgttttaggaagaaactcatagccaagcctttaataagatatatttctgtaaaaataacttccacagtactctttatggccaccagtatctgagatcattatattgaaattatggtttattaaaagtgataatttagttgatcctactgtattcctcatacatagcagagatgtggaaagggacagtatggggtttgaaaatttacaacttcaaaaactattttccttaaataattttctcttgtctgatagaaaatcagtgactctgatatgacatgaatctgattcccttcactaaatattcatgtgaccaccttttctgaaaggaaataatactctaagaagtaaccattaaaacttttattatgttcagctccacagttaaaaggacccattttaatatctaattgagtctacttccattttagtagtttactatgaatgtcatgattgttttctaagtaggtgctacaatctttatcactggaatttccttccatctaagagaacagaaaccgagttaatgtatctgaatttcaataaggcatttacaaaggtctcttttagtgttcctgttggccagatggaaaaatattcactgatgatatggaactgggtaggcttattattggttaaaagtttgtactcagataaccctgtgttatggatttgtattaactgtaaggagatatctagtgatttgtcatatagtttcattcttgcccctatattattctaaaggttcattattaatgtgggtaagaacactggactcaatcttttcaaaattgcaggtgctatgaaactggaagaaatattaaatatgttgaatatgttgaattacaaaatagaaattctgggaaatggagaaattttaagaattaggtagaggttagcaaatcatgtttaacagagccaattttaagtcctcttttaaaaaaatctagcatcaattaaacaaagagcacaattacagatggggataaatttgatttgactacagcatgactgtttagctagattctgaatttaacacggaagacagatagaaacaaacattaattaagtgcatactatatgcacacctggggctagttaccttcatgtactcacttcatttaccttcaacaacaaaccagtgaatagaaatgactataaatagtataatgacaaataaaattaattgaaagaataaccgccccaagatcattcagcaaataagtgtcagatctaacttttattcccaaatttatcaattagaatttgcattgttagtaataaaatatagaaatatagaatttaagaagagtgaaaagggtggctctcccttggtccaaccacatctaaaggctgtgtttagttctggccctgactgcggagggaggttaatagaatggatcaagtccagggaagaacaaacaaaataatttcacattatgtgcatttaaataagtttgaatctatttattttgagtaggaaagttttctggtaggatatgataatgatttaatataattgaaaggctatcgttttaaataaaaattagatactttcccctccactttgctccagagagaaattccaggatcgatgagaggaatctgaagagtttcaggttttactcaacataagaaaaacacttcatattttgctgctttaccttttattcctagctcttattatcttatggtataatatacaattttatcgtatatattttctgtttttctcactaagataaaagttccatgatgtcaaggatttatgtctgcttaatcatggcatttttggcaccaagcctggtacccaggataaaataggtgcctaataaatatttgctgaataaatgaaatcaaaccagagattattggattcaacttggttctagcaaatagtttccttactgacaaacagtattttccttactaatagccaaagaagtattcatataatttgcgaattcataaaattgtacatatttgaaagccaaaggagcgctgaattctcaaaaagtcattttagaaagtggcccagaatgattgattaatctatcaatctctatatgtgagtacactttggaagtttttagtcataatgatgttacaaattgtcatcagactgtttcaaggaggtatgagctctgtagttaaacttccaaggctctttacttgcaagctgtctgatcttgaacaattgatacgacttcatggttactttcagcaccttcctcctgacattattttgaggattaaaagtcataatatatgtaaagtacttactgttaccttgtgcttagtgtgaatataaatattaaataatattaacagtattagtagaaaattatggcattgctcttattatagctacttaccattcatactgtatatcatgaaaatgataaatattgagattgtaaaaaaaaccattcaacatttagaagcactcccagggtctttgcaaaacaaaacaaaaatgcatagttcctctattgtccagaatagataaataaaatgttaaaatatggaataaatagaccactgtgtggattacacgtataggtaaaaatgtcatcctcaaggaatataatgtcactctctactcattttgatcttctcactaacttgatctttttaggtccaacccctcttctgagctttcccttccttctcttgaaggattgaaacataatagcaagttgagtagccacaggcagttttgctatacaagactagctcactctctcccattacagtgttttctttgcttttgtgaaaagactcccacactggtgtctgctgctaaaatcaattctggaaaggtattttaaaaaatgaccctcccttaggacgtgacagatctctgatggtgtctttgtcttccttctgtttttgaaaaaatccacagtattttctccaaaactttattatgttttatgaaaacataccactgacagcttccaataggaatcagaagatttacattgattgacctaggatgcacttcaattatctagcctgagcctatatcatctttttaaaacgtttgcttttaaaaaatgatttatattgccctgatcctttgaaaagtaaatttgacacatgataaccctttaattctacataattcagtgtgcaccccttgagaagcattttcttggctgggcgcggtggcctgtaatcccagcactttgggaggccaaggtcacaaggtcaggagatcaagaccatcctggccatcatggtgaaatcccatctctactgaaaatacaaaaattatctgagtgtggtggtgtgtgcctgtaatctcagctacttgggaggctgaggcaggagaatggcttgaacccgggaggcggagattgcaatgagccgggatggcaccactgcactccagcctggcagcagagtgagactctgtctcaaaatatatatatttatatttccctgattttctgaaagtaaattggacacatgataaccctttaatactgcataattcagtatgtaccccctgtaaagtattttcttattcagttacattactgaagtaattatgaaaattagaaaaataacactgactcaaaattactatttaaactttagacatcattcaaatattattttgtgtcccagtaatatcattcatacctaaagactatactttttgaacatactaatatttttcataaatatttctttatcgccttccttaccctgcgttactgaaaacggtgtgttttggtcatgtttattttgaacatagtgccaaacacattcatcgatattattatattaggttattcttgcattgctataaagaaatatgtgagactggataacttacaagaaaagaggtttaattggctatcagttctacaggctatacaggaagcatggcaacatctgcttctggagagccctcagggagcttttactcatgggggaaggttaagtagaagcgggcacttcacatggtgaaagcaggagcaagaaagagggatagagtggtgagggcgttgccacacactttaaaatgactagatctagtgagaactcactattatataggtaggaccaatccatgagggatccactcctatgattcaaaaacctcccacaagaccctacctccagctttggggattacaactgaatatgagatttgggtggggacaaatattcaagttatatcaattattatctttccatctcctttacatatagatactctatagaatgatgcagtgtaatcttacataatatctctcttcaagtttgaacaatcattttttctaggtatggaacaaattacttttatggaatttttatttcctaaacttccctgcactcaacctacatatactctgaacaaatctgaatatagttggatttagaaatctagaatagtcttatatgtacttatatgtggcatacagttaattatgtaaggaaatatttgccctatataattttgtgcttcattttctgttcactccatgttttattttctttcaccaaccaattttcattgttttatttgactaattcctggctacaaacatgatcaagttgctctttagttttggggaaacttaccagtttgtatgtattggtccagtcaaagggggtaaaatattattagccagaagttttctgaataaacataataaagctaactcgatgttcattttaatggaatttttatgttaaagcctagtgatctgatgaaatgccttcccagttacatatatttctatcatattagtgttggtcattttgaataaaagttgtcactttgctggatagtgtcacagaaatactggtactggtcactggttaccacttttaactgaaaggaacttgagtgtctctgcttcagtgatcatattttcaattattaggaagctaagcaaagggtgatttggtttgtataaggttactcactgagtcggcagaaatgccactgatctcattttatcatatctgctaggttttatgtgacattgaaatgcctcattgtccaactcttgttttttgttacaatgaagatcactaatatattatttgtatttgtagtaatatcaataatcatctgcaattccactttttatattgcattataatttatcaactatttttaatcagtgtcttctacatttgactttagccaaaaagctaagaaataattattttcactgattttatttgaaatggttctttactcatggtgcacagggcaccataattttaataaaactttaccgttcaatacagttttgattaattccaacaactaatatcattcattaatcataaattctagaaaactttttttcacagaagctaaacttcctgatctggctgtggctagttttggagtctgttgttcactggttacaatgcttatatcattctctacttatattttaattagaagaatgtaagtagttgggtcacaggctgaaaaatgacttaaaaattaaaataattatagacaaagcccaattaaacataaatttcaaaactctgcaataaatactttttattctaaaaatttattcagtttctatgaattccaacttgaaagaattattagttttctataattatatgtgctgtcagtaaacatttattttgatgtgaaataattactatttacaagccttaattgaaataaatttgtttatgtagatctgtatacttttttcctacataagttatttttaacagctatactaaaatttagtttcctcttagtgtgtaattttgttattttatatttgtgtaatattatttttagtcttcctaccaaaagttgacttttcagttgttcattcttagagcacagtgataataaaaaggaatctatacttaattctatccataatatgctttggcagaataaacaaagtaactaacacattaaaattaccaagtaattttaagttctaaattaaataaacaatgaacaacacataaatattttctttaaaatattttgtgtagaatatagagtttgtttccacaattattcaaaaattagcttaaatacccacatattttgttgatgtactaataatggggatatttttacaataaaacatagaattaaaaattatgattttggagaattcataataaggtagggatatagtatgatttatgtaccctttgatctcacaattaggtgggaagacaatgaataagtaattcactcgataaaaaatattgttaagaaatgtatatataaaataaaatattatttttacagccttttaaaaaaggttttcaaacatattgactgttgatcttgcgaaacccttcattacttaatatctattaaaatattttcacttatcaggaaatttataattatctgtaatggtttatataagagcaccaaaatgttaagtaagcacaaccaaagctcaaccccaggaattctaacttaaaaatttcattctggtctataacgagctctcttgccccgatatatttattctatgtagctgttggcactatctatctatgtgtctcatagataaaaccacataatatctaaaaaactctagttataatataatagcataggtaacatttattgtatacatatgtgtcatattttaaatatattctttccattccttgcacttagagagttgggtgggattattcctatttcaaagatgagaacactgaagtttagtaactaataaatgagtaattatttttgagctgatgtgcccctaaaggccaatatctttctgcatctttgattatttatacttatagaaaactacattttgtacttagtacttggtaagtagattttgaaatacgtaataacctattagtagatttttcttatgcatacacagctttttaagtaatagaagaatttttatgatacagagaaatagtatgataagacatattatttatttcactttttaaagccaaactgatttaaaataaagtgataccttaaatgacttgacatatggtctgaaatgtttagactgattattggtgaaatattttgggggaaatttgcactgtaaattaaagcattatgtttattcaaggtgacaaagaaatgtacttcaatggcatggtactgttttatttcattactaaaaacaatagaactaaagtgctaaaggtaaaatagagagcttgtagtgcattatattttaagaaaaatgagacccagaatgtcttgcatgttatatttgccaaaatatttgataaattcagcgaaacaaatgtttgccgattgctttttgtaagtacctctgatatgtgcttttatatacatggcctaatgatcttatttatgagaatgacttatcatcatcatacacagtcatcttcaataagcaatttttaagcttataccattggagagacacttcactagaagatgtggcatatacaatgaagattatgtcatacctaggagtgagagcctaattacggagatgaggctagtgcataaaatatagttaacaataaagatagcatgtaaatgccaacaggtgtataaatcgtaattattaaagatggtcaaagcaagacaatatcttttatgaaattattttaatcccttactctttattatcatccaggagaagtcaagatctaaaacatagttcagagaagcagaaaagtttcagcacatcaggtgcttccagtcctggatgaattctaaataagaaattccaatatagtagtgttgacctagcaacaatttaaataaaatgatttcctttttatttgcttctctgaagcatggacaaactgctcattaacagtagaacaaactgctgtccacttttatagttatttgaaatataaaaatcaattattagtcatgagaatgaatcacgttttaaaacaagggttgagaagtaaagtattttagttttttttcaaggcaagtattctaaaatgccagcattaggtccatttacaaaaagttgaatcattacattcttgaaattctttaaaataatcatgtaaaactttaaaaatcagaacaatattacaattattatagataatttgagaaggataatttattccacaaatattttatataaattacttagctttgtaagctaaaatatcatgtaggattttttttagtctctctgttattaactatattaaaaggaagaaaaaacagctgagaggaaaattataataaaactctgtgtgtttgtatgtgtgtgtgtgtgtgtgtgtgtgtgtgtgtgtgtgtgtgtgtttctccattcagaagaaataatggaggaggagttaggctgttaaccaagcctagcactgacatcattcaagagtcaaaaaatataatagaaggcatgcctaatacattgtttactattggaaaattgaagatcaagagaaagaaaaaagaaattatttatgtcacccaacatatggaataaactgaaagtgaaaagaaatgctcctattatagcataaaacaactatgttactgttgcagcatagaagtggcatgaaaatacatggggtaataatatcagaagtagtagaggagagtggcctgaaaccatagctcccatcatgaggggaaggggacaaaatgttacaatagcaacccaaaatacagtaatgtctgagaaagtgacagagggtacatggttaatgaagagaacatatcagtaattaataatgaaccatatggaaacgattttatttcttccacacctttgagtaagggttgaatcagaaagaatggtattgattaccatcactatacctactccaagttaatgtggcctggggaaactagaatcacttgcaaatttgtgttcacacaggtgcttcagactgtaggtgatgcttttaaatgtaaataatgctctatattccttttggagaacttaccttacaaatatgctggcacacacacacaaaataatatatgcagagacattcatttgcagcgctatttgacatggcaaattttgactactcctaaaatgttaaatacattgtggcagattaaacaataaaatcatatgcaattaagaagatggaatatctatatataaagatatgaaagtatcgtcaagatatactttaacaggaataaaacaagatgccaaagagcagcatgtatcaaatcaatcatttattattatttcactattattattattattaatttgagacaggaattaatttgaaacctgttgcccagactggagtgcagtggtgtaatcacggctcattgcagccttgatctcctgggctcaagtgatcctcctgcctcggcctccagagtagctgggactacaggggtacaccaccacactgggctagcttttgaatttttggtagacaagtttttgccatgttgcccaagctggtctcaaactcctgggctcaagtgatctacctgcctcggccttgcaaagtgctgggattacaggcatgagccactgctcccaatcacttatttttaaaggtgaggtagaggataaacttcatttgtgtttccttgtacattcataacaattctggaattattcttaaggaactaagagtagtcatcatcgttgaaggaactggaagtaagaattgggcagatgaaggaaaaaaatgaaagaaagactagaaatgcatgattgtacaactatttagtatttgctacattttcagccatattattacaaagtgaaagttaaaaaatgcatataatttaataggcatgttatgagcagtgggactgagtgagctgcctcacactgttaaacgtgataactacatgaatatagtaaaaggatcagatagtctcataaagtccgtaacaactcaaaaaattattatttcttgaattggtaatctattcatttttattttttacatttaaagctagagctacaactggtttagttagagaccaaattactcatccagtttctgtaagccatccacattttactttcatgaaaacacacatggtaagtaaatgtggagatatcaaaaaggaccctcggggtatgtcattgagaactctgtgaatgagctcaggtttctgcatcctaccgtaatacaggccaccgttttataataataaccccgaggacagttgctctttccagaagtgaggtgagtcacatttgtgtttgtgctccattgactgccttttcccttcctccgttgagctcatagtccgagattcctcaagcagttcccgtcttccttcaggcccactcctaattggaacccatctatcccactaacagccgttgagctttaccctgtgaaacattctggttgttgtcttttcaacttgaagtcatatcgaaagatgataattgtaaggctaaattcaatacttggggttagattatactgtattcttattcgctgacaaatattatttttgtgatctcttaatttagttttgaagctttataaagatacacaattaagaccctccaattacatatttcacaatttaactttattggatagaataaaagcagctctctctctctctctctctctctctctctatatatatatatatatatacatacatgtgtgtttgtgtgcatgtgtatttaattatataaaatttttcaggtaggcaaaacatattattttattgtaattagaatttcagagctagaagatattttaaagatatatctcaactattcaatttacagaagtggaaacaaactcaatgaataaatacatagttacagatgtagttactttacgtattgcatgtgtgtataattatataatttttcagttgggcagagcatattatttcattgtgattagaatttcagagctggaaaagattttaaagataagtcttaactatttcatagtagtggaaactgaaactcataatgaataaatacagagtcaaatgtagttactgtaagtattgcagctataacctgtctcattcacattttaaataagagattcattaaggtataattcaaataccatacaattctctcttttaaagtgtatagttcagtcatttttagtatattcacaaaattgtgcaactaccacagctatttaatggtaaaacgtttgtatcactccaaaaaagaaaacctctatccattatcagtcacttcccgttcacctctccctccagttcccagaaaccaccaacatacattcttgtctctatgcatttgcttactctggacatttaacacaaatagaatcatgcaatatgtggccttttgtcacagcatctttcagttagtaaaatgttttcaaggttcattcatgctgtagcatgtattagtactttattcctttttattgtcaaataatatcccattatatggccataccactatttgtttatctactcatcaagtgttgggcatttgagttatttccccttaagggctattacaaataatgctactaagaatatttgtgtgcaagtgtttgtgtggccctatattttcaattaccttaccttacacctgggagtgaaattgctgggttctatgataacttcatgtttaacattttgataaacccccaaattgttttccaaaatgactgcgccattttacattaccaccattaacgcatgaaggttcttatttctctttaccctcacaaacacttattgcatgccttgaaaaaaaattatccttgtgagtgtggtgtccaattgaagttttgatttaccttgccctaaagactcatgatgttgaacttccttcatgtacttacatggccacttgtatatctttcttggaaaaatatctactgaaattctttgcaaatttttaaatttatctttttatcgttaacatgtaagagttatttaaataacctcaatataagttgctaatcaaatatgatttgcaaaaactttctcccattctgtgggctgtcttttgactttcctgatgagatcctttctttcataaaagttttaattttgatgaagtgcaatttatctattttgttgttgttgctgtgcttttgttgttatatataagaaacaatttgcctaatccaaggtcacaaggtcagattcctttattttcctttagaagttcatttacatttttaacatttctttcctcaaagaagtttattatatgcaatttggcaatagtttaaacaataaacaagtaaaggaactagaaagcagatattacatgtttatatagtaatttcaacttcattctttcaattgttatttatcagatacctatagtgaaccaagcataatgttaggagctggttttttaatgtaataatttatttagttttaacaccaattctttgtggcaggaattatgtgcagtcatacatcagagatatcatgggtttagttttagaccactgcaataaagcaaatatcaaaaaagcaaatataataataaagtgagtcacacaaatttttctgtttcccactgcatataaaaattatgtctacactatactgtatgtctacaatatactgtagtatattaagtatgcaatagcattatgtcaaaacataattaacatttaaaaataatttattgataaaaatgctgactatcatctgagcattcattgagtcgttaatatttttgctactgcaggatcttgcctcactgtttatggctgctgattgaacagagtagtggttgctgatggttagggtggctgtgggaatttcttagcataagaaaacaatgaagtttgccacatcagttgacactatcttgcccatatcttttctctgtagtatgcaatgctgcttgaaagcattttacccacagtagaatttctttcaaaattggagtttattctctcactgtgcagctgctttatcaactaagtttatgaaatattctaaatcctttgttgtcatttcaacaatgtttgcagcatcttcactaggaattgtctctatctcaagaaaccactttttttttcctcattcgtaagaagctacttcttatctattcaagttttatagtaagattgcagaactccaggcatatcttaagtctccaattctaattctagttctcttgctatttacaccaaatctgtagctacttccttcaccgaattcttgaatctctcaaagtcattcatcagggttgaaatcaacttctttcacagccctgttgatctgtgtactttgacctcctcccatgaaacacacgtttttattggtatctagagtggagaatcctttcctgaaggttttcaacatatctgcccaaatccatcagaggaaccactacttatggcaggtatcaccttatgaaatgtatttttgaataataagacttgaaagtttgtattactatttgattcatgggctgaagtatggatattgtgttagcaggcatgaaagcaacattaatctccttgtacatgtccatcagagctcttggatgaccagatccactgcaaatgagtactaatatttttaaaggaatcttgttttatgagcaccagatctcagcagttcacttaacatattcagtaaaccatgctataaacaaatgtacattcatccaggctttgttgttccatttatagagcacaggcagaatagatttagcataattcttaaggcccctaggatgttcagaatggtaaatgagcattggcttcctcttaaagtgacctgctgcattagtctctaacaagagagtcagcatatcctttgaagcttcgaaggcagcaattacttccctccacctatgaaagtcctacatggcatcttcttccaataggaagatgttttgtctgcatggaaaatctcttgtttagtgtagcctccttctttaaatgatcttaacctgatcttctgcataacttgccgcagcttctacattagctcttgctgcttcatcttgtagtttttcatatgaagaaggcttctatcttaatgcttatgaaccagcctctactggtttccaacttttcttctgcagtttcttcacttctctcagccttcagagaattgaagagaggtccttgttctgctttagactttggcttaagagaatgtgtggctggttttattttctatccagaccacccaaactttcttcatatcaggaagaagcttttttgctttcttattattgatgttttcacttgagtagtacttttaatttctttctagaacagttttgttgcacaactcaggtgtttggtgcaagaggcttacctttcagcctatctcaacttttgaagttcctctctcagtaagcctaaacatttgtaacatttcattgaaagtgagagacatggccaggcatggtggctcatgcttgtaattccagcactttgggaggctgaagcaggcggattatgaggtcaggagtttgagaccagcctgaccaatatggtggaaccccatctctactaaaaataaattagctgggcgtggtggtgcgcaactgtaatcccagctactcaggaggctgagacaggagaatcgcttgaacccgggaggcagaggttgcagtgagcagagattgcgccactgtactccagcctgggggacagagtgagactccatctcaaaaataaataaataaataaataaataaataaataaataaataaataaataaagtgagagacatgtcactcttcctatcacttgaaaacttcgaggctattgtagggttaactggcctaatttcaatattgctaaaatagataatagggaggttcaaagacagggagagagatagggaatggctggaaagtggagcagtctgaacacgcataatatttatctattaagtttactgtcttatgtgggcatagttcatggctgaccaaagcaatgataataaacatcaaaaataactaatcacagattaacataataatgaaaacatttatgaaataatcaaatattgtgagaattaccaaaacgtgacgcagagacatgaagtgaacacaagctgttggaaaaatggcatcgatagatttgctcaatgaaggattgtcataaaccttcaatttgtagaaaatcaatttctgcaaagagcagtaaagtttaacacaataaatctaggtatgcctatattcatttttttccaaaaagaaattaagagttaggtaacttttctaaagtcattgtatgaaagaatgaagatagagttaagagaaaaacaattctgattctagggaaatgcaaatcaaaccacaatgagataacacctcataccagtcagaatggggattattaaaaagtcaagaaacaacagatgctggcaaggctgtggagaaacaggaatgcttttacaccgttggtgggaatgtaaattagttcaaccattgtggaagacagtgtggcaattcctcaaagacctagaaccagaaataccattagacccagcaatcccattactgattatacccaaaggaatataaaacattctattataaagaaacatgcacatgtatgttcattgcagcactattcacaggagcaaagagaatcaacccaaatgcccatcaatgatagattggataaagaaaatgtggtacatacacaccatggaatactgtgcagccataaaaaggaaacaagatcatgtcctttgcagggacatggatggagctggaagccattattttcagcaaactaacacaggaacagaaaaccaagcaccacatgttctcatttaaaagtggaagctgaacaatgagaatacattgacacacagaggggaacaacacacactggggcctgttgggctggtggggagggagagcatcaggataaatagctaatgcatgagagtcttaatatctaggtgatgggttgataggtgcagcgtaccaccatgggacacacttgcctatgtaacaaagctgcacatcctgcaaatttatcctggaacttaacattagattaaattaaaaataaagttgattctaagcattctgtaaccatatcagatatatggttgtggttgatagctcgaatgtcagagatggagaactgcctgggtttgaagaatggcgttcaaactcccagcaattcgactttggtctagttaattaactgctttgcatttccatccatgcaaagtgcaaataataatatttatataggacagttatgagaattaaacatgttaatgcatttaaaatacttaagcttatgactggcatgttattaatgcacacaaaatgttaaaatgttagttatatttattcataaaatttattataaatctctgctgtctggaactgacattctattagcggggacagacgctgaactaacaaccatgtaaatttttatgtaattaccaattttggtaagtactacatagaaaagaaaaaagtaatataaattataaaagtgattaggtagttcaagatattcaagtatttctttttctgttccttgctgtgggtgttaaaatctttttatatttgttttcttaaattttcatacaataattcatttttatatatgtatatggtgtttccacatagcaatacataagggaaaaaagttgattaggataaaaatatcctgactctcaactgaaaagtaggtaaaagttacattcagtaatacaaaaaaaaaaaaatcagcttatacaactatttcatgaggtcttatttctaatggaaatttagtatcatcacttcaaagtatttttagaaatacggtataaatcatatatgaattagggttctcttagagggacagaactaataggatagatgtatatataaaggggagtttattaagtattaaattacacaatcacaaggtcccacaacaggccgtctgcaagctgaggagaaaggagagccagtctgagtcccaaaactgaagaacttggagtccaatgttcaagggcaggaagtatccagcatggaagagagatgtaggttgggaggctaggcccatctctcctcttcacatttttcttcctgttttgtatttgttggtggctgtttagatggtgcacacctgattaagggtgggtccacattccccagcccactgactcaaatgttaatgtcctttggcaacacccttacagacacaccaaggatcaacattgcattctccaatccaatcaagttgacactccatattaaccatcacaatacaattaataaaactaatacataactttaaaattataaaatctcatttatcccttaaattttaggcctttagtttttgaagcactcaaaagtcaaagttaaaaaagttactatcattataatgttacagtcaaatgcccagtaatgtacattaatgatttcattttagaaaacatgtgcacagttcttactggcctagaacagaaaatgaggacattgtgtgcaaatcaatggggacattgtgtctctggaagtgactagagttttgggtatttttcctttttttaaaaaaatgtcaacttttattatagattaagagatatacatgcaagtttgttacatgggtaaattgtatgacactgaggcttaaggtcccaacaatcctgtcacccaggatgtaagcatagtaaccaacaggtggctcttcagcccatgaaccccttcttttccgctccatctagtgatgcccagtgtttgttattcccaaccttacaattaggcattttcaatgtttagctcctacttataagtaagaacatgtggtatttggttttctgttcttaagttagtttgctgaggataatggccctcagctacatccatgttgctgcaaagggcatgattttgttctttcttacggctgcatgtattaatccgttctcacactgctataaagatactatctgaaactgggtaatttatatataaaaaaggaggtttaattggctcacagttctgcatggttggggaggccaccagaaacttgcaattatagtggaaagcgaaggggaagcaaggcacctcttacatggtggcaggagatagagagagagagagagtgcgtgtcagatactgccactcttaaaccatcatatctcatgagaactctctatcacgagaacagcatgggggaaactgcccccataatccgaacacctcccaccaggtcccttcctcaacacctggggattacagttcaaggtgatatttggatggggagacagagccaaataatatcactacataatattccatgatgtatatgtaccacattttctttatccagtccactgttgatgggcgcataggttgattccatgtccttgctattgtgaatagtgctgcagtgaacatataggtgcgtaggtctttttgatagaatgaattatttttctctgggtatatacctagtagtgggattgctgtgtcacatggtagttattttttaagttctttgggaaatctccaaactgcttttcacagtggttgaattagtttgcattcccaccaaaagtttataagcattgtattttctccccagcctcaccaacatctgttattttttactttctaataattgctattgtgactggtgtgagatggtatctccttgtggttttgatttgcatttctctgatgataagtgatactaagcatattttcatatgtttattggttgcttgtatgttttcttttgagaagtgtttgttcaggtacttttcccatttttaaattggattatgtggttttttgcttgttgatttgtttaagttccttacagattctgggtgttagatctttgtcagctgaataacttacaattattctttcccattctgtaggttgtctgtttactttgttggtaatttctttttctgtgcagaagctcttttgtttagttggatcctacttgtcaatttttgtgtttgttgaagttgcatttgggcttagccataaattccttgccaaagtctacgtagaaaaggatatttcctaggttttcttttaggattgtcatagtttcaagtcttacatttgaatctttaatccatcttgaattaattttcatatatggtgagaggtagggttctagtttcatagacctcattcaatggctgcatatggctagccatttatcccagaaccatttattgaatagggaatccttcccccattgcttatttttattgattttgttaaagatcagatggttttaggtatgtgggtttatttctagattctctattctgttccactggtcgatgtgtctgtttttataccataccatgctgttatggttaatgtagccttacattacagtttgaatttaggcaatgtgatgcctttggctttgtgctttttttgcttacaattatattgcctattcaagctcttttttttttttttttttttttttttttttttgctgttgttgttttaaatgaactttagaatagatttttctaattctgtgaaaatgaccttggtattttgatagggagagtgtttagtctataaattgctttgggcagtatggccattttaactatactgattcttccaatccataagcatggaatatttattattatttttttttgtccctgatttctttcaacagtattttgtagttctctttgtagacatttttcacctccttggttagataaactcctaggtatttcattttgtttgtgactatgataaatgggattgtgttcttgatttggttctcagctagaacgttattggtgtgcaaaaatgctacttttcttttaactgattttgtattatgaaacgttactgtatttgtttatcaagaatgtttaggtggagtctttggggttttgtagatatagaatcatatcattgaaaaagacagattgacttcttcttttcctattttgatgctttttattttattttctctcttgcctgattgttcctgctaggacttccagtgctatgttaaataggagtggtgagagtgagcgtacttgtcttgttccagttctcaaggggaatgcctgaggtttctcccattctgtatgatttggctgtgggtttctcatatatggctcttattattttgaattatgttccttcgatgcctagttggtcgagggtttttaacatgaagggatgttggatgttattgaaagcttttcacgtgtattttggctgtaataccaaaaataagaagtgtgtcataacaacagaggcatgaagagacagccttcttttcccttatttccctcattacagagttaccattttaggtccattaaatgtattttcctactctataaggtgtccagttcaaaaaaatcacacaagggcctagagacctgaagatgaactctagagaatggtataatatgttttgtgtggatagagtatttcatttttaagtatttattactttctgatagattatgtcactcaatcatggtgtctaatatatagtattacttttataggtaaatttataagtcaccatttcagacatatatttctcaaaattaggactatagaacattcaggaacttggatttgtaaagggatcggctgctggtatgaccgaacatacaataataagtaaactaatgttaaaaataaattttaaatacacataataaaatattctataccttcctgggttataaaataaatatagttgatccaataatttttaagtgaatatgaaattcccttctacatatttagtttcaacatccctgcagaaattctgggagagaggaaagagagttacaatgtacttagagtttgttcaacagggtgtggcctgggacagactgtgctggtctttttcttgtggaacctttgctgtatcacctttccctaggatattgcactggcttttctctgtcatctacacttctaataaagagagaaggatgaggctataataaaagttctcccttggagtagtctctctagtttgtgagacttctcagatttaatgaataagaaaatataaatgctatattgaagtttgatgtatctcttcagcctatttcaaggctatgctacttgttagcatatccttcacatgccattaaactttttgggtttcggaggacacccaacatgactttccgggaagcatcttctatctgtccttgaacacgcttcaacttctttgtgtagtggggcaaactgaacttctatatgggcacatgttttcattaggcttcttcccatgacagagatgtttcgtgttacactacatttgttgactgttaaagtaaggcagtacatttaactatcaacacagatagctattcttgctaagaactatattttgaactcagtgtctgagaatatgtacaaaaaacttagttgagagatacaattcatatatccatgaacatttattgcacacgtattttgtatgcagtgaatcctccagataccattctgtgcattggcaagataagattgaacaatttggacaggatctctggcttcacagagctaacattctactagagatacagttttcatacagaagcaacatgcatggtgggctaagagcttgaattctgaagttgtacctgaatttaaatcctacttcaagcacattttagatgtgtgatcttgagcctctcttacatcatttgtaaagtgcacatagcaatacagattaataatcctttatctgaaactcttgggggcagatatttttcagaattcagaaaaaattgtatatttagaaaggtaatgtggtacatatcggtgtaatatttaacaacctaagtaggtctgcaaaagcattttttttttttttttttttgcaaagaaacacatgaatagtcactctcagtggaataagaagagattataaacagtctcacctcagttcaggtcaacagtatttgacaataaaagggttttaatgtcaaacttctgaaaaaaacaaacagcaacaataaaagcagccactggttttcatcatgtttttggatttcaggattatagctaagtgtttatggatatgtagcacttgaagaagacaacttatgtcttgtcagcacagattctggcatgtggtgggttcttacttgttattaatatcagaattggcctggctatttctttagaaagtaaaataattattattgactcaaccataccagcagatatttatgtacgtgaactgctttcatttgacaccttacttctcctcaaattatttttacagaatggacctttagaatttttatgtggaaatattatgaaacggaggcttgtgagactgactatattatttgcttcatatttaccttaatgttatagattatgtgtctttctgtgcaatgactggtagaaatcttacaaaatagagatcaatctccagcaaaatacaaggcttcactgtataaactaaatatgttactttattcttaacgttctttcatttcctacaatatttaaccaccttttcctgatttttaataaattcactttttaaacttttcacctgtattttcatatgctgtctcaagcctctctgtatcaagacataaagaataaatttgtgcattatatatagatatatatgcatgtgtgtgtgtgtgtgtgtgtgtgtgtgtgtatatatatatatatatatatatgaaatatacccacagtgtatttcttttttttgtttttttgtttttgagacggagtctcgctctgtcgcccaggctggagtgcagtggcgcgatctcagctcactgcaagctccgcctcccgggttcacgccattctcctgcctcagcttcccgagtagctgggactacaggcgcccgccaccacgcccggctaattttttgtatttttagtagatacggggtttcactgtgttagccaggatggtctctatctcttgaccttgtgatccgcccgcctcggcctcccaaagtgctgggattacaggccacagagtgtatttcttctttttctatctccttcatattttcagatcctagactaatccaataaccatcatctatttactatacatttttattttcaattttaattgcaattatatatcgtgttttttgtgcctgtgtgtgtgtgtgtgtgtggtgtgtgtgttcaattggctcttgtgagttagcctagaaaagtaatcatggtttatactctgatttctatcaagaagtaagctacatgtttccattacagttccatattgacataaaaactgtttctaaattggaaaccaagctatgtgccaacttatttattgcatatttttaaagaatatttgtgtttcactagtaagtcactttacttctttgcaatacacattgtaaaaatctttgaatattttttttttctgaatcacctattcctagaagtgtggatacaaaggaaagaaaaataagaggacaacatttatatttttctctagaaaacaatgttttctacaatattgatttgtaatttttatatttttccctcttctttaacctctaaggttttcatttatcatgtaaaataattttaaaattagaaacaaatcattttatatgagtttagcacatctcattttttcctactttcacattaattcattacactcaaatttcattcactgagaatttgtaataaaaataactattcatccctgccatactacttagcatttctattagcccatccacataccctgttgcactttacaaggcagaaactctgaattgcttacaggtcaccaagcacaccctggcatttcagacttttatctgtttacacctgtttttcctctgcctgtagcaaatgtcttcttctcctttgttcactagaacacatcctatgtgacctccacatcacaaatcagaggtcattgcttccagaaattttctactgacagtccaagggagcattcctttgtgttacttctagtgttcctctgtatttctctttaccagatacatgtgtgcatatttgtgtttattacattgtactgtactaaatttcagtgagtttcctttttagtatttgtataaatttaagggctacaagtgcagttttattacatggatatattgcatagtagtgaagtctgggctttcagtgtaaccatcacccaaatattacccattaaacaatttttcatccctcatcccctcccatccttagtgagtttcttgataggaggcatgtagctttttcattgctctacccttacccagtcatagcatttcctatattttcattgattgtatacaggcttaaaataaattaggttgaaattaaactatgtatgttagttttttttaaaaatgatccatttcatagaaggacttaaatagtaggccaatacccattggtaatgtgagtgatgaagaaggtggaagaagaatattagcagtttagatttacaccttgagtttgagtgccagttaactatccaagtcagtagtaagattagattgtgggccactggagaaagattacacataaggagaaaatcaaaaggaagaaaggtgtccaaagtgataaacttgcagcaatacctacatcttaagaaattccatcatttaatgagtttacatatggaaagtgtttgggaaggattccaaaaggatgggatgagaaatgctgcaggaaacacgggagaagttgtaattctgtaaaatgaaagggaaagggaatctcaaaaagaaatgactgtttattgtgttaaatatatgcatctgggagacattcttgatgttagtgatagtaatttcactgctgtaatgtgaagaaattttagtattttgaaagataaatggattttaagaaaagagagatgatccctacaaattttgaagaggaacacactagattgtgctagagaaggatatggggttgacagaggatttttttaaatgtaggaacaacttaaagaatattactttagataaatagtttagaatgaggttaacataaaagaacaaaaggaaatattgaaaataacaaaatgggaataatatattgtttggtaagtagaagttgcagctttgcactgacaatggtgatacataataaagtcttggcatcataagtaagtttgtagactggaaatgattagcttgagaatcttgctgcaccttgtatcttactgtctgagacaatagctagtgggaagctaacaatttattagaatggtaaaagttaaaagcatcttctcttacagtgagaagagaaaacatactagagatatatagaaagatgttcagatagccgtgcatcttcaaaaatgaggctggatgcacagaatctgtgggcacacaaatctgcaaaactttcgtgattgtctccagtggccctcagtagactggctatggaaacaaggagaatacatggtgatattaatgcaagtttggagttttcataattaatattacataaacaaaaagagaagcaatagagttaacatttttcagatgatagtcaaagggatggaacactaaattgaatctaaatttgatttaggagagaaagcaaaaaggagtcatttattctggctgatggtgccattgacagtgatgagctatcctagtaaatggtacaaaggcaaacatatggttgtggacagtgagcctagaaagtaacacctccttttaaatactgtgatgttgccagcagtcattttcatcataaattctatagaataacatgtggatgctgcatgaaggtttttttatatttagtttctactgggactatgttagtctaacattaaatttattgtttattatagggttagatccatttatacagcagaagacctcactaagtggtatattttccaataaaaactaaaacctgaatttaaaatcttaggagctgattatattgcagtggaaatttgtctcgcttcattattccatgaaagttttcattcatgttggtatctagatatactagacaagatgttacggtagtcagagcatgcttttcaccctgccttattattattattttgtttttgaaaaagaacaagataaattgtcatcttaaacccataacattaagtatttcataacttcttaaaaataaaaagcaaattttatcttgtaaaattttcatctaatattttattttcatgaataattactgatatatcttaacagaaattgttgataatattagcaataattcatattcttaccataatttaccactgacagattacttttatatgtattatcttctgtagagataattacattaaactctacaacaaatatagatttttaaaattttgtttatttttattattattattttaatagttttgggagaacaggtggtgtttggttgcatggaaaagttctttagtggtggtttctgagattttggtgcactgattacccaagcagtgtacactgtacctgtgtagtcttttattcctcaccctcctcccacagttcctcccaagtacccaaagaccattatatcattctttaggtttagcatcctcataccttagctcttgcttataagtgagaacatatgatgtttggttttccatttctgagttacttcacttagaataatggtctccagctccatccagggtgctgcaaatgtcactatttcattccattttatggctgagtagtattccatggcgtgtgtatgtgtgtgtgcatgcgcatgtatgtgtgtgtgtgtgtgtgtgtgtatgtgtgtatatatatatatatatatatatatatatatatatatatatcacattttctttattcactcattggttgatggtcatagtctggtttcatatctttgcaatcgtgaattgtgctgctgtaaacatgcatgtgcaagtgtctttttcatatagtgacttcttttcctccaggtagatactcagtcgtgggcttgctggatcaaatgatagttctacttttagttctttaaggaatctccatacagttttccatggtggttgtactagtttacattcccaccagcagtttaaaagtgttctcttttcaccacatccacgccaatatctgtttattttttaatttttacttatggccattcttgcaggaaaaagttggtatctcattgcggttttaatttacattttcctgatgattagtgaggaacaatttttttcatatgtttgttggctatttgtatatcttcttttgagaatcatctgctcatgtcattttcccactttttgatgggattatttagtttttcttgctgatttgtttgagtttcttgtagattctggatattcgtcctttgtcggatgcatagtttgcaaatattttctcccactctgtgggttgtctgtttattctgctaattatttcttttgctgtacagaaactttttagttgattaggtcccccgaatttatctttgtttctgctgcgttggcttttggattcttggtcatgagctctttgcctaagccaatgtctagaagagcttttctgatgttatcttctagaatttttaaaatttcaggtcttagatttaagtttgtgatccatattgagtttatttatgtataagttgagaaatgaggatccagctctattctcctacatgtggtttgtcaattatcccagcatcatttgttgaatagggtgtccttttgccacttcatgtttttgtttgctttgttgaaggtcagttggctgtaaatatttggctttatttctgcgttctccattctgttccattggtctaggtgcctatttttataccagtaccatgctgttttggtaactatagcttgtagtatagtttgacgttgggtaatgtgatgcctctggatttgttctttttgcttagtcttgctttagctatgcatggtattttttggctgcatataaattttaggattttttttctagttttctgaggaattattattgtattttaatgggaattacattgaatttgtagtttccttttggcaatatagtcatttttacaatagtgattctacccatccatgagcatgagatgttttcatttgtgtcgtctatgacttctttcatcagtgttttcaaatatatgtaattttaatgctcaaagaaggtgcaaaaataattgtctgcaagtttatattggcaatgtaatagttaataaaaataaatttttgtttttgaaaatgggaaaataatacacaataatcatgcttccataaagaacacatttcagatttgacttttaaagtcctaggtataaatataagtaacggagaatttagaagggctatgaaaataaaatgagagcaaaatactctgaaaagtaatcccaaagacaattgttatggtttgactatgttccccaaaattcatgtgttggaaacttaattctcagtgcaacagtgttgtgagatgaggtcttgaagatgtgattagctcataaggctcataaggattcagatagggaaaatataaagcaattaccccctgaggaactaacgctccagtagagtaattaattgtaacaaaaaggtaaaggcacaatatcatcgctattcaacatttttaaaaagtaccaggtatgtactaagcactatatataatagtgttcagaaattatcatattacatgccattgtggaggttgcagtataatgtgaggaggtggatgttaatcaaatgattaacaaaaaatataaaatcataatagttattgatatggtttggctctgtgtccccacccagatctcaccttgaattgtaataattcccacatgtcatgggacggacccagtaggaagtaattgaatcatgagggcaagcctttcccatgctgttctcgtggtagtgaataagtctcatgcgatctgacggttttataaatgggatttcccctgtgcaggctctgttgcctgccactatgtaagatgtgactttgctcatcctttgccttctgccatgattgtgaggactccccagccatgtggaactatgagtccattaaacctcttttataaattactcagtcgtgtgtatgtttttattagcagtgtgagaagagactaatacagttatacatgaagaaaaggatcaatacatggagctactatgttgtaccatggaagagtctgaggtagatttggtgttcatacatgcttctctgaagaagcagtgactgagttgaaatctgaagaatgagtataaatgagagcaatgagcatgtccccacactctatggctggaatgggtttggtgaatccagtgagctgggagatggccaaaatggctcatggaaagactgaaatggaatacactgcaaaatgaggctgagtggcagataaggagcagaccattgaagaccttagctctgtaaagggaacaaacaccaagcgtcaagacaaggatggggtgggagtggtggaattgtgacctgattgcatttgggattttaaaatgttacactggctgtagtgtagaggaaagattagagagggctaatggtgatagaagtagatgagtgggcaaggacaagataatggtggcatggacagaaagaattggaggcagatcagagatttaaatatgagacaaagtagagatgaattgctaacaaatgagtaaaaagatagaggcgggaaagatgtcaaggacaaaatctaggtttctggctagcttaattaaatgataatgatatcattcatcaagtttgggtctcctccttccacacccccctaaaaaggacattaggttaatgtttgtttagataccataaatgacatgtttagtaggtcctgttagtaagaaatctccatttctctggcctcatatttctatagagaagagcttcaaaaaataataataataacatgttggcctttatttttacttcttactcagtgctctccagtgaagatggaaaaattatctggttaataatttggaggttaatgttgtactcatatctctctccctctctttcctttctctcgtctctttcttttgaaggtttggggtatttctacatatttccagaaagcttaaaagcttaatttgcctctgctatagtgggatagattttgaattatccttcttgcttgttaaaatgtagacaagtttgtcattttcaggtagagtatgttgaaagctcattttggtcacagagataaactgtactctaatcagtctaccagtaataaagcttacacttcagtcttccatttatctttctcctgtgactgtctcttaattggcttttaacttatgagggaaagggaatgtgatttaaacctcctaaaactcttacatgtagctcaggaaatgagtaatctgcctctagaagtaattgaagctgtggatatggatgagactgccttgggatagaatcgagaggtaggtgaatagcctaagactgagcatctaatcacaactgagtgtcagttctggtaaattaagatgacggataaaatacgtcaaataaatttaaacaacatgaacattatatttgtgattttagaaaatggtaagaagccagattgaagtcatatctcgtgtttctggtcttgttaggtgattgggcaggttcaagtgggaaataactttttggaagagatatttctttaactgcttcttaaagttgagtaaaagttagaaaagggaagagaatgagcaaagcttgagaggaaaaagatagcaggaaatttcaaaatcaccttcttccttcctttttaccttaaaaacccatctctaagaactaacacttatttaggtgctgtaacttgaggaaaaaatgattcactagaaaaattctaggacatttatttcagtggttatttatatagtcaatagtaatcatcagaaaatatactctgaaaattggaaaatatacctattttatttacttaaatatttcaaattttacgctgttgttctctgaaaatataaaaatgaaatttcatcaaagtttcttagtcattattataaagtatgatattttcagcatgaattagaacaaatatatagtcttgacatatagcttattattggggattatagagttgtttgcagtgaagggattttagcacttcttttaaaaaattggtttcacaaaatgtatcactggaaaatttatttccctttggagaattctgctgtgactacaaattcactcttgtcaattctttgctatagctttgctagagagcatgtataatactaaactataatataaacttaattggattgatccatttatgtatttattgcatttgtctggaaattattaccataaacttttaaatagtaagttttaacacctaatatggtgttatgatgcacatagaaactatttttaaatttatagaatcaaataacttgattacaattttatgattatcctatctaagctccagcctagtacaggagtctgtttatcactgaagaccatttattagcatattttaaatataataaaagggagagcacatgcttgtgttataagacaaatcatatttttgttgtttacaaggtttgttttcatatttgatttgtcttctcctaatttcaatccctagtctgtccttcacataatacatcaatacaaaaatcaattaccaatttcaaatgataacttttcaaatagatgaagcagacatggacatcacccacactgaaatgttttttgttttgttttgttttgtttgagacagagtgtctctctgtagcccaggctggagtgtagtggtgtgatctcagctcactgcaacatccaccttctgggttcaagtgattcttatgcctcagcatcctgagtagctgggattacaggcacgtgccatcatgcccagctaatttttgtattttcagaagagatagtgttttcacgtgttgtccaggctgatctcaaactcctagcctcaagtgatctgcctgcctcagcttccaaaagttctgggattataggcatgagccaagctgcctggccctcacactgaagttttttttaatgtaaattctctgtcagttactacacaacttaaaaggtaaatgagaacagttctttttgtttttttcagttccatcatttactttttcatatggctagtttccaaatgctgcaccttttacatgatcagctctgagagctttatcttttattaattttatttatatttattaatcatggttatttaaattatttgtttgttgagtgctctgtatgtgttaagatctgtacggactgttttatatttattaatttagtaaatacctgctgagttcattctatatatctggtacttgaattcagtacagtggaacaatggatgtgttataggaattagaccttatacaattgtgggaggagctgaggaaatacagatggaaaaaggagaaagtttgagaaaagatcaccagtcagtcttcccaaagcactgtcacctttggcatgagaatgctgagaacccaagcacatttggttgctgaagtgggactgcaaatgaaagtttgtagaaaagtcagttagaagcttttgaccctgtaagatctatctgctgtaggcccactgctaagagtctggtagtgggtccaaggctgctgttattcaaacaggactaatagatgagaataagaattagacacaaagcagaagagagtaaaaacaagctagagtttgctgggcgctctgtttcagtcactctctgtgtctgatgtaggtttagagagtaatgcccactgcttcactttcctatcccaaatcttgcacaagttccttttctgttcaactctaatccagaactatacaaagaaaagaacactgggtagtatagttaatagcttaactattagagagccaatagttcaaatctgcaagggatgcttgggattcagtggtgaaaagacagaaaaagttcctcgcttcttgcagttacattctagtggtagagtcagaaaataataaatattttatttaatgtcaagcagtggaagttcaggaaaaataattaagcagagaaaggaatggagaatgatgccttggagcagcatgagtggaggatgagatgaggcttccctttttgagtaaggtggatgaggaagactcatctaaggaaatgcaaatgagccttagagacctcagtgatgtaatgtgaatctttcagctacctaaaacagatcagtactggcagagggtaggcagcaggtgggaaaaagcttggtgatttttggaagagccgggtagtgtgtctaaagttgaatgagtgaaatggagagttctaggagcagatttagagacctttccagggattcgttcaaagagaacattataggcatgaaatgagtttggacagtgtatgataggagtccactggagagttttaagcagagatgagacaagtttgaatttacattttattttattttatttttgtgggagaccagagttttattattactcaaatcagtctccccaagcattcaggaatcagagattttaaggacaacttggtggggaaggggaagccagtgagccagcggtgttaattagttaggtaggagatgaaatcacagggaattgaagctgtcctcttgtgttgagtctgttcctgggtgggggccacaagatcagaggagccagttaacccatctgggtggtgccagctaatccatcaagtgcaaggtctgcaaaatatctcaagcactgatctagcaagcagttcagggagggtcagaatcttgtagcctccagctgcattactcctaaaccataatttctaatcttgtggctaatttgttagtcccgcaaaagcagtctagtccccaggcaagaaagagatttgttttgggaaagaactgttaccatctttgttttaaactataaactaagttccccccaaagttagttcagcatacgcccaggaatgaacaaggacagcttggagaacaagatagagcctgttaggttagatctcttttactgtctcagtcataattttgcaaaggcagtttcaatccctccctttgggttttaaaacacctcagtcttatggtgtaggctatgaagatgggacaaatcctgccatctttgtagagagtagattctagcgagccaacgcgagaaaaatggagtctacatgaaaaatgatagctcaaactgggaatctagctgatgtggtagaaagaaatatatcctgaatctaccttgtaggtagagctatatagtaagactagctaatagaccattgttaaaaaagcaaatggagttaaggatcatcctaatttttttagcaaataagtgagttttggcagtatttgcagagatgagtaagaatggaacaccagtgagtttaggagataaattattttctattagaagttagagattttgtgttgattaggcagttacaaagaaaggaattgaggtgaagcgaggagagatggatattgaggtgtacattttgtagttattcaagtccataatgtgtttagggacacgatactagaaaatcagtggggaagatggtatagagtttaaaaagtgaagagaagtgatattcttgtggcaaagattgtgtacaacttaataagagaagtgttgttacattcttatggcatatgcttacctggagggagtaatgcttcttatgcataacctgatttatatcctattttccttcacaacagatttgagctgatgttcaataatacttttggcactccagaataaaatgcaaacagagggtagttgggtgcaagagagaaccagggtagttaaattttgtagccgaaagtaagttagcacaggtgtattaaaaagaaatgatgatgaagatgagctgcagatttttttgcagtgtccaaaacaagaggagcaacacaattagtcaaattgttagaagatttataatattcataaattaaaaaataaaaaagagaaatggaaaaggaagaattgctctgaaaatatttgcgaaggctctgggcttctatgctcttcaagtagtgttaaaccaatttcctttgaattgtctgagatgatattacatagtatggcaagtgatatttggaattcttgtgacattatgttactgaaatgaaattcaataaaaacagtcctacagggacccaagcagttttatacaagttcttaattctctagtagtctgtcttgatccaagataaacttcatttatttcaggtaatcttccacaaaattctctcaactaggagtttgataattattgcaaaggaaagagttattctttcttcaaaggacctgtacttctttctcttcctgttcatatgtgggaaacatatgataccatgtattatatttttctatattccttgggatgttaaacttacaactggacaatactccaagttccctgtgatcgtagttgatatgacaggatgaccaactcctttggataaaataaattggatttttaaattaagttccaaacttttgggagtgagaaatattttggtagtcaagaaatgctcatgatgatgactacagtgataaactggaagtaatattttatgaacaatgacacataagccaccaacatgtggtagttaggaataactataaaacatctataaaagaactaaaatttacaaaaccctcagtgtaatgaatatgagaaataaaaatctcaacatcaataagtgagtcaatttaacaatatttctcactatttctatagggtaataataggcttttgaactgaaaaaaaaaaaccacaaggacaagcttctagtttcttctgatatttcaataaaaattgtctatttacaacagcagtcctaacaacaaaaaatactactttttatactcctctgattaaacaaaaattcaaaagttgcttgtaaccagaggagctaataatcattattaagtatttactaggataaaataatttaatgaatggaaaaaacatagttctcatgactatctaaattatatttcaaatgttaaaattaagtcttgtattgttattaaacatttttaaggcagttaaatttttaattgtgttgaattcagcagaatcttttaggttattataataattataagatgaattttcttgactaccaagccaaaagaattatttcaaatagtttaaatacaattttctgtagaaagagaagtaaggaagatgatttttttccacatgagtatcattattaagtagacgacagcaaatacaaccaagaaaatccatctttgaagtgtgctaaagggtggctcgtttagatatggcaattaatcactgcattatttatagtactttaggaacagctcatactacattaatcagggataacttctgcttaattaacaagactgccaaaaaatgtcaaacacaagcacaaaaacacaatggaataaaaacaagaaaacaagtgttagctagcgactgatcaccacaaagtgaaattttaacttgcatcacaatattttacttgcttgaacttttatactttagctggatatttcatgaaacgatgatttcttctcaaggttgaaaagggtgctgtttaggacacatagtagcaaaataaggtaatccatattatatagtgttttacttctgaccacctcttctgtagtatgtttgtgtagcttattctgtctaggcaactgcctactttcccacatggattgggcaggcattactgaagtgccaaaatagactgtagttagattgcctagtttaaattctggcaccattatgtcccagctgtgtgatttaagataaagtaatcaacttctctgtaccttcatttaataatttatgaaagagatgaaaaatgccaactaacttacaaggtggttatgcaaattaatatatttaaagcattgaccaatctgtaactactcaatatgtattaggtgttattattatttgtattttttaatcaggaaaattatcctctatcttctttagctttctatagctctctcttccttagcctctgaaagataacctaatcccacctactttctttctctttaacatctcacttggacacctgagcaactgctgtatgcatagtacaatgcaatgaatactttatgattcaaacacacagttcaggctttctatggtaacttgtacttcatacatctctggcatgtagttttctcagatatttgatcagtttcatatgtccaaagttatgtcacatttaatgaaactataactaataataagaccttgggtcattctctgaccaccaatactgaaatacctagaataacacaaattcctaggacttcttggtccacggaatatatggtaacatgatatacaaagaactttcatgtgatgagctaaagcaggaaaatggtattcagggtagaaaaggtatatgctttgcttaaggatgtgataaataatgtaacacagttgggaataaccaataattgtagatgtctacctgatctagtctgtccattttaaatgacagcagcaatcagtattaatgctaaaacaaggaattacaaacatagtgcaaccttcagatacacagaaatgatagcttcatctaaatccagaagatactgcttaagtgaggttctgtagatactcaagtatatgaagagcaacagtatgaaatgcttcccctttggaaatacaatcacaaagaacaagagcaaatatctttcctttgatttgttgaaaaactgtttattatatattatgtgaaattatcacatacatttttttcaccttttctttccactgatacaagcatttgttcatggacctgaagggaccttctctctcttttattactatataaaccctagaaatgcaaaaagcataaggtcacctcctagaagaaaccttcctagattatctgacatgaaaatcatatttagtaggtgagccatccaagggctcatgttttaaaatggaggagggtgagcatacctatgtgtgttagtgtcaggacacaggtttttgaccaatggtatcaaaatcactgggttaatgtcatttcccttcaatctcacctactaggaactcagatcacattgaattattaaatagtggacttgaattcaggcttttatgtgtttgttctatttttggcttaatgtcttactaacttcctatactctgatccggctcaaaatatcagaaggatgctccaaataatacatacattttcattcttgtattagttaatcttgtattctttcatattgggtttggctttagtgggttccaattatgggaccttatcagtatttagacgacattcttgatctattatgttccctaaaacgtatgacaaatatattttgatgaatgaatgaatgaataaatgaaggggttgggataaacagccccatgaaaatgaaaaagatagcatacaaacataggtttgttgagttatggactaaattgcaacccacattattgataaaaaactgttttcttgttgttaaatgctgtattttcagtccatctcagatgttatatagaaaaatatactaggaaaagctagtacaatgaatggtccctagaccttctattttgccttattataattgtagatggaaaattcaatttttaagaaaatgtaaataaagagatcatgataaggagatgactttttaaaaggtagcaactagaacattttatcaaaatagcaacaaaatgttaacaaatagagcgaatagaccaagttatcttggtttcagttggttaagtttaattaaatgaatataataagcccaacacagtacaaagttttattgtaaataagttttatagattttcttatcttaatgaatgcaaagtttttgttgtgttttctactctaattgaaaaatagaaaatattcgaaagacttaccaaaaatcaagctattgctagggaaacaatctactctgtgcttctttggagattagaattattttgttttcaatatttgattaatgctaataaaaataatagttttgggccaggcacggtggctcatgcctgtaatcccagcactttgggaggctgaggcgggcggatcatgaggtcaggagatcaagaccatcctggctaacacggtgaaatcccgtctctactaaaaatacaaaaaattagccgggcgtggtgaggggtgcctgtagtcctagttactcaggaggctgaggcaggagaatggcatgaacccgggaggcggagcttgcagtgagctgagatcacgccactgcactccagcctgggcaacagaacgagactcctcacaaagtaataataataataataataatagttttgaaaaacattttgtttggcatttatttttcaagtttctaaagaatttactggaggcattgtaagaaattcatctttaattcttattcttttgttttcttttttctctcttaacttctgatatttccttcggtaatcctgttacagtttctaaattttcagtaaggaaaacaaaagagaatagaactataacaggtttattttttccttgtggacaattggtatattcccgtatattctttccctgtgatattaagaagagatagcatttatcataattttctttttattgaacattttgctttgagtattaagttataactattatgttttttgctaataagaacatgtaagtaaactaacttacattttatttaccatattttagaaattaaacacatggatgtcagagacattttgtgaagctaagacctacatttcctatcttttaatgtttattttattatgccacttccatgatagttaaactagtattttttatttttatgcatgcacagtaggtgtgtacatttttttgaaaacattatgaatttatttatatacatgttccacaaacattttttttaaattatactttaagttctgggatacatgtgcagaacgtgcaggtttgttacttaggtatacatgtgccatggtggtttgctgtacccatcaacccgtcatatacattagctatttcttctaatgctatccctcccttacctccaccccccgacaggccccagtgtgtgatattcctcttcctgtgtccatgttctcattgttcaactcccacttatgaatgagaacatgctgtgtttggttttctgttcttgtgttaatctgctgagaatgaaggtgtatacattgatggggtgcatgagatatttcgatgcaagcctacaatgcataataagcacatcagggtaaatgcagtgtccattatttcattcaaatatccaatatcccagcctcttgtaaatattctattttctgtcttcataagttcaattgttttaagttttagatctcacatgagtgagaacatgtgaactttgtctttctgcgcctggcttatttcacttaatgtaatgtcctttcattccatccatgtcattgcaaatgacaagaacttaattctcttttatgcccgaatagtaccccattctgtatgtgtactgcattttctttgtcctttcatctgttgatgaagagcttaggttgcttccaaatcttggctattgtgaatagtgttacaataaatataagagtgcagatatctctttgatatactaatttcctttcttttggaaaggaatccagcagtgagattgctagatcatatggtagtctatttttagttttatgaggaacctctaaattgctctctatagtggctgtactaatgtaatttagtccccagcagaagtgtacaagcattctgtgttctccacaccctcgccagcattcattattgcctgtcttttggatataagccattttaattggagggagatgatagatcattgtagtgttgatttgcatttccttgatgatcaatgatatggagcaccttttcatgtacctgtttgttgtttgtatatcttcttttgagaaatgtctattcagatcttttgcctagttttttaaatcagattattagattttttcctatagagttgtctgaactccttatatatctggttattaatctcttgtcagattgatagtttgcaaatattttctcccattgtgtgagttgtctcttcacttttttgattgtatccttttctgtgcagatgctttttaacttgatgtgatcaaatttgttcattcttgctttggttgtctgtgcttgtggggtattactcaataaatttttgcacagaccaatgtcgtggaaagtttcccccatgttttcttgtggtaatttcagaggttgaggtcttagatttaatccttcaatccattttggttttatttttgtatgtggtgagagataggggtagtttcatttttctgcatatgaatatctagttttcccagcaccatttattgaagagaatttcttttctccaaagtatatttttggcatctttgttgaaaatgagttcactgtagatgtatggatttgttttggttcttggttctctattctgttctattggtccatgtgtctgtttttatgccagtaccatgctgttccagttacaatagctctgtagtattatttaaagtcaggtgatgtgatttttaaagtttttctctttttgcttaggatagctttagctatcctgtgtcttgtgattctctatacatttcaggattattttttctatttctctgatgaatgtcattggtatattgatagggattgcattgaatatatggattagtttgggtagtatggacttttaaacaatattgatacttctaatccatgaacattgaatatctccgttttttgtgtcttcttcagttacttgcatcaatgttttacagttttccttgtacagatctttcacttctttggttaagtttattctctgttattttattttatttgtagctgttgtaaatgggattactttcttgattcctttttcagattgtttgctgttggtatatacatatgctgctgaattttgtatgttgacttttttgtcttgcaactttactgaatttgtttatcagttctaatagttttcttgtggactcattaggtttttccaaatatgagatcatataagctgaaaacgaggataatttaactaattccttagaatttggatgaccctttatatatttctcttgtctgattgctctagctagcacttccagtacaatgttgaatacaagtggtgaaagtgggcatccttgtcatattccagatcttaaaggaagggctttagatttttctcattcaatttgatactagctgtggatttgtcatatatggcttgtattgtattgcagtatattttatctatccccagttttttgatggtttttgtcatgaagggatgttgaattttatcaaacactttttaggcatctattgaaatgatcatattgattttgcccttcattctgtttatatgatgtatcacatcgatttgcaaatgttgaatcatccttgcatctctgggataaacccatttggtcatgataaatgattttttaatatattgttgaatttactagtattttattgaggatttttgcatcagtgttcaacagggatattggcctgtagttttatttatttattgtttgacgtgtctttttttttttttttaataacagtgtaatatccttcaaacatgaataagaaagactttccagaaaaaaagactttccgtctctatgttatcttgaatttcatttagcttcctcaaaacagccagtttgaattctctgtctcccccagattggtttctgatgccttatttagttcatttggtgaagtcatgttttactcttgatgctcgtggatgttcactgatttctgggcattgaagagttaggtatttattgtagtgttcacagtttatgcttgtttgtacccattcttctggaaaaggctttccaaatagtcaaatagaattgcatgttataatctaagtctttggtcatcactgtaattgtgtctgcattgggggaaccccaagcccagtaatgctgtgactcttgcacacttgtagagataccactttggtggtcttgaatgaaatccaggtgaactgcctggtttaccaggcggggaatcttgttcttttcccttactttcccctcaacaagcagagtctctcttttcatgctgatttgcctggagctaggggaggagtgacacaagcatctttgtggccaccaccactaggactgctctgggtcatacctaaagccaacacagtattgggtctctcctaaggcccatggcgaccactgcctggctactactgatggtcatttaaggcccaagggttctttagttagcaggtggtgaatccatgcaggctggtgtcctttccttcagggtagggagttccagctggcccagggtgggtccagaaatgccgtttggggaccaaggcctgagtcacaaaccttaggaatctacttggtgctttattctgctgcttctgaactgacagccaacctgaaagacaatggctttcccactctttcctctcctttcttcaagcaggaggagtctttcctcatggccaccactactccaggcctgtggggtactacttggctactgctgatgttcactcaaggcccagtgctcttcagtcagcttgtagtaaacactgtcaggcctgagtctctctcttcactgaagtgggctcccctgtggcacagtgcaagtccagaaatgccattcagtagctaaggcctggaatcaggaaccccatgagcctgcttagtactctacacaactgtggctgagctgctactcaagcttcaatataaagtcccctttactcttccctcttctttcctcaaacagaaggagcctttccccatagccaccgcagctgggaatgtgctgggtcacacctgaagccagcagggtactaggtctcccccaaggcctgcaatgagtattgccttcatctgctgatgtttactcaaagcccaagggctctttattcagctggtgatgaatccttccaaaaacggtccttcccttaggagtagcagctttcctttttgttcagggtgtgtctagaagtatcatccaggcgctgggacctgggatgggggcctctggactctgcctggtgtcctattcaaatgtggctgagctggtatccaagttccaagacgaaatcctgtttactctcccctatcctctcttcaagtagaaggaaggagactctcccagagctgcaagctgtactgcatggggttgggggagggtgacacaaggactccctcagtcacccaaggcagtgcctcactatgtcatgtacacctcaagtccactggctctgggcccagcacagcactaagctgtgctcaggaattgcagtccttgcggcctagaccgcctttcaagtttatgtaggttgccagagtgctttagcctgcaatggcggtgcttgccagaacttaggttccgactgctgggatggatgattcccctctggctaggtctcatctaagtgcttcctctgtgggtgccagctgaattttgccctgtgttgctttctgctggaacagacacactgagttccaatgccaagtcccacaatcattgcaagcacacagattctctccccacctgctgctggggagttggggaggggtggcattagcaattcaagactgtctttccacccccttcagtgcctctgtcctcaatataatgttacaaccaggtactgtgattgatcacctgatttttgtatcttatggaggtgctttcttatgtagataggtgttcctgtggggaggatgaatactgaagggttctattcagccatcttgctctacctacctttcctaaaatcatattttaatttatcaaatcagtaattagtttgtcaccttccttaaaagataacatacacatatttaatgaaaattaaaagagagcaagcaagaacagaaataagaataaataaaaaagaagaacctagaatgaggccaataatgcatatcatatactttacacagtgggatcatggatttaactttcagttttctataaacccacgtcaaaattgttacacaattcacgatgtccgtaaatttaaaacaaccagttattctttgagataatacgttgttctcagttttcttcagtagtaatatcagagtagaaattttccaagtggagcggctattccagacactgtgtgacataatacaattattctcagcaacatcctttcaggcgattccacagtggttttcatggactgttttttttgcgtgtagtctctgatggccacacagcaaaagatggtccagccaaagcaattttataagtttgtagagtgtaacagaggcatttcctcactgactggatcaaggagtatgtgtatatttgggatttgaagtagcttttttatttctgaaacaatgttctcttaaatggcgttaaacataacctaacaatgcattcggaattctgctgttttccttgcgcctatggtaaattctaatgtcagttaaagtcagaccacaggacttaaaagataatccaaatgagattataggtgtcatatatttaggtcaaaaatagagagcctagaaaggacaacagcttaatttgaagctatcctgacctcctttggaggtcaattaaatagaatagagatagggtaattttatattatttaattttcacatatatcagttttggtggtttaaataacttctaatatatttgaaaaatgaatagcaaattaaataaagcattttctaataatacaaatttttccaaaagggaaattaatataatatatagatagatagatataatttgataggtctctctgaagtcaactgtatttcctactggatatgtgagaaaatgctcatatgaaaatttagcaccccttaatccctataatgctgtagaaaattcgaatatttaaaaatagaagattacttgctgtcgttgatcacatgggaatggaattcaacaattcaaatgttagtattcttacttttatactatgaaggctaaatagagtaggaaaatgcatatttatatccaagattattatgtctttatgatagcagtatatcttctatgtttcatttacacaggattatgtacctcttcatttttaatatttactgagccctatgtaagtgggcaccccatctgcagttttcctagaggtttctttctgttcctgggccaccaaaccggatttgtgttttcattatcagggttgataagatccttgggacatttcacaaatttccttatagggtatgtaaattatttcaacctgagtgtagctttgtgatcgaaggagtttatgacagaaaatagtaaaatgtaactattcaaaacagaaagggtcaaacttaactggaagcagtatccatggagatgatgggggagatgtgaagaagatagatgtgccttttacagtggaagaatgtgctacaagtgtcatgagtattcatctgtctagaacagagtagataatagttcccttcttcatttatgtcataccctacttgagtctgtctggaatgagaccctgtctggaatacaataaaccagagtgagactatgtgaatcacaacatacgatgactgattgaaggtgctagcatgttgagcctagagaagaaaagcttttcactattttctacaagaactttccgagctttcatataaaatgtactttaggttttccatgccattgcagagaagagtactagggtccatggatgaaagtgtagtgaggaagactaactcattgtgaggaagaactctctgtgattgattctggaattgtctgcctcaagaagtggtttgttctccatcactggaagtatctagacataggatatatttgtcaggaatattgcatagagagattttatcagagtagcttgacagactacgttctttttatccttgcatttcctttggaccttatgatagattttgttgttgtatctgagattgtttggtatagttttagagactggaattggtgtgccatgtgagaagataatagcaggcatatgagacttcacaaggaagttttgttgactaatgggaattaaggattatattccatgtcttcatagtgaaaggaatattactaatggtggatcctacatgctatgaaagtgtaccgcaaaattattctattaaattctcagtttcctttaaattaataattcttggaggataaataatggcaatgtgtacaggtaaccatcattatttaaaacaccttttgtgtgtgggcaacaaacatttaactaggtaaatatgaaaacactaaatgttgaccttaccaaaaattcagagaatcctatatcaatgaattaaaaatttctcaaaatactaaagatgtggcaataaaaaaagtcttgacattttcccattttcaatattaaattataatcaatttgttattatagggctaaagatttcagtacacatttctgggcatctgattttattttatttatgaaatgctactactatttaaattttctcagcttttttttggtttgtttacatttttgaatttgtttaactgacataagtatcattttgtttttctaactgtgaagtgtacagatagtcttgaacaagtgctatctactagaagattattaagaataatacattgcatcataatggttatggaatctctcttaggttgcttgtgtgtgtgaatgtatatatgtagctataaatgtgtgttaaatatgtattagacatattagacttatttctacatacatttaatattgaagacaaaggaaaacaatctcctaaatgcctgatactttcataatttattaaggaatgatttatttatgatataagaataatgtctgttgggccaataagtggcatatttatttaaaattatgtgtataatgtttatcatatgaaataataggtaatgaatgctttatgtactaaatacaatagtataaaatatattagcaagtttgatttagctgtagatttggctataacaatttttaaacaactcaaacaaatgtataaattcttaaaatgtgagtaaattttgaaggacagattctagttaatttataagttatgtgtctataattgactaagatgttcgtatttgaatcatgtgggtcttataccaattaaagagaaattttactttaaattgtaagattctttaaattcaaaataaatattcggtgcactgaacttgggctatgactagcatttcaccgacgaatgattggaaaaaaaatgattcatttatatttctctaggaatgcttatttttagtttttgttttgagacagattctcgccctgtagcccagcctggagtgcagtggcacaattttggctcattgcaacctcccccacccaggttcaagcgattctcatgtcttggcctcccatgaagctgggattacaggcatgcctcaaatagcccagctaatttttgtagacagggttttgccttgttccccaggctggtctcaaactcctggcctcaagtgatctgcctgccttggccttccaaagtgctgggattacaggcgtgagctactgggcccagctgactgcttaaaggactattattaaatgtttgagtggttctggaatcaacgtctttaatatgctgatatttgattattcatatgtccttttctgtttaacctcaaaggtttcactaacaaaatcaatatacagaaggtattactcagacatgaaaacacatttaatacttccttctttctatattacatctacatggcaacttgtggatattgaggctccaataaattggattgcttcggctcaaggtaaaccaccactttaagaattaatacctaaagaaaacaaaattgcttagatgttttgttgcttattaaaatgatttatatctcagtattagtttcagatccatacagtctttctttgaactctttttactagcatttttttcttgagccaagattacatgcattttttaaagttcatttttctgattttattcattggactttagctgggcttagtgtgccacaataaataatctccaagagtatttaaggctgttaagtatttcctaagactatttatgactttccatcgttggtattgtagttattttatacgtacatatgccagaaataacataaaaatgtatgccaataaatttcatgaatatctcacctttttttttcctcttaatatcaggatacaatttatctgctggtttgtgcttctaaacactaaaccaactatgtcacacaaagcttactttaaaaaaagaaagcagagggacagtatgatgtatttgtcattaaaagaaaaataggctgccaggaatctcggagcacatatactcagatgcaatgattgattatcatcttatcgcatatttttttttgtgctcccataatccctgtcctttatcttaatatctaacaccaattttcttgtcattttctttgtttttatttaatagtgtatatgtgatgaggcatctaaagtcaatattggcattatactgtaaggattctattaatttttataaaataatattcatttggcagtttaccttctgtgtgtgtgtgtgtgtgtgtgtgtgtgtgtttctatactagtattttagccatgggcacatgttcgtgctgtttttcccaactcttcgttggctaccatggaatctatttaactagtgtcttcttttaactgaagaatcccagtcgttctaggagaaagttgtatttttgaattctcttctttgatctgatataaccctcaagaagaaaatctgtagatacatgaatgcttattcttttaccaatgtcccctgtgcatctattcatgtaatatcccatgaaacaatatcaacatttggttttctagattattgccagcactgtgagatagttacagtatatcctgccttctctccaacactggtgtcttgcatttcatgcgcgtccctgtgaagagaccaccaaacaggatttgtgtgagcaacatggctgtttatttcacctgggggcaggtgggctgagtccgaaaagagagtcagcgaagggagataagggtggggccgttttacaggatttgggtaggtaaaggaaaattacagtcaaagggggcttgttctctggcgggcaggagtgggggttgcaagttgctcagtgggggtgctttttgagccaggatgagccaggaaaaggactttcacaaggtaatgtcatcacttaaggcaaggaccggccatttacacttcttttgtggtggaatatcatcagttaaggtggggcagggcatattcacttcttttgtgattcttcagttacttcaggccatctgggcgtatatgtgcaagtcacaggggttgcaatggcttggcttgggctcagaggcctgacattcccgccttcttatattaataagaaaaataaaacaaaataatgttaaagtgttggggtggtgaaaatttttagggggtggtatggagagagaatgggcgatgtttctcagggctgcttcaagcgggattaggggcggcgtgggaacctagagtgggagagattaagctgaagggaggtcttgtggtaaggggtgatattgtggggatgtaagaagaaacatttgtcgtatagaatgattggtgatggcctggatacggttttgtgcgaattgaaaaactaaatggaataacagaaggagaaaaacaggcataaaaggtttaagaattgggatgactcaggacatctgatgagagagtgcctaaggagattcagcatagtcctgccagcaaagattatttatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagttttttgggggcacagtctaagttggtctggtgtcaaatgagactggggcctaataaaaaggagcatctgtacaggagcttaaatgggctgtaccctgtagcattccgaggacaggcctgaattctgagaaacgaaagtggtaaaagtattgtccagtcctttttaagttggtggctgagcttggtgaggtgtgtttttaaaagacctttagtccgttctacttttcttgaagacggaggaccttaagggatataaaggtttcactgaatactaagagcctgaaaaactgcttggctgatttgactaataaaggctggtctattatcagactgtattgaggtgggaaggctaaactgaggaattatgtctgacagaagggaagaaatgactgcggtggccttctcagaccctgtaggaaaggcctctacctatccagtgaaagtgtctacctagactaagaggtatttcagttatctgactcagggcatgttgagtaaagctaatttgccagtcctgggtggggcaaatcctcgagcttgatgtgtagggaagggagggggcctgaataatccctgaggagtagtagaatagcagatggaacactgagaagttatttccttgaggatagatttccacgatggaaaggaaatggaggttctgagaggcgggctagtggcttgtactatagcataacctgcctttgctggtgtgtggtgattaggcctggtggaaccgccatcaataaatcaagcgtgatcagggtgaggaacaggaaagaaggaaatttggggaaatggggtgaatgtcaggtggatcagagagatacagttatgggggtcaagtgtggtatcaggaataatgtgggaggctgaagtctgggccaggaacaacggtaattgtgggagactcaataaagagtgagtatagctgaaggagccgggaagcagaaagtatatgaatcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttggacagaaaggctacagggtgcggtcctggctcttgtgtaagaattctgaccgcactaaccatgcctaggaaggaaaggagttgttgttttatagaaggtgtttgggtttgagagatcggtcggacaagattggcagggagagcacgtgtgtttttatgagaattatgccgagataggtaacagatgaggaagaaatttgggcttgattgaagtaatgggggctgtctgtgaagctttgcagcagtacagcctaggtaatttgtggagcttgatgggtgtcagggtcagtccaagtgaaagcgaagagaggctgggattaaggggcaaaggaatagtaaagaaagcatgtttgagatatagaacagaataatggatagtagaggcaggtattgaggataggagagtatatgggtttggcaccacggggtggataggcaaaacaattttgttgataaggcgcagatcctgagctaacttgtaaggctcgtctggttttaggacaggtaaaatgggggaattgtaaggagagtttataggctttgaaaggccatgctgtagcaggcgagtgataacaggctttaatctttttaaagcgtgctgagggatgggatattggcattgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggaggcaatgagatacagctgtagtccaggaatagtcagggaagcagataatttagttaaagtgtctcagcctaataagggaactgggcaggtggggataactaaaaaggagtgcttaaaagagtattgtctaagttggcaccagagttggggagttgtaagaggtttagaagcctggccgtcaatacccacaacagttatggaggcaagggaaacaggcccttgaaaagaaggtaatgtggagtgggtgcctccatattgattaagaaggggacgggcttaccttccactgtgagagttacctgaagcttggcgtccgtgatggtctagggggcttccgaggcgatcgggcggtgttagttttcagccgctaagccgagaagatctgggaaggagtcagacagccttgcgccagagttccaggggctctgagagtggctcccaggtgagttgaacagtccgattttcagtggggtcctacacagatgggacacggcttaggaggaattccgggctgcgggcattccttggcccggtggccagatttccggcaagtgtagcaagctccttggggaggaggttctggaggaacgcctggccgctgcggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccggaatttaattgttggagttttatttaatgttgggagcagattgggtaataaaatgtatattgagaataagatggccttttgaccttttagggtctagggctgtaaagtgtctcggttgctggcaaacaagtcatgaactgggctggatttttatatttgatgaaaaagagcctaaacgctatctgatttgggataaagaaaaaggagcattaaccttgactatgcctttagctccagccacctttttaagagtaaattgttgggcaggagggggagggctagtcatggaaggaaactgtaagccggaccaggtgtgaggaggggaggtgataaaaagattatagggtggaggagcggaggctgaggaagaattgggacctagctcggcctggcgaggagcagcctggggaggaagggagaggtcagatgggtctgtagaaaaggaagattagaaagactcagcgaggcttggggttggtactgaggggacaggcaggagggaaagaaggaagatttgggacgagttgcactgggcacagagactaggaagggactgatgtgtaaaagaatgcctggacgtcaggcacctcagaccgtttgcctattttatgacaagaattatttagatcttgcaggatggaaaaattcaaagtgccattttctggctatttggaactactgtggagtttgtattggggtcaagtggcattgcagaagaaaataaggcatttaggttttaggtcaggtgtgagttgaattggttttaagtttttgagaacacaggccaagggagtagaaggaggaatggagggtggaaggttgcccatagtgaaggaaggaagcctagagaaaagagagagtagagaaacggagggaaggggtttgggggttcttaccttccagaaaagtgggaaaaggggttggggcacagagataagaggtcgggacgtggaaataagtgattggggcacagagatacgaggttggggtacttgcctctcctctagaaaagcgggacttgccgctaagagtgaaggagaaggggttggagtacttgccctgtgcccggaaaagctgagaaggggtagagacaaggagagaaggggttggggtacttgccccttccccagaaaagcaggacttgccgctaagggtgaaggaccaaggcaggcgtccctgcgtggtatgacacctttgaaacgtgggttgaataatcagagaggcgtccctgcaatgattaaacaccaagggaaggctgcctttccagtctgtgaccggcaccagagttttgggtccacagataaaatgtatctcctttgtctctcccagaaaatggaaggaattgaaattaagagatgggagagattgaagagtggaaaggagaaagtggttgagggacagtgagagagattggagaagagagtcagaagaggccgcttaactgatttaaaattggtgagatgttccttgggctggtcagtctgaggacctgaggtcataggtggatctttctcacggagcaaagaacaggaggacaggggattgatctcccaagggaggtcccccgatccgagtcatggcaccaaaattcatgcgcgtctgtgtgaagagaccaccaaacaggctttgtgtgagcgacacatctgcttatttcacctgggtgcaggcaggctgagtccgtaaagagagtcagtgaagggagataagggtggggccgttttataggatttgggtaggtaaacgaaaattacagtcaaagggggtttgttctctggcgggcaggagtgggggtcacaaggtgctcagtgggggtgcttttggcgccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttactttaggccatctgggagtataggtgcaagtcacaggggttgcaatggcttggcttgggctcagaggcctgacatttcgtactatggatataatgtaaaaagggggcgtttgtcttctctttttaaatatccgtacagaagtctctgctgcaacataataaatgacaaatgccagaatatatcctaaaaatttagcacatgtggacagtgggtttacttagatgtttatttttgcccttacatatttttggaggattgatacatttttggtatcacttttggtatttaaacaaataggtaaatattttctcaaaaagtgaagacttttttttcagacaaatctatgagaaattattggcttaacaaatcacaagttttgtcacgtatgccatatttgtttgtttgtttgtgaaaggattttgggtattaggcaactgtagcagacatcatgtatctggactttagcgagtcatgatcactcatcatctagtaaaaatatttaatatttatataaggcttattatgtgctagatactcttcaaattatttcacatctcttaactcatttgatcttgttaacagtgctacaaagtagatgatttgatttttgcccttgtattgatgagtaaaattagtctagcaagtagcagatgggtaatttgagtcccagactctcttgccctagaattagttttataatcacaatgtcgtgctgctaaacaattgagatgcatcattcctgacaatctttgccttcacccttcaagtaccatatcagcatataaaagtgaaggatgatgccttccagtgaaggttcaaggcttttgcctgaagtttatattatttgtttgaaatctttttcagccatggagatattgaaggagattttattaaactttcatgttgtatacagctgaaagagtgttttaaaaagtgatatgtaaaatgacagttttggtattcaaaaggagcaatggtggaaatccaacaataaatatggcagggataaatgtaaggtgctacccttgaatccaataacccatgaaacaagtagagcataggagagagctgatttaggaacaagccatgggaagaggtctaagggattatgatacagactagccccatcgtggtgtggttccccaaataacaaattctatcttaggtaggctgcatttctatgttgtaatttatttattgaataatcttaccttggttagtgcgtaattctaaactttttccaattaacatttttagctctgctattgttaatcatttcccatgctttaatgtcactgtgaacacatttttaattttttctaatgttttgttactaaaatcagtataaaactcttatctcatattttttgtttgtttgttttgagacagagtctccctctgtagcccaggctggagtgcagtggcactgatttcggctcactgcaacctctgcttcccgggttcaagcgattctcatgcctcaagctctggagtagctgggactacagggttacgtcaccatgccctgtctaatttttgtatttttagtagagacggggtttcactatgttggccaggatgatctcgaactcctgacctcaagtgatcaggccacctcaacttcccaaagtgctgggattacaggcctgagcctccacacctggctttatcccatatttgatttaaattgtatgttcttacctcttcttggtacccaaattgagaccctaacaaattggagtggcaaagaactaccacaaggtctgactctgagataaatgtctcttctttctctttgatatatagttgctccagtatgttaggtcagagaagagagagcagaaagtgttaagtgtatctttattcaacatttactaatactatcatttatttgctttctctgctttgcagacttctgtgtggctctcctatgaggctcattcatggattctttagaggacctattgtaaagttctctgatatgggagattcaatctgaatccaagctagctagcctccattagagtgaaccccaagctgtacacactgttggaacttgtttttgaggtctccttagttactatccagtggctctagctccactacattttgtatatttacttgactcatggagaacttacatagagttacttctaagtctacagcctgttctattgcaacaccttgcatagattggtggaccacttgggtgaaatgcagagaatatcatgcaaagaatatctgctctgcatgaatgattaacagcagaagttctcaagttttacctgataaccttcgaagtaacaccaattccttgatttgctcctgcaccatccctttttggattctgtccaacagatctgctataaagcctgatgattttgtttgtttaaagcacttcagctagtcagcaagggttcagaaacactaaattagattaccttactcagaatcctatgattctatgtatttttatcctctttaaaagtacttttataactgtgatattactttaatattttaaaacaaccataaataagattgcagatagtaatgcattgggtttgcaaaaataactttagataaaatatattccagtttgtatttatgtgataatacattacctcaagacctcaaaaatagatttgctttgtttatatggtttccttctataagtgaaaaaaactagtccaatgaaataaagggttaagaccccttagaggaaaaggaagataaaattatcttcagaaatggctatggtaacacctcccaaggcaaactattggcagaccttctaagggcagattgtgtgcatctatgtaagtgaaaaacagctgaagggtgtcaagtgctctgagtcacactagagtccctttagatttatttcccaaaccaagtagtagttgccttttccaccagcccacacagttctattattttcctatctttgctttatgaatagctggctcttacagtacttaacttcttatcttagtccacttgggctgctagaacaaaatatcataaactcgatagcttataaacaacagaaatttatttttcacagttttggatgctgagaagtccaaaatcacagtgcttgcagattccaaatctggtgagggcttgtcctttggttcacagacagtaccttctagctgtgtctgctcatgttggaagaagcaagctaacattctgagttctcttttataaaaggactaattccagtgatgagggctctgcccttgtgacctaataaccttccaaaggccccacctcctaataccatcaccttatgggttagaatttcaaagcagaaatttggggtggaggaggatcaaaaattcaaatattctgaacccttgctgactagctgaagtgctttaaacaaataaacaaaaacaaacatatcacttatgttgaaaactagtcaaataataaggcatttctaacataagacctcatgatcaagtaaacttacatgaaatgaccagtgcaaagacatgcttgggtaaagcttttctgtagagtagtagtattgatttttattttatgtatgtatgtatgtatgtatgtatgtatgtatgtatgtatgtatgtattttgagacagtctcactctgtcacccaggctgcctaggctggagtgcagtggtaccatctcggctcactgcaacctctacctctcgggttcaagtgattctcctgtctcagcctcctgaatagccgggactataggtacatgccaccatgcccatctaacttttagtagagatggggtttcactatcttggccaggctggtcttgaactcctaacctcaagtgatcctcctacttcggcctcccaaagtgctggaattacaggcatgagccaccatacccagcccgagtagtattgatttttaaagtaaattttttcatcacatccctaccaaattatatacaaattaagtaactagcccagttaggaaaatagtacacaagtactaaatccatattaagatcaacatctaaaaaaataaacatttacataaatggaagagacattttttactacatttatttgattttaataatttaattttatggaatttatgaaaattttatttttaggaattcatgaaaaattccaaaaatttcaattattaaaatcaaataaatgaggtaaaaattatgtaagatatatttgggtaaaaagcataaacacatttaaatattttattaaaacattttaattaacaggaacatgttttaaaggaactaatacataaaaatcaatttcaatctcattattcctcacaatcacttccagtattctggagcctcaggttttcatccttgatatttatttataaagattattatagtcatattgctcatgtaatagataatccctctccacaactaatattttattatgatattttctacattattacctatttctcataaatataactagaaattatcgtgcaatattttattgggtaacatgatttagttagctatttctcccataattatacattatatatggcttactcttgggttttgctcctacatataggactgctttagatctccatgtcactaaggttttaccatatttggattatttccttaggataatttttcagaagtgggattattaaagagactcaacatttttaagtttttgttttgtaatgcaaagttgatttccataacttacagtgctgccagcaagatagggaaacatccagtacacagccttactttttccttgaatttggagctcatcttttatagtttgtataaaatatgatagttgaaaataatatttcatggtcagatccatgtgaaatacaaattattgtattagtggagatgagttgaaaatttttttccatgtgtgggaaatacatttgcctttctcctctaaaatatgtctttttggaaaataggaacttcagtattttgtgatcatttgtatacactcttcatataataataactctgtcataactgcaaaaatattcatatttattcttaattttactaattatactcaagtttttacttgtaatataatcaaatatgtctatcttttcttactgatatatatatatatatatatatatatatatatataacacttaagccaaattcatttatatttcagaacagtcaggaatctctagaagcttcattaactctttcctaccattatatttaatttttaagtcatggctttagagcaccagaggttagtatgagtaatttagtcagtgagaaaagttggctccttctggaaaagcacctttatcaaagcaattccatcaaagctggctttgaatttcagagaaagcaattagattaaaagaaaattaggatcttggctcacagtaagagcatgtaaaacataattcatcttgattcagcgttttaatattctatcatgggtatcaaatatgtcagatatgaaaagtaatttcagctttgttttcaactttgctaagtttggtcactgttccttagaagcaaaagtttagctctgatcatgttggaaaataaagtagttttagtcattaaaaacaaaaattttatcaataatagtgtgatattataataatgtcatattttcatcttctggtgtacctatcttgtgcctgatgtataataggtgcagaatttataatagtagaatgaatagatgaatttcctgaagtagaatgcagtgaggcattaagcatgtcctcataatgcctttaggattgccaaaagtcttgcttaggggttgaaaaagaagtagaaatcaaatgataagacctcgaaggaacagagaaatccaactcaatgaacagtaaaaatcaatgaaggcaaaaaaggtccatttttatctcattcatcttcagagatagaccagtgtaagttcattgatttacagtgctcattgagttgtattctcctgttctttgttgtgctccattctctgttttttcagcttcactttgtgttttattttaaattgtatttgttatgaggtgggctttgatggcatagttttagcacaatgagactattttttttcacttgatttttctactcatatgatatcatcacttttcaatattcttaatggtacttttctgaataacctcctttaaatctctctctttctttatgttgatctgtgtcaatcaagtttttatgtgtaaaagtgtgttaataaatttaaatttaaaaataaattttaatttaatttaatttttaaatatttattttaataaatttaaataaatttaatttttaaataagtttaaataaatattcaaataaaataaaaataaaataatatttaaataaatttaaattaaaataaatttaatttaaatttattatagtgaccatacaaaacaaatagttgtttctattcagttcactcataaagaaatgttatttaacaaatatattcagcacctttcaatgcaatgcacttttgcagttgtcaagcaccataattcacttaggttctgccccaggcctttaattataagttcttatttatgggaattagagagtagaacttgaactgaagagactagcctgaccgtggagctgacaaagaaagaatgtacattggttctgagtacagtgcccacagataattggagaatacgtgtttgaatcagactgatgaattctgggtggaacatgaaagccggtaattctaaatattagtgatattaattaaatcatcataatttgtctagaatcacgctcaatttagaaaggattcatctaagggaatgaagacagaatagctgaagccaatattttgaaagataaaacagagtaagaaaaattatttgaccactaggcatttacatttttttatagtatataaatcacttacaacatgcagatacacgcatacaatagaatttcaatgaggtacaatcacttcccacattttaatgaatgtgctcagggtagaagtaataaattattttaatatatagaatttgataaactcataatagaagtagaagcaaatcctttgagtgctacaaagaaaggaaacccatttcaccaatgatatgcatgagtgcttcattgtggagttcatctttggtttcaggcttaaattatgacacattgacaatttggaacattcagattaagaaaacattgagcaataattcaggaaaattaggcagaagggtatgttcacaaaataatcctgtattgtccaaatatcaaaagagcctaagtattcatctcaaattgagcctagaaaattagactttgggagggtcacaagataagatgtttgtaatatagccagataagcactaaaacaaatccaggattaggctgtcttgtgatttggctttctccactgtaaaccatgtttttctatgaatgtgagactctgctggcattgttgaatcactacatagtcatccattcattcatcatttaatttattatccattcaggattgcaaaaagccaaggatgtataagtgtaaaagacaggtaaagcagtgtcatggcatacatcattgtggaaagctaccattatatacttggctattgaacacagatgccctaacagtgaaagttttaataaaaataatattatgccacataaatgttctttatagtatatatggaaatgttctctattattaatgtcaacattgcctttctgtcatgctttggttagcaaatttagcaagggtaaatctgtttagatttttttttttttttttagacagagtctcacttggtcacacaggctggagtgcagtggcacgatcttggctcactgtaacctctgcctcctaagttcaagcaattctcctgcctcagcctcctgagtagctgggattacaggcatgccactgcaccctgctgatttttgtattcttagtagagatggggtttcaccatgttggccatgactggccaggctggtcttgaactcctgacctcaggtgatccacccactttggcctctcaaattgctgggaatacaggggtgagccaaggtgcccggccctctttaggtttttaatgtaagttttttatgaagttttctgtgctattttaagcatgaaagtgagactaatacatataataacaatttgtgagaacttgtatttggaagtacttaataatagtttgtgaattgttacctgcccgttcatgagtagatagcaaatatatatgatacatgtatatataatatatgtttaccatatatatatatttaccatatatatatatttaccatatatatttttttaccatatatatatatttaccatatatatatatgtatgtttctatatatgatacatagagatagactgacaggtgtgtgtgtgtgtgtgtgtgtgcatacacttatgcatttgttagtctatgtatccatgtaacttatgtatgattttctacttatgaatatgtggcatttgtgtgggtgtgtgtgtgggggtgtatacatgcattaaatcatgtcctctaaagagcaaataccatgtcagaatttatcatgcaagagatttattgggaaaatgcctgtgaaagaagaaggagagggaaataaaggaggcaggaagaaccatcaaacattgaagcagttctgatccctgggaaaggaggggagagaaggaaggagagttggactgacagaatcttggatgaagcatagtttttaaaatattttggccaggccaacagggagtcattgtgccaaagttgcctgtcagaggagtattacatcttttagaaatggacctgtcttgctaatgctatcttgctcagtcattagcagagaatgggttcatacagagtatggcctcacgtatgtatattcacatatgtatatgtattcatatacatatatgcatacataagtatcaaaaaccgatgtatatttattgcaccaaatgatttttaatgtacatgttgaaacatattcgttgtgttactcttatgcatataaagttatttgtaaagacatggatttctttcatttatgttttaaaatttccatgtactatattagaggacataaaaagatgcgtaatattacctaggagtgcacattgttgaagagagttacctagtgtttgtgaaaggcttttatcatccagaaattaaattttacggcttaccttttaattttcctctcaaatattgattgattttttttacaagtagaaaacatttaagctatgtttgagattttttaaatataatgtataacttaataaagctaaattatactgtccttaaaaacttaagaccactgactgtttctttcttactgaaatcaaaatagtgattatggctcaaagacaatattacaaaactgaatatgattgcaaatatgtgtgcactaaaccacagcatgcacactttggccacagccaaaacataattagatttctccaaaaatgcctcttagtgtttaaataaacagtactatgtcataatagtacatgacatatagataatttacttttttagagaaatataaataataatgacacattgttttctctgctattacttacaaaatttgagtgtctaagtcataaatgtgtttttctttcccacattaaaacaatgacaaaataattagatttgtatgttttttccacttattggacacctggcttcaaattctattaattattcattacctgatcagcaaagaatacagagaaaagtacttaactatatgaaaatgagcattatgcataaggataaatttggctagtatcttacaagtttccttatataaattttttcaactttaaaaatcttgtgattctccatataaatacagttttattgatcaaatgaagcataaatataactaaaattaatacatttattaacctctgaaaaatgttaggtgaatgctatgtatatacaaacacagtggttgctatatggcatggaacattcccatcaaatctgcatccctggtggctcacgcctgtaatcccagcactttgggaggccgagatcggcagatcacgaggtcaggagatccagaccatcctggctaacacggtgaaaccccgcctctaccaaaaatacaaaatattagccgggcgtgttggcaggcgcctgtagtcccagctattctggaggctgaggcaggagaatggcgcgaacccaggaggcagagcttgcattgagccgagatcgcaccactgcactccagcctgggggacagagcgagactccgtctcaaaagaaaaaaagaaaaatctgcacccctgcaatgtctctggattactttccgattattcacatattatgttgtcccaaaaactcagataaaaccaaactagagtatttaaaaaaaattatttctaagaggttgattttaaactgttttcctacttggttaagattctactgtatgtctagctgtaaatgttttacaacttcatgattatggaatgaaaattagtgctacttttatatagcaccgctgtaaatttctattcattaaaactactttaaaatagaaaaatcctaatagagcccatatctttgaaaggcactagaatttatgtgaaataaaaaggatacttctaattttatttatttttcatttggagtaatgttttaatgcatctattgagcaagtattttttgaggtttgtggccaaaatactactcagttactaagtgccgggtggacaacagagacatttccgtgttcttgtgaaacttatattccaggattcttatattcagagaaaatcttattttctaatactctgtataccccaaacgacccaccagagtatcaattatgtgaattacaactgggaagaatgtgagaaggagaagtacaccatcaggagaggatataacgtgaacctagtgttgggcctggggagaggtccttgaggaagtggtactggagcagatgtcagaagaatgaggtgtgagcgagagggaaaccgcacaggaagagcgttctggtgagcaggaatagaaacatggaagaatgctctgaaatggagaggagcatgtgctcaaggaaatgagggagaccattgtgtctaggtagggtttggaaagcagtaccggagtggtgggcagtgaggcacgagagaggggaagagtttctaaatgcatcctcatgtaactcaagaatacacctgagatgaattttgttatgcttgtggaggggcagtgcctaataaagtttaggtcacactttgatactagaatgcaatagtaaattgtatgatcttattgctgcctgcgatttgattgattaattacagtgatttttctcttttacaaaagacaaactgctgccacttgttgcattttttaaatgagcagtttgcaaagattgtatcttttatgtaggttgcttatttcatatatttggaaacgggttatatcagttggtggacgatatgtcaaaaatttagaactttctcccatctttccaagttgctaaattatatttcagtgaaaagctttctctctaaagtgctaaaggtatttctcaatggaagcaataaaatgaacttttttggcagctttcccagaaaaaaaaaaatccctctagcatttttggaaatgagtaggggaaaattataaataatgtaaaataaactcacataagaggcttatatgaactattatacaatatatattaggaactaaattttcttccattattcctttaggatcttgtggctctagtagaatgggaaaatgcactcccatgagaaatttgacaataacagccaattctgcacggaaaaaaatattgaatggtttatatataagtttaaaatctattttaaaagtaagacttgatacgtgagagactagtcaagtttggtgattaggaagtctctttttctactaaattcaaacctacagtgttggtgttcactgaatacactaggtagtgtagaggatgcagaactcaggggaaaaggtctcaataccaacctacataatgaaaaagaaaagatatgtgtgaggtgtggctttaaaacaaaagatctaatctaaaaagatctaatctatgtatcacttttgggatctatatgatatgacagttatgccttatgtttggaataataagcaatatgtaaattacagcaatatacaagctactgtatattagtagggaacacaggttccatttctccttacttcttcctggcatgctatgataacaacttaactatgttatgataacaactactagtcatcctgcttcctgtatccctttcttgtgtaccttagacacacgtgcatttttcttcttaaataacaggtatgttatgaaatatttgtgcctaaaattcttaaatatttatctttctctttacacacactctcacacacatttatttatatgtgtatgtgtatatttctgtctccaacttatcttctaggcttattttcgacattccttacaactggcatgagcttcttgttatagtttctagatattctaggttttcttaccttgaggtcacttttttggtcactttattttttctgtttgtaattttttgttctctatttttactatcctctatcacctcagtttttgactgttctttaaaaccaagttcaattggcttaaactctgtgccttttccttacccatatgaaaaatcactgtcttctcatcaaagaattcctgtgatacattagttatgctgtttttatagcacttttcacattttccattgaattatttatgtttatgtgttagattgtaaggaacttgaaggcaaagtttatctctgagtcatttggcttagtaccttgcatagtaattatacagagtaaatatgtatagaatgaatgaataaatatatgagaagaaaaatatatttcttttatgcgcatcgaaagatgtaggcttcatctacatacacaagtcggacttaagtatttagctgacttgattaagggatgtctcatcctgaggaagggtataatttagcaataacttactcattataatttatttaaagttgcattccacaagtaattgtacagcatcacctatgggacaggaacattatatgtgtagcttgtgaattcaagattgataacaatcttcagctgagaccttttttttaaaaatgtggcatttgcctccaagagaaaaggcacgaaagcatcacaagcagagaacaaagagaaagtgtcttcagaatgtaattgtgatgaatctatgcctgtctgtttgcaaggatttgtgtagcactcttgcaccttcccccttaaagaaatttctctactacaaattttcagtgctttgaaatgaaaaataatttctgccattgtaaatttttttgcaaataatttcagcacctagaataagtgaagttatttttcagtaagagtttatgacataaagggaagtgattaaatcagtcatgaattgtgcatttagaatagcatgaaggacttttctttcaacacaactgatacgtttgaactatgctgaaaagttctcctggctgaaaaatggtcatgtcttttttattctaaaataagaatgaaatgttttgtaccttaaattttctttgattttattccaaaaataaatagggaagctaaattttgcaaaaataattagtctctatgataggcacggtgagaacaaaaagagactgtgaatcagatgatcctagttctaggcctgggttcagccacttaattaagtctgtgaccttggcgatttcatataaatatttaagtctgtgacctttgtcatttcatataaatattttcatcctcaggaaccttatctgcacaatttagggattagtctttaatggtaaattttaaactgcttttaggagtcacagtggcacatggagtcccttgagaagcaacctcacaaggggtggcctagggtgccaggctccaccattttttgtgtttgttttgtattctgtttcatttgtttgttaaaattccctttataataggttcgtgacaggaacaaacaacaaatttaaaattctagattaaatcacttctgggtttcatatagcaatcttaatttttacttgtttatggaacatgggtagtagcagataaagataattgtcatttttcttattgctctattcactcacccaacatttattaagaagttgctacatgtaaaaactgctgtgtccagtgttttggaaatttaaaggtgtcagagttcaaaatctattcggaaaatatctaagaaaaaaagtccatgtgataagggttacggcagaaatataaataaaatgtccttaaagaatgtaggtagagacttcattcttccatgctctgagcaggtaatgatcccacaacaggagatgaatgcaagttggtttaagtcctatggtctcaaacttggttttagaactgaagcactttttatttcagtatcattattttttaagcaaatgcctgatgaaaagttatctttgaaacattttgtatttaaaaaattgtcatcatgcatacattacttaatttaatacagtacactatttttaactcatagcaaaagaggtaaaacagtaacttaaaatttataggttgtaagaagtatgaagatcattgtgatgcaagtataaaaatggaaacgtgttttaaataaatcaatattcaaatatgtaagtcatataattgttataaataatttaatatacaaatacatatgccaaagtccacatgatatatccactaagaccttaacatcctgaagtgtattatatactagcgtaacataattaatatagtgaaaaatgtctggcaatatgcaaaccatccataaccactttgtttgcaatctaccttcaatatttagttggacaactttggagtgaaaagtactactgcatgagtaaagaaatacaaacgtcttattatgttgctttccagagtcttaggtttcagttgattacctatgtcaattagtatattctctcctttcctttctattacctttctttaaactttgagttttctgtgcctaaaaatgtgtatacatacatcttgtctacccaaaattttattctgttgtaattgaaatatgtatttacttgtgatggctaatttcatgtatcaagcctggctatgtcaagatacccaagtgtttaataaagcatttctctagatgtttctgtgaaggtatagatgagattagcatttataagtagacttacagtaaagcagatgaccctctatagtatgggtgagtctcatccagtcagttggaggttttagtagaagaaatctgacctccatggaagaagagagaattctgccagcagcctgcctttggattcaaactgtcactctttcctgggtctccagcctgctggcctgccctgcactctggacttccagcctccgcaactgcatgagcccattccttaaaataaatctcactatatatatatatatatatatacacacacaactttttggttctgtttctctggagaactctgactaatatatgcttcagggcccagaaagtgctgaccatcttataataatttgaacaaacaaataaacaaaaatagcccaaaccagaaaagtcactcaatgtatatgtgatgtgatacagtgacacagatattgagaaggcaaatactgtgtgatcgagataatggggtcagcagatattcttccagagacaagaagcactggtgtaaacaagtatgctagttaaatactcattagttaaatttacagagggaattcagtgaaccctacaatgcttcagttcttcagaaagattatccagcctctctttacttctcccttccgaaatttcatgtacacgattctagatatttgaataaatgttccacacagaactttgggtgatgaaataaaacctatccatctgtaatggaagggaactgactcttacaattgttatttctgatactgatagaatttttgtctcaaataatttttacacttactgctgttgttttcctttctgtcttgctcacacttttagtgtaaatatagttataacatatagaactgttagaattgtggcattaggttgtagatttgtgatcttcctatatttttgatgaaggcatttaactcaggactcattttgaaagtctaaactctttgaattggaaatatatctcctgaaagttttttactggatttagtaaaattgagcatttacctcactgtttttctttttcaaaagacatataatatttaaaaacagtagagaataatgtgggggaaaatgcaatctaattaggtttattgttattactattttgacatttttagatctctttagaaaaaaattacataaaagacatttgaagcttcatatatataacgctaacctattttcctcccttcttcctcatatgtatctattttaccacatatttatttttccataaatttctgtctattgttttaatttttaaagttttatataaatagtatataaatcatatatttatataactttctttcttatatgtgttttttaactgagtaatgaaagaataagtgtttaaagtaaaatattttatcaggtatacttatgaaacatcaagtatacccattaaacttgtcaacttttatcgtaggaatgttacatggtaagtccttagttaacatcattgataggttcttggaaactgtgacattaagcaaaaggacatacagcaggtccttgaataacatcattttgctcaacatcattttcttataatgttgagaaaaagcatggtatttttatacgttgttttgcttaagtcacagtttctaagaacctattgacaatgttaactgaggacgtgttgtgtttgccatttttttctagccaaaaactctaagaaacttgaaatgacaaacccttcaatatgctttctcgatatctttctcataagaactcagataatttcagtatagataataatatagctactttctgtataattgtggattttatatgagaattgctaataaaatgcctttttttaataaataaaacctaaacttaccctaattatactttcattttcttcctgatctcttaaatcatcgtggattacagggttttgttgttgttgttgtttaaatctggcatatggttacaaatatagcctgtgtgctaataatcatttcatcttttttaatatattagaagacatttacacagtggttcttttccaaggagagcattttctgctcagttagcaggaaatgcataagtagttttcctaagtgagatcttcatcagcctagaagtgtctactgcaactttctgggcttttaaaatcataccaccaattattcctgagatgttgtattacgtctttgacagctgacatttttttgtgtcacagctatttctatacaaatagaatgcatggagcattacaagatatttaaaattgttatgtattcaaatagtaataggtattgttttgaaatgtacttctttaattcacaatatacttcctttagggcacctggccagggatttaaaaacccaaagcaaacatgtttttgtttctttctagaaagatcaataaatagcattatacaattacaacttactattctcacatcgctaaaatagaagtgtgcttatggctgatgtcaaagactgtagttgcctacgcatcacagtctcccaaggagaaagcttaacctttaattgtatgctactcaagcaggattgctgactatccttatctattgaggggaaataagtaaatagtaggagagaattaactgcctttcattctttgctatcacttaaacatatggtataaacaggatttttttttgtggctgttgatttttttccagtggctctttgctggaagcaaaaatatattttgccttgaaaataaagttagtgttctcaatttgtgataaaggtcactatttaaaaatattttttgttgtttttgttttctgacaactcaagcagaattgattaaggataaaaaaatggcttgctatttatggagatgatttcctatagtttgtaatttaatggactccctaaccaaaacacattcctaaaatagttttatgagttaaaatgttaagtgatcggtttaaaaaaaaagtaaattcctttctataagacacttctgaatcaatatcattgtattactgaaatattaaaaacaagcaagaaaaccaatgagacttgttatacaggtacatgtggctactcaactatattgtgatgtcagagaaagctcccttttctatggagggccatgtgaccagaagaaataggtgctttcttactatgaaagacacaattgtcccttattctaatttgcgtagatatttatttcaatttccacaaaagtcctgtttacataagagacagaaataaatgtataacattataaagtaaaccattgaataatatataaaaacagcttgaagttttatattatgactatcactgtgaaatgctatcattacatgctttttgatggcatgatgcttttaaattgaaggttaaaagtcctaaaatatgtaactagttagtgtaaaatttttatttaaaactgatggagattcagttttttaatttctgtttcagaaattatcatcagtctaggaggtgtaaattatcctctcaaaggaaggattttgctcttatctattgggaattttctttaaggcctcttgcctgtaaaatcacttgtatctaatatgtgccattaattataaaaccactcctcctataggtctaccatcacagagttttgactaacattttttgaaccaccatatttattatgataacaatttaactaaattaggccctgcttttcatcattcagacaacttttgggaaaacatttaaaaaataaactcaaaactccactgtctctgagaagtttaaaaacagtgagcctcaattcttatgtcagtgaagtcaagagtttcagataaatctgtatattcaatcctgaggtatcaaatccagttcactgaaattgtcaacagtgatttacaaaaataaactgaagggcactgtttattcacttctgtactgatgttctatcttcttacggtgttttctcacagcttttttttgtgtagagaatcttgtattaaaaggtcaagaatattgggatttaagcctactgctgctactattttaataggtatttaactcccaattgcctatatttcttgtgtggtagtaagtgggatactgaagttagattcattgatgtctatggactttgctgtcaccattccctatcttgagaatcttatcttcccatctctctgcttccttttttcccttttcttttaaacatttttttttattcatttgctctttttctctacttctcttccattgaaatgactatattttccctcccttttaatatgctaagtcactttcagagactcaatcctaccctattcttctcaaacattcttaaaatacccttttctaaattgtagagcatgtaattttcctctcatttccaatattccttcctattctatcatgtatgttataatctgtgatgagtaaattaagaatcaagtgtgtcacagcaaaaaccaaaagaatgagaaagatagtggaaatagcacagctctggttaaaactgctttcatcttgccctttctcttagtaaaaactcaaccccacagtattctaacaggatttttactaccgttcttttcctgtcctaaccccaattcaaataaagacttcacaccatctcagttcagttaaaagaaatactgttctctttaatgttagaaataaagctctagtcttccataccagaaggattttgagtaggtatattaactttttgctctacccactttagagtagactggaagtattaggccaatatatgttaattattttcttctgatggcaaaataatataacgcctgctaatatttcgagtgagttttaagactttcaaaaatccttaaaaaaaggtaatacatgacttcagttcaactccataaaatagcatatcccagcatttagagaatcaaagacaaaaaagacaagttcattaatctcaagcagcttacagtctattagtggagctagaaatataagcacataaatgttaaaaagaataattaagaaaggatttataaaagatagcaattatacagaaaaatgtctaattctcataagatagtatgagaggtttggctctgtgtccccacccaaatctcgtgttgaattgttattcccgatgttaggggaaggacctggtgggaggtgattggatcacgggggcagatttcccccttggtgttcttgtgacagtgaataagttctcaggagatctggttgtttaaaagtgtgtagcgtttccctcttcactctctctctcttgctctgccatgtgaagatgtgccagcttccccttcgccttccaccataactgaaagtttcctgaggccacccagccatgcttcctgtatagcctgtggaactctgagtcaattaaatctcttcataaattactcagtttcaggtatgtgtttatagcagtgtgagaatagactaatacagatatcaaagcaagtgattcataaaagttgagattcctgggccgagttttaaaagataactaggaatatctcacaggcaaaaaatagagagtgagattaaaaaaaaaaattcaggcagagagaacaagtacagactcaagaaaatgttatgtaattaacattcataattgaattcattagacactatttggaaatgggcttacatatatgacaaaactgaaaaatggcagatttctgatatgaattatttcaccggattgcttaatttgctttttattgatattatggaactcattacaaattatttatatagagctataattcacaattatataccagtagcaataaaaaactagtagaattgtagatgatgttggcactttctttgtagtttgctcaaaattttcattgaagaagaggttacattcctctaattgtatttttccttttaatattgtgcaattaaatgtttatttgcagttcataaagcaacatcatctcatttgtttgaaaatcctgcttgacatgttcttgtatttagtcttgctattaaattaggggccattagaataaatgagattgtgagatgttaatacagaggtcagttcaattttctacccatttccaccaatgtgaaaagcatctaacatgtttgcataaatcctgacttatagatgtggtaataaacaaacaaaattgtaaatttcatttatttacaactactggggagtagaaaacataaagaaaataatgatcatatacaggcagaagctgagagtctcacagccccctttttatatttaataataatatacatattttaaattgacatataataattgcacatatttggggggtacataccaatgtttatatttatagatatgttgagtaggtgcaaaagtaattgcagtttttgcaattacttttaattacactatatataatggacagttaattttactacactatatatatgttacagtaatcagatcaggatgcttagcatatccaacatctcaaacatttataatttacttgtgttgggagcattcaatatacactcactagctatttgaaactatataatatattaatgttcactatagtcatcccacagtggtagattttcactgcctttcagagtttgtacagagagttaaaactatttttctttttctatatttagtctgtacattttttccttttgcaattccttttcagcattctgcttctaatctctacgtccatgacttcaattgttttgatttttagataccacaaaatatgcttatttcacattgtatgcctttatcaaaacatctcatgtaccccatacatacatacacctactatgtactcacaaaagttaaaaataaaaaaattctctatctattcattttttaaaattatttgccattactcatttccttggtttcttttacagtcgtttccctattaaatcagttagcttttgtttagcttttataattcattctccattctctatattgtacttacctatgacacagttatttaggtgattacttttagagtggattggcatatttctgttagaagatgatatcaaaatattgttaggtaaatgaatatatatctacctaaatgatacatacatatatatatatatgtgtgtgtgtgttatatatatatgtaaacataccaccttaatgggatgcatacagggctaatacgataattccttattttatataatgggaaagtagtttttgccttattcctcgaattaacggtgtagagagactcaatttgttttaaaatcttaattatcaatgataattcttcaaataaatactctcatttcattgcaaagttattactattagagaacattttaattattgttatcaaattttacttttttagaaaaacacaaatcctattttaagttgaaaaagcgaatgttaaaaatgttttaggatttacacaatattttatttgaagttttcaatttttcaaatgtgaaaatacctatgaagtatgaatttttttatttatcacgttgattataactttaagttttaaaaatgttgaaaagcaactgggttatgtagaagtgtatatgtgtgtttctaaacaccttatatattatgtattattacaaaatgtttataaacacgttataattttcagaggcttacattctttttaaaatgatacttcgttaataacacttcactaagtttttcattcagaaaattttaatctaaactagactgatgtactactacacactaatatgtaaaaagggaccactaccccttgagtgagactttatattatttaaattttgctccaagtactgtatgcatctggatatattcgaaaaaaatctttccacattctcttatttctgttttcttagatgaagcatgagtgggctggtttgtgcatctagaacaggggtaggggacagggagatatccaaccaagtatggaaaagcatctcttctcttaattttcttcctccaaattaaggtgctgtaacttgaacgaacactcaaattaatgtgtacacatgttatggaaaaaaataatgcagtgatcaatgaaagaatccaggtttaatattgggaattaatacaaagaggggatatagaaaattgaagctaggcttaaaattgaccccaaaaacttatctgaacaaatgaaatcttagaaatcctttaagtatagtatgccttggaaatgagtgatatggaatgatcatagtaaaaccacactaatgtgacatgtaaacttacctatgactacatgaaaacttgggcccaaggaaagctggattatcaatactatgtgtatatgaaagagtttgtcatgaacctagactgtgtcacttttttccatactaagagggatgctatctcatccacccaacatgaatggaaatttaattatattcaattatcttaccaggtttggagatacaaatgaaatactattatttaatatttactgagtgcttattttcaagtggttatcatgttaaaggctttagatcattgactaatacaattccataataaccaccctgactaggtgtttttactagctgaatttttcagataaaattgagacttacagagactgaataacttttccaatattaccctgctagtagaaagtggcagaactgggattggatcccagttcttagaaaatcaccaatctttcttaaccattatgctatttattggttttataaataattacttcaaattacctacttggtggcatccttaatttggagccaagcacttatttaaacaaacacttaatgaaatatttatttatttttaaaaaacttaattaaacacttatttaaacaaagtttaagtaagatacagtttttgttcttgaggaacttacagtataacagagggagaaagccatgtaaacaaaaaaacaaacacctctaagtttgtggctttgtacagagagagtggtctgttccttttggatttttactttctagaagttttatgcaaggctccataaatatattatgtctgagtttcattgtgaaaagttagcaggtattcacttactgaagggaagccattaaaatgttttaggctggattataaccactggacatgaacgaagaagaagatttcagctgagaatagtgagtccatttaaaaggctgttgaagtagtcaaactgaggtcagatggaggcccgaagagaggtagttccagagacaaggcactgtgaagagaagggattttggtgtttgaggagtagcaatcatggaccacacacatttctgagtggaagtaaatcagctcaacctatgtcactgcctgggcatttgacagccatttgttgctttccttgtttttaattacttaatttctattatttttgaagagactacctaacatacttaagaaacttcactttccaaaaatctttggctattattatcccgtcaggaaaactccttatcaaagaaaactttctttttggaattatttttttcttcagtgtcaagtgcttttatattctgttgaagatttgtttttcgttaaaagataacttccacttcctgtattgcaacaatccaatgagaatgaagaaggttagaatatagttgtccctcagtatcagcagatagaactggttctaggaaccaggtggatatcaaaatctgcaaatgctcaagctccttatgtagaatggtatcactgtatttgcatataacctacgcacatcttccatttagataatctctagattagttataatacctaaatcaatgtaaatgctatgtgaatagttgtcataccatgttttctatttgtatatttttattgttgtattgttatttttattatttcttaaaaaatattttcagcctgaggttggttgaatccatggatgtggaatccaagaatacagaaggccgattgtaaccgatatcggatcaaaaagagagtaatagaaagaaaggcataaaaataggaaaagacaaatgaaacaaacaaaaaagccacaacaaaaataacccaacttagttagattcaagtttcataatttttttttcttaaaggtatgattaagagttgatgagagatacttggaagaaaaaacaaaacaaaataaaataaaacaaaaaagctgaggaagtttagtaacagagaagagttaattgcttttagaatattttcacaatagtaaagctgcaaattagtttaataggatacaaaattttaaatgtaattatattaataaggaggtaatgatttcttgtagtctataagttatcctatacagacatgaaatattttttgtattatataacaaaccctactgaaaggatggatgtctcataagtatattaaaatttttctaaaaggcatttataaaaacaggtgtgaaaatttttaacacaggatggactagaagaaaataaataggagactagaaaaagatacattctcattggaaattctacagctccatacttgggatcctaagctataattggatgtggaacactcaatttgagagaattttcacagaatgctaaagttctctcttttttatcatccaaaaaaaatcatcattaaaaacttccaaagggcgtaaaacatataatattggcagagagacacaaacatgtttttttttaatttaattttaaccccctgtgaaaaaagaattccttgagtttggccaaaattcaaaattttaacttagaaaataataccagtctctattcactaaaaatatgcattctttcatttatttctgaaaaaaagaggtagaattttatttctgtaatgtcaaagcaagtcctcatccttctttaatagacactatatttgtcaaaatttttgtaagcataaaaatatggctggagttcttagaaatgtttgccgtaacttaaccaataaataaagtattgcctcaaactaaattgcattagaaacaggaaaaggagctctaagcaagaactgactgcaatcattcagaattatatttgtattttcaataatggccaaagacataaaattacgagtgcccactaggtgaacattatttattgtgtgtcagttatgactcataatacatagtcattatctctttaacacagtaagccagaataatatatatgatttttcccattttacagatttaaaaatgatgctttcaaagtaggcttaactgcttcacaggaatgttgtctaattttgagcaatgtacattataatttttctaatactgtctacatacagtattattggtacaactttaagtaggttgtgtagtatattgtaacacagggtacaaatcctgacagcaagtggtaaatataatggtgaggtcaagccaattccaaggaaatacattttctgggacatatgagaactttgccttttgtatatatgagcatcatgtaagagcgaatggtacagtaaaaaccccaaggaaatggcaacttaaatgtgagtcatttaaacaacattctgaggtattggtataaggttaggatcatgttttaattattgttgatctgcaaaatattctattgggcatccttcaatcctttcaagcatccagcctaaaatactaatactatataatgttacatgactccaaacaagattgaggaccagtgaccttgtacaaccctttcattttataattgaggaagttaaaggcttgagtggttagactgttggtaagtaagtcattacaatagcaaaactagaacccaaatctccaaactcttttttcccattatgttttctcctatatcatactgcctggtataatgataatggtaaagttcttgctttttaactctaactgttaacattttaataataaacataaacaaccaactgaaataataaaaataatttacacatgcattttaaaatatttattgtatgaccagcatatactaacttaaacaaatttaaattgtacactttgataaatactgacatacttaaaaattgtaaacacaaagtagtcatcattccccccaaactcccttgcttctctgtaattcttctcacccacacttcctgactgcaattccatacccaggaaaacgtggtttttttctggtcactgtattagtttgcattttatacaggcttatataaacagaatcatacaatctacattgcatttctggccttgtttctttaacggagcatacttatttggggatttatccatatttctttttttttttttttttttttttttgagacggagtctcgctctgtcgcccaggctggagtgcagtggcgggatctcggctcactgcaagctccgcctcccgggttcacgccattctcctgcctcggcctcccgagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccgttatccatatttctatgaatgtcaatagttcattgcttgttataaatttatactatttcattggatggctatactatgatttgtttatccactcacacgttgatggacagttgtgttgttttcagctttggctgttacaaatagagctgctatgaacatttacacttaagtctgtataggaacatatgttttgaaattttgggtaaatacctaggaatggaatgatgagttcatttggttggtataagtttaactttttaagaaagtttcaaattgttttaaatgagttgtaacattttactttcccactggtaatgtataagagtttcagttgctccacatcttcatcaatactggtgtggttacacattttaattttagacattattgtaggtgcatagggatgtctcgctgtgggttcaatttgcatctccctaatgacaaagagtgttaagcatcttctcatgtgtttgtcatgcattttccttcattgtttcaatgtctcttcaaagttttgcctgtcttaaaattgggttgtttgtattcttattatcaagctttgaacattatttttctgctctggaaacaatcctgttgtcgactgtatgatttgcatgtattttctcacccatttgtggctgaccttaacagtgtttttcaaagtagaaattcttaattttgatgaagtccatttcattttttatgggcttttattttagcgttgtgtctataaaatttttacctatcctaaatttacaaagattttttctatgcttatttctagacatttcatagttttaagtttaatgtttagctctgtgaatgattttgggttatttttgcatatcttatgagttatagatcaaaattcatttttttgcatacgtatagtcagtaccatttgttgaaaaggctatgctttcttcactgaatccccttcacacctttatcaaaaatcaattgaccatgtaattttgtgtttcacttttagattctccattctactttattgctttatttgactgttttgatgtatgtgatcttttatcctgaaaacttgcaaaacactttttagttccagtggctttttgtagcttctgttggattttcttcttacacatcggtcgtcttataataaggaaagttttattttttcactttttaatggcttacatttatgttttctgacttagtgcactaggcaatacatccaggacaatgataatagaagtgggaatagtggaaattcttgactttttcctgatcttaacaggaaagtattcaatcttcaccattaagcgtaaagttagatgtaggtctttcatagattcccttttcaggttaagtaatttttcttctatttctaggatcctcagaattttatcactcagagtatggtctattttggtaaatattctttatgaatttgaaaagaaatatgtgttcagctgttgttagctatcgcgttctaaaaccatcaatagtgtcaagttggatgatagtgttgttcaagtcttactgagagagacagttgaaatatccttctataatttgtttctttttttgatgatgaaattgtgtttaagtttttcagctttattgatgtatgattgaacataaaaattagtatatttaaggtctacaatgtgattttatatatttatatattgtgaaatgattaccacaatctagctaaaaatcatacccatcacctcaaattgttatcttggttgtgtgtgtgtgtgtgtgtgtgtgtgtgtgtgtgtgtgtgtacgtatgcgatgacaacaactgagaacttaaggtctattctcttagcaaatttcaagtataaaatacattataattaactgtagtcaacatgttaaaaattatgtctccaggacttattcatcttatgaatgaaagtttataccacttgacctcaacatctctcccatttcctaccctcctatctcctggtaccatcattctgctctctgtttatatgaatttggattttttagattgcgcgtataagtgatgtcatgcaatatttttatctttctatgtctggcttatttctcttagcataatgtcctccagtttcatccatgttgtcacaaatggcaagatttacttatatttgatgctgaataacacctgattgtatatatatgacacattttcattatgcatttacccactgatgaacacaaggttgattccacattttaggtattgtgaataaagctgcagtggacatgggagtacaaatatctctttgaaataatgatttcatttcctttgtatttgtacacagaagtgagaatgctggatcataaggtacttctatttttaacttttggaggaatctccatcctgtttttcataatgatggtatcaattacattctcaccaatactgtacagtggttcccttttctccatttcctcaccaacagttatattttttccttatttacaatagtgtgaagtgatatctcattgtagttttggatttgcttttctgtgaggattagtgatgttgagcattttgtcatatacctgttggccatttgtatgtcttctttggagaaatatcaatttaggtttttttctttattttttcctgagttgtttgacttcctaatgtattttggatattaacctcttatcaagtatataatttgcaatttttaaattttacctttcatagtttgtctcttcattcggttgattgttttaatttttttggggggggggtggaggggggagggatagcattaggagatatacctaatgctaaatgatgagttaatgggtgcagcacaccagcatggcacatgtatacatatgcaactaactggcacattgtgcatatgtaccctaaaacttaaagtataataataataataaataataataataataataataataaaaagctttttattttgacttaatcccatttgccttttaaaaaaaaaattgttgcctgtgtttttggagtcatgtccaaaatatcattgccaagatcaatgtcatagaacttttctcctgtgttttcttgtagatgttttatgatttcaggacttacatttaatctttaatccatgttgaattgatttctgtatatgatgtgaagtaaggatataatttcagtcttctgcttgtgggtttccagctttcctagaatcatttattgaagagaatgtcctttccccattgtgtgttgttgacatcttggtcaaaaatcaaatggcagtacatgtgtggattttatttctagtctgtctgcattgttctgttagcacatgtatctgattttaagtcaataccatgttgctttggttactatagctttgtagtattttttgaaatccaggtagagagatgcctccaaatttgttattttgtctaagattgctttggctacttggggtcttttatggttctgtaatgaattttaggattattttttaattttgtgtaaaacatcatgggggcgttcataggcattgcattgaatttttatatcactttgggtattatgaatattttaataatattatttcaaaccaagaatatgtgatatcctttcatttatttgtagcttcaacttcttttgtcaatattatatagttttcggtttacagatcttttacctccttagttaaacatattcctaaatataatattttactttattttattgtagatattgcaaatggaaatgttttcttaatcttctttggatagtttgttgttagtgtatagaaatgctactgatttaagaaattcagtgcttcttttttttttttttttttgtgacggagtctctacctctgtctcccaagctggagtgcagtggcgcaatcttggctcactgcaagctccgcctcccgtgttcacaccattctcctgcctcagcctcctgagtagctgggactacaggcgcctggcaccatgcccggctaactttttgtacttttagtagagaccgggtttcaccgtgttagccaggatggtctcgatctcctgaccttgtgatccgcccgccttggcttcccaaagtgctggaattataggcgtgagcaactgcacccggctgaaattcaattcttctttacattaaacataagataattttctaaaagtttaaaaaatattgtcttatttaaacacgacaacaatctaatgtagtagattctttatctatagaggatgaaactgtggcacacagggtgaggtttatataacttttgtaaacccatacagatattaaaattgaatgatggcattttgagtaaagatgttatatgattagatatccttcactctgtgttgctttacttatccaatcattttacctagttaaaatgattaaaataataaaatgttttaccagtagcaaatgaaaacatatatatctcagaatctacttataaccactaactaaagaaaaaaatttcgtatgtttttctaaataacatagcatttaaagctgtattctaaaaaagattacatatattgcataatgattttacttaattactatcacaacatgtagtcaaatatgaatgcttaaaatgtggtgttgcataatgatggaattttaaaaatatgtcagtgaaattcatttaggaacgaaaatgtgacttttctatctttaatttataaggctaataaaattgaaataatatatactttaccgactggtggagtggtccaaagaacaatgaaatgaagttatttaaaacactgtcattcttaggataaaaatcctttgcaaaaacagatggctaaactatttgatttaacttcatgtgtgtgtgtgtgtgtgtgtgtgtgtgtgtgtgtgtgtgtgtgtgtgtgtgtgtgtgtttgcttagtattgttagactatgaaaatgtacttaaatcttttaagaatggaagaatatttttgtcataatcagcagtgcaggcacttgaaaactctagcacaatatttttttttaactgtaactgttttggtttgctaatgcagcacttacttttccatatgcaaagatatttaaggtctcaatggttaaccttattttagtattactgtggagaaagttgcaatctgaatctaaaataagtcatttagtttagactaaatggacagacacatctttgaagtttatagatacagtttccagtgacccagtttttgacatactactgtcgtggttcactctaggttttccaaacactgtttcagtgattactgagccagagacagtatgcttgattgtgtcagtttatacttgaatacctttaatatgtgaatctatgcatcatactcaccatttatcactctaaccctctagggcatatgagcacaacacataaatctattttggctgctccttaaatgtcataaataccctggctatatttggttttaatatatatatattttaaagagataaatactgtaaatcatatttctgaaggaaacattattttgacaaaatgtccatcaattaaacagggtatatatgtttatatatttatatatcctcttttatatatattaattatattaatatacatataatacattaatataattaaaataatatatattttaatatatataaatatatatattcacacataatcacacacacacatagagatacacaaattgaaaaacaaacatacacataccataaactgtgttattggtactatacaagagttacatcttttacagaacaacataggccctagaaatagtataaactcaagaaatatttgttgactaaatgactgcataagcaaatgaggaaacggcctagaaattgatctaaataacattaaaaaattgactgtatcccatccaatatcatagaataatattttctatattactgcaattaccatatctttgattttctttaccaccaacctcttatttgtgcagttatctttttcctctagtgctctccctctttgtctctcctgcctaagctaaatgtaactaaaataaaaaatgtaagttactttaaagtatagcaccatgaaatcttcttagtctgattgtttggaagtagtcagtggctttacccctacaacttaaattttgtatttcaaacttagtcctgaaaaggcattatttgcttcatctccataaaattgcattttagtagcatgacttgatgtgcttaataaattagttatgcatcttaatgatagaagacagcttaacctgtctttaaaacatcatcataaagctggtcatgcatttttctttagtgtcttccctagcactgtgaagctgtatgctcatatttacatcaaaactctgtcagatgattagattttgcacattttttaatggccattgaaaacaagttctttaggaccttaattgccaaagcaaaagtatgaaatagttttgatcaccatgctgtgatcatacttctatgacattcttaagtaaatggcttaccttggacacacttttaaatatatctgacttctttttttccctttatggttttccatcttgtttctgcagacgttctcttccttctgtacgcctctcccaatatagaatttcaaatttgtcatcaattttctgtccacatctccctatctgaaatgtttgctaataaggtaattctggctaggaacactcacagcaattctttgcgggggtaaaatgctactcttcaaggcccagtgtgacatctccaatgatttctcaggatttatgagtttcctttgtggagctgactttctttatggtgtggctgcatttctgaggatcatcacagtgtcaaaattcgttacagtgagaataagtatctcatatgagccagttgaaaagctaatacaatttagatatttgtggttattgataaagatatatttaacaatgtagtgatttcagaaaaaataataatggtgggaaatattacaccttgtgtataattatgatacattagtggacttacttcaagtttagtttgtgcacgctatggaaataattacatggttttttaaaagttgttaagatacatagtcctccttagtctttgctctgctaaagtggatttagtgtactacaaatggtaaactgttagaatggtccaagtctaattcataataaaattttacctattacaaactgtggttatatggattaaaaaaatgcctaaattttccagagaaagttttacaaaatgtgtttatttggattttttaactatattaatcaacaaatatgtagcattttcaatacctccgtattgttctgtttaaatgagcacttacatattattagatttgatgatgttctttattttacatatgggaaaactgaggcacagatacattcattaagttcacatggaaaagcagaaccagattttgaaaatgaaagagatagttataaagttgctgcttattgaggagtattcttcagacctttcaattttatttggtgaatcaggaaatagattaattgatcaataggaacaaactacgttaaatgattgataagtaatataaattaattccaaaagtggagacttctgtgggcttcagttagctaaaaacatgttattgaggagacaggcttgatctggactttggagaaaatagagaggcaattagggagacataatgttggagtgagtacatagaatattcaaataaatatcaaatgttattaaagcatttcataaattaagttttagcgtaattgatagaatgtgattctttgaaacattgtaattactagcttaaaattgtttattgcataatgagtattattattattgttattttggaacatgttttcccttctgattagttttcttacaatttctgtgtaataatgattacaaataatttttcttgtcaaaaaatacacgtatcttctcagttctactaaaatgaatgttttacatgaatttgttagagtaaaagcataagaaaccatcaggatctagaaaggaaagaaatggaatgagaattaaataacttacttgaattgtcttgctttaagtgaatgtcatttcttatgataatcacaaaaatcattaatcaaattttattttcataagtttgcatgagattacttaatagttttcttgagtcaatatagtgttgaaatataacatttttacatttttctccttagtaggaaagataatctataactatgggtgagcttatcatcaagaactccaggaaaattatgaagtgatttctcttgccacagtgcctgtcttagtttcctgaggctgttgtaccaaattaccacaaatttggtggcttctaacaacagaaatgtattctctcacaggtctcaaggctagaagtccaaaattcaaacttggcagggctgtgatccctgcagggctctggggagaatatgttgtttgtcttttctgcctttctttggctgcactggttttccttgacttgtggtcgctcaaggctctaaccttaattgcatctgcaagtactctttttctaagtaacgtaacattcataggttacagaaattaaggtgtaggcatatcttttgggggtgccatccctcaacctacttcagtcctcttttcctttgagctttcttcaaaatccctatttcatctgctacctgtgattagagctcccttgctcactatgctccccttctacttcattgtagctcttaggaagttgtcaactctcttgttcagcttttaaaagtactcatttgattattcttgctggtgtctagtttcgtgaggtttctatgctctacatgctgacaagggtagtaagtatgatctcaatacagtgaaatcacctctcaatagagttaaatttctgaagtcagcaggataggctgaatgtgtatatgacgtaaacatggtaagccagaattaatatagctgtactgacaagtacacaaaattggaagtttaatttactcaaaggtcttgagaaaattgtttattatctttaatttcatatacctttataggcttctaattttttctgtaatcttatagagtacccttaaagttcctggaagtagagaagtattactcttctattttaagaaattacggaaagaaaaagatagaggtaattactccaggataagtgttcatttaatagaatggtaataaggaatttatgtgaatcacagacactatttaaatgattctctagtatgactagccaattatctcagcaccatttactgaataaggagtcttcctcattgcttgtttttgttgaccttgttgaaaatcaggtggttgaaagtgtgaagctttgtttctgaattttttattctgttccattcgtctatatgtatgtttttgtactagcatcataaaattttcatcagtatagccttgtagtatagattaaagttaggtagtgtgatgcctccagcttcattctttttgcttaggattgctttggctattcaggctcttttttggttccagatgaatttcatgttatttttccaattatttaaagaatgatgttggtagtttcataagaatagcacagaatctgtaaattgccttgggaagcatgaccattttaacaatattgattctttcaatccatgagcttagaaagtatttcaatttatttgtgtcaatcattatgctgaaaagacacatgcatttgtctgttcattactgcactattcattattgcaaagacatggaatctatccatatgcccatcagtggtggactggagaataaaatgtgatatatatatatatatatatatatatatatatatatatatatatatatatataaaataacaatacaagcttatagctgctcagagaattttgatttattcaagatttatatatatctatatttatatatatactatggaatactacacagccataaaaaaacagtgaaatcatgtcctttgtagcaacatggatggagctgaaggcaataatcctaagcaaaataacacaggaatagaaaaccaaatattgcatgtcctcacttatatgtgggtgctaaactttgagaacacatggacataaacttgggaacaatgggagcaatagacactgtggactacttagagggcagagggaggaaggaggacatgggttgaaaaactacttattgggtactatgctcactaccggggtgcaatatacccatgtaacaaaccttcacctgtacccctgcatctaacttaaaagttaaattaaaaaatataaaatgaaataaaaataattattctattcttgcaccttctccttctggttgaattggtcaaaggcaaataagaatataatttgactccatttagttatgttaactgttttagaaaatacaatagttacccaattaaaatctactttttttaagacgagattaatttaagtcagaatatgagcctatttgttaatttggtcttatcaaatcatatcacagggcagattgttgctcaattctggcttgtgattgacttgtctctggctgaaagaatctagagacgcataacttaaaaactctaacggaagaagatgttactaattaattcttcaaactcagtatacatcacttaaacaatgtattattttacaatattaaatgcttatttttattattaacattattctctaaattctatgtctatcattgttttagaaatttatttttaatagcaacatctgtgaactataaatactaataatatgttgcaacataggattgtatccatacatggaatattttgacagaatacactagacacatctagacaaacttgttgttcaactgacatagttggtcaaaagtacaagcttggctgggcgcagtggctcacgcttgtaatctcagcagtttgggaggctgaggtgggcggatcacaaggtcaggagttagaaaccagcctggccaatatggcgaaaacctgtctctagcagaaaatacaaaaattagctggctgtagtgcacatgcctgaagtcccagctactcaggaggctgaggcaagagaatcgcttgaatctgagaggcagaggttgcagtgagccaaggtcgtgccactgcactccagcctgggtgacagagtgagactctgtctcacaataataataatactaataataataaccacaataacaatacaagcttataactgctcagagaattttgatttatacaggatgccagttgaatgttgagttagttttccccttttcaagtgatgtcatgttttatcagtttaatttatcaagacagtcaatatgtatgttgggaaaagcaataaagctctcgttactgaataaatatcactgggacgatcaaagctagagtaaaatcctgggtcaggaacaccaaccacaagattcagggagcaatcagatttcagaatgtgattaccaagctgggtcagatgtctggagaataggatctggatgaagtagatacggaaggtgtaagtaagtttgccaaactaaaatcagaataatgaaagtcatatttagaagtctgagggagccttttcaggctgctacagggatagggaggtaaacaagcaacagaaaaaaattaaaatgcctctttggaatgttaagtagcagaatgcccctgttggtgtttcctgccacacctgacagtgtggcaaattagcttatacatttttgaagaattttaagaaatggaaatattgcatatgagaacgcacagttagttaacctctctgatatggcataggaaagaagattaaactacgtgaatgataaagcaaggtgctctccatgtaaactaacttgtaaaactgaccactcccaaatttgtatgtttttattcacactgtgatagaacaaggtaaatctatggtggaaggatggagggggagaaagaaacattacaaattgatagggaacattttaactgacaatagttgctatacctaatgtttctattcatttatagtaattgtaacctacccaaagtcacaaagatggtatctgacacaactagagttggttattgaaagatcactgctacaggcaaggcaccaagatgcctcatccaagctgcataatgattcagtaattcccttgaagaaagttagtaactataaaaagaaggtaaagataaaatgtcatttctgacttccagaagccccagcagtaatatactttattatatactgtatgtaagcaggaaataaaatattataggaattgtgaatattaattaaccacatcttcatagagtactcagaaaagagtttctggaagatcaatggttccaaacagattctaaatgatgatggtttaggaaggtggagagacacattcaatattttatgcaaagccaacataattttatataatattttatataatacttgttgaataaagaagaatatggcataaaattgaagcagtacatcagaataagttaatggagagattaagattcagactaaaaattctgggtctagttcagtagatattgagatagtaggatgattatgaagagcgtcatatgaagaagtactatacaggtttgacttatgaggtatggagttgtatatatttgatctaaatctcatatctaccactttttagctttgatcttaagctattttacattattatgcattataatttctcatatttaaactcagattaatgaaaatatttccttcatattacatggaaatatgtaatatggaggattacatggaaaacttcatgtagcgatctaatcatggtgcttaccatacatttaagaattatctatttattaaacaaatatttaagtggctgctacaggcaggtcattttgttattgttatttttataattttaatattatcattactcttattttcgatattgctaataacttgaggacgtttatggcaaatatatttaggctggatgaagcatcctaatcctggaggatgacagttggggattgggaaggaatcagtgagaatattcaaatgtttctaattgaataaatttatttgcttatatggcttttatttatgatttatattgtccttatatataataaataaggtgtgtgcatatatatatatatatatatatatatatatatatatatatatatatagtgtgtgtgtgtgtgtgtgtgagtgtatgtgtgtgtatataattcaggaccattataaagagaaaaataggccagtcctggtgactcacacctgtaatcccagcactttgggaggcccaggtgggtggatcacctgaggtcaggagttcaagactagcctgtaaaaccccatttctactaaaaatacaaaaattagccaggcatggtgtcacgtgcctgttgtcccagctacttggtaggatgaggcaggaggattgcttgaacctgtgaggcggaggttgcagtgagctgagattgcaccactgcactccagcctgggcgacagaatgagactctgcctcaaaaaataaataaagaaaaatgagagagagaaaaacaatttgcaaaaatatctgtaataaaaatatttgagaattttaagcttcagactttgcatatgtcagtgtatcatctgctctgcattaattttatgtttgtatgtctgacataaaattttacataaattttacgtggaattttacataaatagctttctaaaaattttctgggcctggaaacaagatttgaaattgtagaaataatgagtatagtgaaaactaatcatgtaaatatacagtagataacaaaaatgatggaacttgtgaaatccaccaagaaaactatgctaatgggttctcattaacactcaaattagattacctgacctctggtttctatttgtaaacttgaatctctaaaacataaagtggccaattcaacattccagccagtatgtaaatcttataatgaaaataaaatataaaaatataaataaaataaaaaaatataaaattagtttttatttttaaccacttaaaaactaaagatagctgaccggtaatcacctttatcatcccattagaagcacatagtaaaaaataagtaattaatgtaatatcatgccctttggtatacagcataaaaaatagaaataaaggggtacatcattcataagcctcatattttatataaattgagcttcttacatttttcctttcatatactccttgtcatatatgtaaatataataaaacttgaaagtttaacataacttttccaatttgacatagaaaaccagattaatatttatgtttgctgaaatttacattctgtcctttcaaaaagtgatgtaaaatagccttataaatctctctctctttcacacacacacacacacacacacacacacacacacacacacacaaacacagataatatagtaggaataagaagggtaagaatcaacagagtaaaaagacaaccaatggaatggaggaaaatacttgcaaatcatatatgtcataagggattaatatccaaaatatataagaaactctacaactgaagcagaaaacataattcaaataaaaatagataaaggatatgaatagacatttctccaagaagagatacaaatggcccacaggtatatgaacagatgcttaacatctctaaaaaatttttaatattaggttttggtgcaatgatacagctcagagatatggatatacagtataacccaaaggaacgtttaattatggcttttcttcattagattttggtgttcatttcatataaattatcaaacatattgatatacatttgtttatgttcttcctcccttagcctcttaatgtctcttttatttctgatatttgtgatttgtacattctcttttttgttatgatctatctggttacaggtatactatttttgctgatctttccaaataactttattttaattcattttcctattgcgtttctgatttatatttcattgatttatttctcatttatttctttcgtttaaacagaaagtttaattcaagactaattttttagacctaaatttatttttccagtttcttaatatagaagcatagatattatattatttcttgtatttaaatttaaacatttaatatgatacattttagagttacttttatgtttaccatctagtgctccttattttttgggtagattccaatttctatctgttattatactcgtgctgaaaaatgaatactactactagaacaggccttctgacattaaaatctctcaagtttttgccagtttcttcattttcttttcatttttgaaagatatttccactagataatagactgtgggatgaagtgattttattttagtattttcaacatatccaataaataactacattgtctttgtcttgcaagaatttctatctttttatctttattcttctatatgctatatcccactcccctgttttccccacccttgctggctttactaattttctcttggtctttcagttccaacaatttatcaatgttttctctaagtgtttgtgtgtttttaaattgttgtgggttttttgtttgtttgtttgtttgtttattttttcctgctacatagtgttgtcttgggttcttggatcggcagttttgtgtgttttgtttttggctttcattgattttatgaaattcttgatcattttctgtcctattgctcttctcctctaagaaaacaatttcatatatgttataacatttgatattgccctatagctgttagatattctgatttatttattctttgtttttcctctttctgattcagtttgtagaacttcttttgattcagattcaggctcagtgcctcaactgtgtcgattctgttgatgaattcactgatggaattttgaaactctgatgtcatgattcttatatgtagctattgcttgaatgctacactttctataaaggtataatgtgacataatctaatactcaattcctgtcaaatgtttggttaaattcttacattcattttggggatataaaaagttaaaagaggacaccggttctgacaaccagtgagaaaaagctgaataatctacaaaattataactattattcaacccatcgaagagctgagatcacaaggcaaacaaataaatcaacttccccagtatgtcactttgaaatagcagagatccagtcacaaggaaacttagcactcattcacaacttatcttcttatgcctccactggatgctttttagaaggatttggggtgctggcatgaaggaggtaactgctgagggatcattgggaagcttgcactacttttctagactctcatatgaagcaaaatctttatgttactgggaaatgggaaacaaactaatctccacaagcaaggcaaaattccactgcttctgaggtcaaaatgtaaccaaaaacccttctgtctctggggtaggcatgctgcccatgggatttaatcaaagaaatgttaatgctgaggaagggtaaaagaacgtacctcttgtgcctgaaggagaagtgagaaatcatctggggctcaggactctgcattctgcaagcacaggtctgataatcctggggaaagaccaggaaactcccatctgtttaagaatgatcaaaaataaaggcaaggtttggcttctttggggaatagacatgctgagaaaactctactcaaggagtctcatgaccctctctgtgcttgtctgaaactgcgactacagtagaacaacagagcctacccaatttataccaccaatttataacacaagcatacctagtgatagtacatttcccatagtattgctgtgatgattatattagacaatagatagaaaacacagtgtataggtgggtaagtcctcagaagacattactacccacaaaaatactccctatgagtaaactaaatatgaaataaatatggttgccccttctactgtaactacaaacagcaataataaatatgcagatttaggaagtttacattgcactctatggttgataacaatataatttttttaatgaagctgttttaacttaaaaactcaacagaaataattatattcattcagatatttttaaaacatccatgtcctaaatgttatttaagaaatcaaaatacatcaaaattatataattagatacatcaaaagcatatttagacacacatctcattgaaatctcgattttgtaacaatattcctcaaaattattgaatgcttttgattggtgcagaggaatatttccatgtaacaacaataataaataaaatcatggtacaagtttaattgtctttgattgaacaatgatgaaatgattcatctaatttgttcattattgaaagtaaataagggccgggcacggtggctcactcctgtaatcccagcactttgggaggccaaggcgggtggatcacctggggtcaggagttcaagaccagcctggctaacatggtgaaacaccgtctctactaaaaatacaaaaactagcaagcggtggtggtgcgcgcctgtaatcccagctactcaggcggctgaggcaggagaatcacatgaacctgggagctggaagttgcagtgagccaagattgtgctactgccctccagcctgggcgatagagcgagactccatttaaaaaaaaaaaaaaaaaagtaaatgatttcacttagagtaaaagatgactgttcttctgtgaaattcatgaaagtttaaaattaaggaagtctttgcatttttggagctacttctttatatgaggatgtgttccaaacaaggaaactaaaaatatgtttccttaaaatcaaaagtacgtttccttaaaattagtcacagggatcactttttaataaaataacttatttaactgtagtgttgttgaggaagaatttcatttggaactacaaattctgttactcatgctttatagtaatagatgatatcattaaaactttttggctctatgttctgtattcagttaaaattaataagatagcaaatatatggaaatataatctgcctgtttgtaacctttatcgtattcaaaattaaaagatgcatttggatggtgtaggtttgtgagaacacagaaatagagttagaagaaaaaattataggtatctttattgatttgtaaaacctggaatgccagttttcttatgtgcttgtaatttttgttcattttatgagcccttatatagcatcctgctctgatcagtttagtgtatttatcattaggctttattaagctgaacagcaaatggacaaatgctttattgaagtgaatagcatattgcagccattatgttcccaagatgatttagactctggatagttattttacgttggtttattgttctcacctccattagacactataactctatcatattgaagaagtagtgtggaataattaccgtggtacattcattaacatgggaaaaaatgaaatgctgattctgaattcccagtatgaaatcccttattgaaacagttccatctcagcatgagctttatgggggatttcataagaggccgtcctctccaaagtccccaaataaagcatctggggatgattctcctcaaattctcctcaaattcaatgttaacctttaagaaaaaccagaagaaacaaatttaaaataccaacaaatgatgcctgttttgcatcattaaccgtaagtgttcacattgagaaatccatacaattgaaacataaaatctagtatctatctaaaaataaaaacaaaaatagaatggaatgaaaaacacatgcaactggagttattaagctagtattgctcttttgtattttatctttctgtttacttataatttctccctattgcacaataagcaatttatagtaaattgtagatcttatatatcactgcattccagccacctggcatttttccctaacatattagcccgataaatatttgctgaatcactatttttgaaaataataaatggctggataagaacatttatttgtaaacctttggaaggagactttttgaatgaaaagtctaccacatgcatatatatgcatcttgcatttgtgacatcttggttaaggggtcttagataatatcagctatgcttccagttccacagtttctaagagctccggtcctgttttgtgctggatattgatgcttttatcttctgctataactgtatactccccaagtctaacataagccttcttgtgtacttttcttattgtcatcaggttagctcagttctttatcacttccaaattgtttaaagtaacaaattaacaactgatatctagctcaaaaacattggtgttttactacattctctttcccttgccatttgaaattaatgatgcaatgacttgtgccatttcttattaaactgattttttttcattgtcatgtttcacatttgtcttgtatatgcctcatggatagatggaatttgttaataaatagctgtttccttattgggtgtgtgtgtgtgtgtgtacatgatgtcaacagaataaagtaattcattttcaatattctatgatttcactatggataaacataaattatgattaattgttctatggtttcttcagtggatgataaaagcattaccatttctaaacatttctcatatcactttatagagtactttttggagatatgcattaatagttggatcaaaattatttaaaccacttcagtaatgccttttccaaactgtgcattgtacatgttcctaaattttgcacaggatacaaaaatgaatgaaaacattttctgtgaggatgggctttccctgacatcagtctattcccagaatccgaatctttagtcattcataagcttgcatttttaaatattattttagttatatctatcctaaaaggctttgtatgctcatcaggacaggtattttaaatgtggaagattattctcctattaaaaagtaaacagagtctttgaatctagaaagggatcttattaaaactgttgttttcctatgagtatattctggaaagaaagactctaccgaactgtcaagagcaattctcttccttcactatttggttattatatatggttagaagattctttcttggtaaaatagtctcaagattttaaccgtccccaatgttgtgcaattagcaaaagtgggacaattttttgacaaaatgatgtttattacatgtgtaaacatttagcattattctgtaatcaggcaattgtatagatacataagagcatgtatcattctgagttagagcaaggattattttgtagtgatcattggttagcatccacatattccattagaacatcctttcagatattcttggatagagaacagaaccacatttttatatctacaaagcctttatgtagtttcagtctatttccatatgatatctgaggcatagatattccatgtttctcagagtaagtggtatctctgtaaacacagaatatgaagctcaaaggctcctaggaaccaacagcttttaaaatgatgcatggcacaataggtattaaggagtcatatctgaaatccaccaaaaaaattttattatcaaaaacgtttaaaaggttgcataataactaagtaaacaatacccagggctaaatggaatacagttttaggccaggcgcagtggctcatgcctctaatcccagcacttttggaggcctaggcgcgcggatcactggaggtcaggagttcaagattaacctggccaacatggtgaaaccccgtctctactaaaaatacaaaaattagccaggtgtggtggcacatgcttgtaattccagctactcattaggctgaggtcggagaattgcttgaaccctggaggcagagtttgcagtgaactgagatcatgccactgcactccagccgggggacagagcaagactccatctcaaaaaaaaaaaaaaaaaaaagaattgaattgaataaagttttaaggattaatgttactatttcgctaagaaaaaagtggtttttatcctagtcactctcctaaaagagggcattataaaactattctattaagtcttcaagaagcacagactcccgactctacaaattccatgaattcagatgtctttcaaaaatattcttatttaactttcttccacctgatacctatgctgggtaatgcatcaccatcagcttagtagctgaagccagccagaaatcatagtggacaagagagacatagcccagcactcataaaattctaaagctacttcattctccacatgaatgaaatctttctgagactaaccttcaattaatgacggagtgtgtcagctgctctaaactcaagtgcagcagcttagaggtgtgtcttgcatccttgtgcatcactcacatttctatcccacacactgctgctaatcaatttctaaaataaaattttaaatctaattatttcacttcctttatttgtctctcattgactcccgttggccttaggataaagcgtgattgccatggctaaacgctcatatttttgaaatctagacttttctagctatctaatttgtttaaattattgctatcattttgaacagtttgaccttttttagccttcagctgtttccaataggagaccactagaaataaccatataaagcaatcagttaaacactttcctcaaaacagaagcatttgttagaaaacatcacatacattgacttaacactgtctttttagtttacgtataagacacaatatgatttgaagaaacaaaaagaaatgcagacaaagacaattagtattagctccttgcacttcagctatttaactattattttttacatttttgttgcagagccaaaaagttactgtgctatattcattatggtatccaaaattatctgaaaccaattacatctgctattgagaaaatttttcataattgctttgcctatattaccaagatttttcttccccataaaactctattatgttgatgtgaacatatatttgtgtctgtggaacttggtttttttgtttattctttggagagagagccattagaaatttataaatttaatggattctcctttttataaattcctagataggaaattactaaattactaaaaaattttcaggaaaattttttagtaatacacttttacatgtataaaggagggaattttattcctatgtatttagataaccaggtcattagtattagaattagcttacattatatagacacagaaacatttagtgtgtttcttattttacatgtcacatgagaaaaataatattgttttgataatattaattacaaaaaacttctgcatgtatctaggctttgttttatctcatttatattcacaaatctgtaaaagagagttgggcaaggttaccaggataacaagtaccagaatcaagtctaattctgctgatataattgctggcacacataaacactgtactaaaatggctctgttgtaaaagatttgccaaatgtgtattttatctttacatttgtagtatgtttatgcatttcattttttcattgtatcagtaatatttctaattttactaaaaaaggggctatgtacacagtagccatttagtacatttttagtttggtgcaaaagtcattgtggtttttgccatttttaataaaatacaaagaaaattattgcttaaaaaataatttcactttacattttcctccattgttagataaaaattatgcagtgaatttctattacattttatattattgggatgaagcacaattaaaattccagaatagagaaaaattaataaaaatattatcaaactttgttcaaatatacagaaagtgaaaagtatttaaaaatcacttttgtagtagtagagaaatgaaagcattcatgtggaatctattataatgtgtttccagtcaagcaaaaccagaattctcctcacgagagagtgtctagatcaaagaaactgcttctttcttcagtttcttaaccataaaattatctggaatacatttcaagctccctgtgttcatataaccttcccagtaggtttattttacctctgagcatctggttattggtcactgagaagaaactatttcctagaatctagggctagtcgctatgggggaatactcaacatacacaatagcaacatagattccctgttatacaatgaagaaataaggtagaggatctcttgtataaacaggtagaatgaaataattttaggtggctaagaggatcacaggcagagatgctgataattttaggttgccatagagacaattagcaggattgacacaattatactgttcaggcataagagtagaatgttggaagttatacagaaattaagggaactaacagaaatgtaggcaagattgaatgagatccgggtacataagcatcatggaggctgaatgaataatcacagcagcttaatgtaccatttaaaggggatattgattgtttagaattataaaaatataatgtaatataaataaaacattacaaaatatatgaccatatttagagttagttctaaattaaaattcaaagtaattgtgtagggtggtcattttctgatctgagaacctcctgataggtgagttgtggagaggaaggaacatcagaacatattcctatgcttctctagtgagatcggaaagattttagatagtattcaactccatgacattggcaactatacccagacatgcaaacttttgatgcaactatgagccatctttatggctaaataagttatagaggctttaaagtaaatatgtatgaactgaatttgtatttcctcaagacagaaaaaaactactattcctttagcaaaaattattctgcactgattattattttcaaataagtaaagcttaccatgtaagcaccatgtcctttaaattaatgttgaatattttgaaaatgatcctttacaaaatgaattgcaaatttttatttattttaaaaaactgatatttatcctaatttcagaatgactgacacacaatttcaatatatgtacacactctcctttaccttgtattccttctttgtggatgtcagaaatcagtttctaaccctccttctagttataccctacctttgaagatttcagtttactggaatctgaaaacaaaacaaaacaaaacagacagccatacttcttagatcttgtataaatgagcagtaaagaaggtctgagtgaagatttagcagaacttgccttttgccaacagaacttcatgtatctgactacaagtaaaagttggaaaatcatcactaaaactgtaacagaaattcaaggactaaattgaaagagaagttgaagtttatttatggtattctttccagagagattttatagagccttttttcagtctttcccaaccatgtttatttatgttaaattaaattattggagtttttttttagaattcttatagaatatatgactaaaatgaaggataataatataatttgacatttaaacagttttattgtgaaaatgaaaatgaatgttgttaatacttatgctaaaacagtaggcatgaaatgacactgtggctaaccagaagggacatatattcacaccacctaaatatgagacatgtttgttaaaagatcctccagatatctttttccagtgaaattaaaaaaaaattacttaatttatacactttcaaatattgtctttttttcacattcagctgctaagttatttgtttctagttccctaaaattggcacagagggaaacaaatagttaaaatcacatttatcccctattttttaccttatatttatataagaaagtcataaatctttctttagtccttagttcaaagattacttttagtcttcttttacaaataaaagcaatagtttggagagtgggaaatgagataggataactttcctctggttaaaaaaaaatctttgagactttgttgttcactttaatgcttcaaaatacttccaaggcgtctttgaaggtttaaaaaaggatttgtgaattttttatggaatgccacttagtaggtgtcaaaacatatttagcaggtggtatctaattttcattttaatgaagctaatcttttcagactaggataacataaggttttaccatctgtgtgtatcctatttagtttatccaggttggagaaatctgaaagaaggtctgtgaaacaagaagctagatgttgttcaacaccagccttaactacctgaaagcattactattttaaaaattaaaaaaatagagaatacaaattttagtatattagcctataattttatctaaattatatctttgtattcagattgaatgatcttttacagcattacttagaaaggctttacatgtaagacatcttaaaatctagctaagaattttctgaggagacacggtacaaatgtgtttcaagagccagagaattaaaaatatgttgcacttcttcacctttttctctcttgcagatcatcactaattatttccctgcacaatctttttttccagctttgcttccagcacatatttgaattttcctattgacttcttttccactgcttgcaagaaccttttcctttatggtcatatataaatttagtacatatttaaaaattttacgtaaaaggatcgtgccatatgtttgtcttttttatttttggaaataaaaaattatcattgcttttcaaaagtgacttcttaaatcttagctgcataagtaataaatacagctgtaaacattcactatgtactaaaatttaaaaagcattcagaatatcatgagctcagtgataatcaaaaacaaaactaaaaaagaaaaatacttcattgctcaaaataaaatgagatatatagaagaagataaggaagacaagaagggagaagtagaaaagaggttataggtaaaaaatggagagaggaggaggaagtcatcccacctttgcataaatgttgtagttgttgttgctttaagtattattataaggtagcacaaggggaataatgtgattggaattcaagagttagcattagtaaattggtcccaagtcagttcacaattggattgcaaaatatagtgaatttcaggaacttatttagaagaaatctaaaatttattagaaatgatgaagaactttgtgcagtaagagcatatatgtgccaagtatgttccagtaaagggcaattaagggtatatctgtcaattaaaggcatttatatttaaataacaaagctaaaaactgattatgcaaaagataaatttgttgaatacacgaaaaggataaggtttttaattttaaaatatcatttgcttttaaaaataattccttgattatttttaaagttttgctcaattggattcaattgatttaaaaaattaactttcttaatgaatggactaggaataaataaataaaacatgacaaaaattaaaagctgcttgaattgtgagtctatcaggtgcaaacttaaaacatctgtgagactattgtataaatttacagggaagcataatcccatcgacattcagttctataaatgcacaaacacatattccttcagaatgtcctccaaaatatatattaatatattatttaccatgcatacataatcattcatatatagtgtaggtagtatgaatcatggaaatttgaatttatgagtatgccaaatcatgtaggaaatgagacaagaacttatttaggtaaaaaaaaaaaaaaaaacaagttagaagaactgtgaccataatattgtccaattttgtgacctgaataaaaagaaaattagatttcttaaaatcaaatctagggacaatcttaatataagtatttaatagttgtcttacttttatacagatgcatagtttgaggaaataagatacattgtagatatgtatactacctgttttctttacatttttccttttttcttatttttatttgatgaagttattgattacatttcagagctttatatttatcatttgttcctttccttatattaataatcaaacatgtatctcctgtaatatttgaaagaaagagagaaagtatatcctgccctaccaaaactttgattctccagcagtttatatttgatctttggcaagatttctttagaatgttgttatttccttattctgctgcccattcctctccatagatttatccaagttcttttaggttgttttctctatttgttcctaagatttattcaaacaatttaatactttccttcaagataattaatagcttttactttatagactggctcttctatatttagaattattattcagcagaaataaaattccaaatggaagaagctcatattgagcattttaaataaatagtgtaggtaggtgatacaatctatgaatgttttgtttatttatttatttattattttgagacagagtcttgctctatagcccaagctggagtgcaatggcgtgatcttggctcactgcaacctctctgccttctgggttcatgcgattctcctgcctcagcctcccaagtagctggaattacagggacgcaccaccatgcccagttaacttttgtatatttagtagacacagggtttcaccatgttggccaggttggtcttgaactcctgatctcaggtgattcacacacctcagcctcccaaagtgctgggattacaggcgtgcgccattgcgcctggcctatgaatgtttttatacatccaaatttctttcttattcctgacaaataattgatattttaaattcaggattataggatttcagtcctgttctttcattaatatttttcccatgcaacttattattgtggttgaaaagttgacaacaattcgttctctgtcattttttggtctaattcatcggtcttgaagtgtgcaaggttttttctttgtaagtctcaggcattttactaggatttgcttacctgtgtttctttttttttaaatcttttatccagtaacttagtgacccctacctagctgtagttgccaatatcagcattgttttcacactttaaaaaattttttctttcataatttctatttttgtgcttcgttttgagatatttcctccacttgatctcccagcgcaatcattaagatgtcattagtgattcttctgttctcagtctatctacaaaagttaaattcttttaaaaaaaaacatatttttattcacattcctttgagaactaaatttttaaaatatcttctgtttaggtggacttaagtgaaatttctctgaattcccttgttgtttattcaggctggcatctgagttctctagcaagtctgtttcatttaaaataaatacaaatacttgtgtttttacttattattcctgtcttttgctgccattattttgcctcaccatacaccagtctgattgttggaatgctttatgttgctaagccctgaaattggtgggctgtctctggctttaaaagaataccaggtggtatgaaatctttgtccgccagaagccaggagtaatcctgcctgatacctgattttctcagttacaaagctagggcatttctagccttaggaatatgggtgaaacaatggtctagaagctcttccggggccataaaaaccactaggtcttttgggtgatggtttcttaagtgagtattgcatttaattaatcagagtctcccagtactattcaggttaccagagctccctttattttctaagattcattcatgttctgttctttgttgcttatctttacagctctggttctcattctttcattagggcccagagttacgtgctatttttctgaataccaatagaaaccttaggcttatttcagatgctctgccaacccctgaagattcttctctcaggaggggtgttggttaattgaatttgattaggagggaaggacaacaggaatgcattcgggaattctcaatgatttgttttcagaagtatactttaattgacagtaattactgtcagttgcagtaattgattgatacaggagtagccaactattgtgtggcaaggaataaagtgagtgctggccagagcatctgtgagggggcaggttatgccagtgggctcattttaccagcaattcaattccacattcgttgaacacttaaagtatgttctaggcactgtatcaagctggtccatgaaatgatattgtgaataaggcaaggatagtgctttcaatgtgcccacaaaacagggttggcacaggaggaatgaagggaatggagagcatgtcaactaatggggggtttcagctgtgtagtcttctccaagagaaatgcttacaaggtaaagcacaatgccacagcaccatctcattctgccttcttcctctaatgatcaaggcctgtaagctctttagtaacctctctgatgcaggtatcacttcaagcatcagtgaacaaatcatgccagcagcctccagccttaccctgtatgacctggttgcttagcactgccaacaagttcctactaggtcggagtgtactaattagtcacaatggaactgttatggatctatactgtcagtagtgtttaaagtttcttcttcctgcacttttaaaattatattccaaccaagaaatgattgtttacatatatttgagattgtgacgaatatgacaataaagacaaaatcatcagatgacatatgaaacagtttgatgattttgtttctggatataggcatagaatattttcatgaattaaatttttaaacttactttccttcttgaatcatggtaatgtaatattttctctcctttatatgacttctaagcagagtagcttaactaatatatgtatctgtttattaaaaaattcctttggaaattgttgtcaaattatgaattaattagtattccttttaaaaaaataaaagactaaaaaccaaattatgatagttaccacaaagtgagcaagtattttaatttttttaacatatatttctattgcagttttcaaaaatttcttttctattttataagttcaattaatgttagaaagaaaaacatcatctgcttacataaaaattacatgttaactaaaagctgtattaaaaagtgtaattcattaaaggtaatatcaattattctacaattattaggggctaaatgcaaattttcttgagaactgcagatgatttcaactctcggtaatgttgttgccacataaaatataaaatgagtaaagattttaagagtttattttgatgtttcaaggtagtttgattaaatataacataaatacatgcaactacatgatacattagaaagaaatgttctgagtaagaagtctggtctggaacatcgagggtatagtttttatgtaagtgtttttaaagtagaattaaattttgatacaaagatatgttgttatccacccagagttcttggaaatatattacagcagaaataatagtataattttgcaaataaaagcaatgaactaatgccatgtgatttcttttttttttttttttttttttttttttcctatacgaagtcttgctctgtcacccaggctagagtgcagtgcggcaatctcagctcactgcaacctccgcctcctgggttcaagcaaatctcttgccccagcctactgaatagctgggattataggcgcctgccaccacgcccagctgatttttgtatttttagtagagacggggtttcaccatgttagccaggctgatctcaaactgctgaccccatgatcagcccaccttagcttcccaaagtgctgggattacagacatgccatatgattttcaaaagcaaagataaaaaattaaggtttcttattacaggtggttttaaaatgagttccttgaaatgtggataccttgatcacagttttatgtaaacgctttctttctagaaatccagaaagcctgtactaattatgtacatgctatatagtatgtaacaacatgacaataaaaagatagtatcttccattctcattatagttagcaaaccctaaattttaaaaacaatatttctgcttgaatttcagagattgtaatattaaataagtttagtttctcctttctgttttctgattcttatgtaaaattagtttactaagctcattttagaattaagttatcaagatacagcatattggcattgaaaattaccccacctcaaagagagatacaatgaaatcatccaatccaatttagtttacactatggttctatccaaatcccttggtgtcatttccgttttttatgaggtttcctaaaaagatgtcccaatattatttgaagtatgtgattattgtgataatttgataatgtatcactaaattgtttccatgatccttatagctgtgcttctcaatccaatgcatcattcagttgtttgattaaatgccaatgctgtctgaaatgctgtctgatactgagtcccagaacagcatgatttccttcccactgaacatacataacactgtataattttacttttcttataacgcttatagttacaacttaatgccaggaattatttttcctactttataaagctagagtaaacctgaaggaaagtttttctacttaataaagtgcccagggatctctaacagatctattatagaataatcatgaatatttattgagcttaatgaggtagaggtatatagttaatgaagaactggaggagctcaagaagagtaaacctctctccccaatctcaaaataataacagttagattgaaaatataagaaataaaagtatgaaaatagcaataaaaatttatatatcatttcaagaccaaaaatgtgtagtacattattaattgtcaactacgtaaagcagaccataattgatggatgacttcatagaaaagaaaaatcacattagggtgctgatgttgagaaaggatttttatagaaattggaaaagtaattttgatgaatgagtaaaatttccatacccagaagagaggagaaaagggttttctttgtgtatggaataatgtaagcaaagtcatagaggtgtgattctaagagaaatcacatgagatgagattctaagagaaaagacatgagaatgggagaaaaacccaaattcctagaggcctctgtgtggtagggaatattacatgtcaggactgtgtgctacctaagcaagttggaaaataggattcagggtggtggtgataaggagacagctgtagaaaaaatgatcaaatctacagactctttgcaggaatatgttgagattgactccagaagagaatggaccaattgtatttggagttcctgtacctaataaacaacataattttctcatgccgaaggaagttaataggaaatctttttctttcatatgttttggtgcagttgttgagataatttttatcactaataaggttcagcctcttcaactagaaaagcacaactcttcctgatatgcttagggatagatcatgaatatttggcaggcagtttgataaaactcttataaaaaaacagataggttcctaaaataatcacactggctggcatccaagatttcattaaaatcgtaccttttctatcttgcttttaaactgaaatttattttgttatcaaagagaaaacatttcattttgggatatcaaaactttaggtgcatctacatgagccaataatattcagaatttttttccaatataaatatttatactagaaaataaaattgtacttgttttgtaccagaatacaagtcaaactaataataatgggtccaaatattgcaagaaacattttattaattaaaccgtcgaatcatttaaaagagaaaatgtaacttaagatggtgcgaagatggcatcaagtagtagagttaatctacaaaacttgagagcttttacactacataaaccatagtggctttttgaatagcctcataaaacgcagtgtcattgccattctgctcacaacatgtggattctctcttctgcaaatagaataggactcttggagcaatcataatgtaagcccactgaattttctcatttattttctgtacttataaagaatgctgtccataactttttatttttaatggcctggattaaatggcaactttctactgctgacaaaaaggcaaaatcctatgaagaagtcagagtcatatcaagtgctcctaaattataatatagatcttttccctatttttcttctttcttccttcttcctttctttttgcaagttaacatatataaaacacctgttcttattcttaagcatgcacagcatagtgataaaattttgcacagtcaatggtcatgatgcccacgggttagtgttgtaatagataagtgaatttaatgccacatgtgccctttgttagagtctggaaaacagtatgttaggggagtggaggagagggagttgtgaggtgacaaggaaagcttacaagaaagacattgctttaatctgttattgcagatgttaatcagagaagacagtagggataaagtggaagacccagaggacaggactacttggcaggcattctaaatttttgttgaatatatcttttagtgcaatgtatatctttaatcctcagcagagctttatattgatatacacttctaaataagtattgttcacaaaagaagagtgtcaataagttatatattctaccaccatttcctgaaatctctttttatatttgagatcaagaattatagaagctggcatttattatattgagcaataaagatacttcaatcaacattaaatgaaagtaggtatagattaagaatggcagttcttctgcatttgcatattgactaagcacatgaaaatgtatatattgaattcatggactattttaaaattaaggaaacactttggagctttatatagtgataatttgggcaatttagtgtagtagtaactgaattctagaagtacatgtggccaagattcaagggatacaaaatatagcatgcagtaaaaaaaggaaaatcaactgtaggcaaccagcttgatgccagaatgtggtggtgggattctaaatgattctgtgataaatgagttgagctgctttctaggaaattggagaggagaacaacaatagctttctggacagaactttaagtgactatgtgacacaatatctgtatggtcattcaaagtgtcatggatgcataaaacaggttgtattaagtacaattttaagcaaatgtgaaagagggaagctgtttttagaaaagaaatatataataacattttattggcatgagcaaaataatcagaagaaacattgatggccagttgattatattgggaaaagtttgtcatgactatgaagagtactgaatcttgttgaatgtctgagcacatgacagcttgaaaattgtcttttttttattagattaagagaaaatgattttctggcatgtattctcactgtatcccttacctatatacgataatacatttctatccttttcttcttgctttgctgaaggcagttattaggaattggagaatacagagcattcaggtattcccaaataatatacattcacctcctttgagacaataggttgatgtggtatgtgtcttcctatttctactcaggatataacagaaacaaaaaggtagcaattggcgtcatcagtttctgaaaaaaatctttcattttttctaatatgtcttttatttatcttcttcatcttgttctctatttctctgtcagcctcctgtgcttctactgctaaatggattatttcctctaatactttagcatccctgcctcctgctcaggctatgtcactttccctccctaatttcactgcaaatctctttgaaaaaaagcagtctactttcactatctctattcttcactgtcaattcatgtgttaatttattacaatctggcttccttctatccccagcattttgatgattctattctgtcagaatattgtgaggttaatgtttttgatagctttacatgcagtatttcacttcagtcccctttgaagagtgtcatatatttcctgcagggatatttctttgaaactacagagcatatcacagctccttctaagatgatacaccacttggatgtcctgaaaaaatctcaaactcaagacattgaaaatgaaaaattatattatttcccactgcctactccactgctactaatgtgctttctcgtgtataattgtgtgtgtgtgtgtgtgtgtgtgtttgtgtgtatgaagggcatcactgtttacttggtcctcaatataaaacctttggaatcctctccctttcactattcctcataacccctatgtagttaatttctgagtccagttttttttaattgaataaaaatttaaaaaataaaaaatcagtacaagagctacttctgtaaaaactctcaatattgtccttatttttatctatcttagcagtgagtacttaatatctttttttcagtttttccttcttcctttcctcttttacctgatgcaatagctttataacagtgcttcttgcctcagttgcttcctggcaaacaacatataacactcttggaatgtgagtctcaggtttccaacttcatctcaagtcattcttcaaggtattctagtatgtgctaaattcacacagcattagtgccatgtttgtagcaagccctttcatatggtccatgctttgggctgtgtagcctctattatgtagaatacccttccctggctttactgcattgtaaattccttcacagcacagtacaaaaaatccacttctttcataaattatttctgtcttaggcagaaatattctattttatttattttagtagcactttttgcagcatcatattttactggaaggtccttatgtttctgaaactcaaaatagactatttttcctaggaacagtatttatatcttattctttttgtaaacacagtttttgaaaaagtgtctggtacatagtaggaattcagaaacagttgttgtataaagtactttcattatagcacttattgcattccatttattgattcaattaacacatattcattgaaaaccttctacataccactcatactacaactgtgagtggtatgtagttctagtgcttaaggtatggcagtaaatacttgataggacatattctatcggtaaatactgataggacatattctagaaggggataagggaagaaataagtactatgaagaaatcaacgaatggtatattttgaacactgacagatctaagtgttattttaggaagggaggtcatggaggcccttactgaggaagtggcattcagttgagacctgtacaatataaaggagcaaagatctaggagaagacactgagaaagagcaggcacaaaagccggaagggagacataagtataccatgttgtaggaatggcaagaagacttggtgtttggagaagaggaaagaaaagttctagaagatggtgcgagagagttggatcttgtaagtctgagtaaggaggttggatttcattctaagcaagatgggagaactttgggagatcttgagcagggaatggcagacaatactttttttaaaggatgcctgagagaggaaagagtttaagtggagagaacagttaggaggctaataaaatccccagttgaaataactgtggtttgtaccaaggtagttgctgtagaggtgttgagcagtagttagatccaggatccattttgaagatgtattacataaaaataactcaggaggcttagacgggaggcacacttgagcccaggagtttgaggttatagtgagctatgattgcaccactgcactatagcctgggcgacagagtgagaccctgtctgttaaaaaacaaacaaacaaacaaaccaaaaaagaaagaaagaactgatagattggatttggagttgaacataaaagaggagtcaagaataattactgtgtttataacatgagcaataatataaatgacgatattattaaaaatggacaaaacttcagaaaaaaacataaccattagtttacttgtttgtatctccaatagaatatgaactcagtgaaggcagggctcttggcttattcttctttgtatctttaatacagtgcttagcagaagtagacacttaataaaaagtgatcatctctggatcttaatcagcaaacaactattggcactattctcactttttaaaaaattatctttccttcattcactcaactgatgttattgagtacctactaaatgcactgaggcaaaaaggatatattaatgaataaaacagacataaatgcttgttctcatggaacctatgggtttataatccagtgagatgatttctatgatataaaactaaataaaatatagagtgtattagattgtgataagtgcttcagaaaagttaagtagaaaaaggacattgaggtagagtagtggcattgcaaattaatagagtggttgaaaagggcatttctttggttaatacctttatgaaatgagactttgagataattaagtatttgagtaaagagcattgtggctcaaggaaacagcatgcacagaagctctgagatagcagcatgctcggtatattgtaggaacaccaaaagcccagtgttgccagatcatactttaaaaaatagagcagaaaaatgtgcattccaagggataagggaaggccaaattatgaaaagccatgttggctactgtgaggattttgacttttactctgagaaaaatgggaagacaactagagtttttcagcaggctaatgtcatattctgacatatactttcacagaattcctctggatactgcgttaataagagactgtattgggttggaagggttgaggggacagaaataagcaaaacaacagctacaataatctgagagggtggatgcccagtccaaggtggtaatagtgaatgatagtaactatggtttaactgtggatatatcttgaagtcagaatctatagaactttctgataggttgatttggggcaagagagaaaaaaagcatataaggttttggatctgaaccagtacaatggatttgtcatttactgagatggagaaatcaatgaggaagatgaggagctcgtatttgaatttgaacctattgaatttgagatatccattagacatctgattatagacagcacagaggagttttccacataaccctgaaatacacattgcaggctaagaagtgtccaggctagaggtatgaatttaggagtaatcaaattttagctatttttcaagtcgaaagactgggtatagtcatcaagggtttgatagaagcaaactctagggaagttcaaagttaagaaatagtgggttgtgaggaaaggagaggggaagatggagagagggtgagtacaaagttacaattagatacgaagaatacactctagtgttctattgcacagtagggtgactatggttaacaataagtcatagtatgttacgaaatacgtaggaaagagtttggatatccaaactacaaataaatgataaattcatgaggtaatggatacccggattaccctgaattgatcattagaaagcatatatacgtattaaaacatcaagccatatcccataaatatgtacaattacaatgtgtcaattaaaaaaaaaaaaacagtggcaataagaaggaatccagtaaagagtgtgctttctaaaacaaaaaccaggagcgtgatgtcttagaagtcaagtaaataacatacttaaatatggataaagtgagtaaatatgtagaatactgagagtttggcttaccataagatttattgtctgttttagtccttcctgtattgctataaacacatacctgaggctgggttatttacaaagaaaaatggtttaatttggctcattgttctgtaggctgtacaggaagcataatgctgacatatccttagcttctaggcaggccttagggagcttacaatcatggcagaaggtgaagagggagccaacacatcacatggcaagagtgggagcaagagagaagtggaggaggttctaagcccactttaacaactagatcacacataaactaccagagtgagaacacacttatcaccaaggggatggcactaatccgttcatgaagaatctgcccccatgatccaaatacctcccaccaggtccaccgccaacactgggaatcacattttaacatgagatttagaggagacaaacatccaaatcatattatcatccaatctggtacacttctgaaaatgaaaggggtcactattagttacatctaaactataaatacaaactggtactctttcaggaaacctggaatatatagtcaccaagtgacatttcaagtatgatgaagactgataaataatcgttgcattcagcactgtagagatcttgattaccttaagaattaaaatattgttaaaatattaggattaaaagtctagttgaatcagttcaagagaggaaggaaattggagatagtaggaacaagcaaatcaatgaaagttttgctataaaaattaagtggagctgaaggaggttgtggggaaaagatgtttggttttaattgaaataaaatacacataatgtaaaattttctagtttaatgattttaactatgtgtggtagagtgacattaattgtatttttgtgcagcaatcactaccatccctctctagagactttttattttaatgaactgaagctctgtacccattatatataatacctcagtctcccatcccctcaactcctgacattcaccattctacatcccatgtccatgaatttatccaagacaatgaccattctatttttttttttcttatgtaaggtactgtaggtactttactcactgtggatacctcatacaagtggaatcatgtagtatttgtcctttgcaattggcttatttcacttagcatagtatcttcaaggttcatttatgctgtagcatgtttcagaatactcttgcttctaaggctgaataatatttcattgtatgtgttataacatattttacttaccatttatctgtctatagacatctgtgtggctttcaccttttggccgttatgaataatgctgctctaagcatggttgtataaatattcattcatgtgagttcattcaagtctctccttttaattcttttggatatatacgattattttaagacaaaagaaattctaaaacatagtaagctttctctatgtctgtcagccagtaaagaatctggaaaagagatgaattatttgtcactatgtccagcaaatagctccagatatcatttaggaaggaaaattacaaacttaaatgacaatgagcctttataaatgctttaactaaattaatattttggggtcctaggtaggtagaggtatacactatgattaataataaagcatatttattgtctattcaaagttctgtttcattgcttggtgcctacaccttagttctgtgtgttttcagaatctaccttaatagatattttagcttatatctcaactggcaaatcatatcctgttagaagtaagaatgggatagttttatttgtataaccactaaagattgaccctgagaacgtaattatatagttattctttttactctgcctcttttttagttggctgtaatatttttgaaaaagtatcattttaatagatgtgtattgtggttgagtcttaaagttttaacttactttgaattgagtgagacattgagtgaacacacatttgtgaatatatcataaaacataagtacaagattaacatatagaatggctcctagagaatactttagcaaatagtgtaaacagcacatttgcaagatttttatagcaatgacaaccttcctaaactggtgtgtactgtattcgtgtatatggatttgtatcattgttaattgctgtgatctttgtcaataaaagctgactctttcttaattaacctattgcccctatcttaccaatagcatcagttagacattacaacattattattcaatacagtggaacacattttgtcacaggattctggcaccttgaaattgatcagtacaagcaggtttactagagaatgaaaaattttggccaagcttctgtttctatcacacaccatgttctgcttaattctgggaactctatgcacattgacaggagaaagtttgagttcctggagtattgcacgttcttgtttcaaaggtttcaaagtctttgcacacagggccacctttactcaaaaataattcctcctctttgcctctatttcaatggtgaatttcacaaagaagtatttttttgactgtatcctaagttagctccctcttatacaatatcatagcacaatgtagcactctttcctagtacttattatcattgtaactttacattttttgtatggtgatttcactaacctctgcttcacctacaaaactgtcagcaccatatgggtagagatcctgcctgctttcactcaatgctgcgtccctcttccttgcatagtgctggatactgtagtctgtactcagaaatatttattgaatgagttgaagggtaaataaatgaatgaatgattgataaagatctataaaggaaaactattttgaaatatattttatgtgagtttaatgtactgtgtagacctctaattagaaagcatagcatagaacttggttaccagtttcttcaggattttgaagacgaattgaacaataaaaagttaagagctgatatcaaggacctaagctgtattttcatttcatcaccttgaattgaaactttggaactgtgggacatggaaggaccaacaatgggcaggcatttctcaggggaagactataaataaaaaacatgaaaagggtttgttgtttctttactaaactgcttatatgagccaactgatgagttctgttttacccataacagccttaatttcacatagacagcattatattattgatccacatattttattgtattctgaatctgtcatgttcaacccttatgtataactgtaatttgatagtacagcttattttataaatcactttataatcactttgacagcacaagttactttataatcccaataaacttgagatatatgaaagtttattgaatttattattgatagtgtgaataagaaatcatttagcacttctatgactcaggtactgatttaggtaatttacatacatttttagtttttaagatattttacatttcattttcaactaaatgaaaagaaagtctgctatttccataggctgtgaaaatctaatgttactatactcagtcaagtttaaatagatatactgttactaccactgctagctgatgtgtcctcactgacttcacaagttttcacaatgaagaatgatcatataaaatcttagatctttctatgaagaattacacttctatagcaattggtatccatatagactatgtgacaaaaaggacagaagtggccactggtcatttccacataatacacatgttaaaactgtactttgctctatggctgctgctgctgctatttgtaaaactcagctctgcttgaatccctgcctcatagtcacaaagcctgccagactcctttgatcacaaagttaccccatgcctgcagccatgctctaagttggtctgtctgtttctcttctttctaagcagtgatattagaggttgtggctcagtatgtgtataaagtatttcttcttcttacctttttgcaattgccctatatcaggtctccatccagcagcggattggattagtgattctccacaattgccctcaactatgcagaaataccaagctgagggaagtgcagtttcttcttgacatagtcgatacatataatgttgttatatttttatattgacgtgatgacttagtataaattatacttcatttgtagtttttaatttcatttctgattccactatgagaatgaggaaaaattgctaagctatattaaaattctgttgttcaccattttttatttctgttcctacatagaattcaccattgaaatccaattaacacaagtctttaataaactgtgatcactgtagtgcccgtcaccttgtttcttaaaactaatcttctaattaaactatcaactaaaatagacaacataaaagacaataaattatttccattgaattataaaagattatattgaataactatatgtttttcctctgggatctattttttcacttgttaatttattacaaagaggttggatttcagctcagaagaatctcatttcctggcaattataataagagagtattccaaccaatcaagaagtccagtgattttattaataatgggtttatcctatgtgactagttcagaggccatcagataactttcgaaagttttatatttgttctggataaaatctaccttgggtattgtagaagtatattcacacaaatggtacagctgctacaatcttgttatttatgtgatatttattgagtacctactaacggttgagctttgttttaaataattggatacattctgtgattaacagagaaaaaaagaatattgttcttttgtttgtcgatgttacctacattttgtgactttctacgaaggcaaattattctgacactagtttctcacttcatttgtcagaatgattaacatttttacatagaaagtagatttttttaaaaaattgatagtcaggctcatatggagagtcctgcagaccccaaaccactcaatgttgccttccttaaaccatgttactttatgtttttgctagaaaattatcgttctgtcagatacatgtaaaagaaaagtcacacaaggcttgtagttgggatctttctgttctttataactcaaatattttgtttgaaaattatgtggaggaatgcttaacgtatgctgcagagaatcaactcaactagccctaaagggaaagactggctagtacattttgctttgttaaactttatttgatggtaagatgcagttttgctataacttttgaccttttggtttataatgtcattcatgttgtatatatcctttattctataacaattctttgaattctaggagtaactttgtaggcaatcaaatacttaaaataaccaacaacttctttactataacatcattaaaataaaccacatttaatagtaggcaatcaatgatgttcagctttgacccagagttgacccatcttctctagtaatagcaaccctatcgtttcaaattacaatcagttcacaaaatcattttaatgatatcagattggaagaaagccctgtgtggtttgacagctgtgctctatatttaagctcagataaggctcactttaaagcagcatgtctttgtagtcatgtagctccttaatgctgtgacacgtctgtgattctgtgcatcaatcatggcggcagaaaaccataaccttccctaagaggaggtgccaggcaaacaggcaacgagatgagtgttgccatgtttcggttactgtgcaggcttcctgcagtgtaaattcccaatgtcccttcttagctcccactggctctcgacactctcatcttctttataccctttccaggaatacagtctgctcttcttcgttaggttgtgatggtaggtagtagattctttgcctaattactttctttctatggattttattatttataaaaatataatcatagctctgttttcattttaaggatgtgactaataagcaccattaacaaggtggtaagaaatcatacagagagataaaaagagaaacttataaacatatctgggatagttacatattttgaagacttttttcacttcttatagtattgctctttgcttgtataataatgaccaatttgccacgtactggatgccctcgtaggcttacccagcttttcaatcataaagtcagaattcaaaccctactcataataagatcgttcagcaagacggctcctactctttgtagcaaatagtcccaaaggtaaatttaaagtgaaacaacaggaaagaaattagttcctcccatttttttagtcatttgttcatttgctttatttattcaaacactccttcatttttcactcatgatagaatatttcataatgttatctttcatcatatttattgagagctggtaaacaaaaatgaaagtgttcatacctttgaggatataatgatactttgtaagcaaaagtcttggaaagcttctcatattttagatattattctgttaatttgtgtgtgtgaatgtgtatgttgttaaaaaatattaaatatctttcaactatattggcctcatatcttctgtttccttttaacgtatatgaacaaggtcagtcataaatagttgaaccaaaaaatgagtagtacttgggtttaattcagaagactgtgccttcagtcagctacatgaggtagtagtttttaccataacattttccagagttaaaatagtcaatttttaaaaatttctggaagtatatgaaaagtacttttaaggaaatgttccaaatattaatacatctcacttggttttccagtattgagtgccactatgtggagacccacattttgtgtccatatctataaatcactttatcagcttttgaggtctatcaaagatgaacaatattttcagataggcaaaaacaaacaaacaaacaaaaaaccaaaaaaacccactgtattgtaatgcaataacaagattttataagtaacttctagaggtaaagtgttttctcatcaaatgaagaaatgaacttctaaacttatatcaagtagctgaacaataactacttttccccacccataccccatttctacaatcttataatgagtgtgtctgtgcctcccatcttctctctctttctctctcccttttcttctcctactcttcatccccctttttttttctttctctgttatttttttcagagcagatttaggctcttcagtggattctttgcctgataattctccaaattaggagttaaggtaaaggttagctcaacaggcttattgctactataaattaaatcctggccctgccaagatacaaaagctcagaatatacctgcaccaagatccaatttgcttttcacagatttaaaccttacaaggaaaagccttaagttagtgcatttggttgagcactgaagctggttactggtgaaagttaaaagaagtttaaaaatgagaaagacaaatactgcatcattccacttatatgaggtatccaaagtagtaaaatatgtagagagagacagtcaaatggtggatgccagaggattgtgggaggaggaaatggaggattatttaatgggtatagagtttcagttttgcaagatagaaaagttctggaaatttttttttcacaacaatgggaatacacttgaaactattgaactgtacatttaaaagtagttaaagtgtaatttaccacagttaaaaataaagtaaaataaataaatacataaaaggtattgacctttaagaaatagtttattccttttaaatgcagtcatttactagaatattacatggaatctcttcaattatcttcctttttctgaaaatagacaagctgtaccattctttgaagcaaagtattataaactatcttgccacatagtttatcacaagtgatcagttttgaaataaatagcctattgggataaaacatcacatttactttaatccatatgaaatggttgatactggataattttctgacacagagttttgaccaatgtaagaaaaacagaattccagaaccccaaattgaagacaaactatgatagtatgtcatagctggggtgaggaataagggaaataaatatgcatattgaaatacatgtatcaaatttaacctttatttagcttggtttagttataattttaattatttattcaaataatactcaatggcagcataggatggcatgaatttttaaaaaattatcaagcccaaacctgagaagcatttgcctaaaagtcactaaagaaaaaagtcatttaattcataattttgctaagggaggaattctacccataagttattgtgaagaacaaatgagatatgccattagtaattagatatttacctgctataatatctaaaaattaccctacctagaagaaatgtaaagttttctttatttcaaagttctcagaatctaagtactaaaaagtaattcacctagaaaacgtaattttatgtgcaactacacaggcacataaaggccatagtcctaataccatgaattagagctcttgtactgaatccctctgggtcttcagagaaccataactaataggatatgcatatatatatcttatatatgagattatatatatatatgtatgtatatataagagcgagagagagattgctttattataggaaattggtttacatatttataaaaaagaataagtcccaagatctccatttagcaagctgagacccaggagaaccaatggtgtagtggtttcagtctgagtccaaaggcctgagaataaggagagctgatggtttaagttacagttttaacctgagtttgaatacaggagaaaactgatgtcgaggctcaaatagagtctaggcagaaaaagtgaattctctcttactcagtcctttggataaggtccacccatattggggggcggaatttgcttttctcagtctaccgattcaaatgttaatctcatctagaaacaccctcacagacattcccagaatagtgtttaaccaagtatctaggcactccatgaccctttcagtttgacacaaaaaagtaacctttacaagtccaccctttgtcaacttggcacccatatgcaactccttaagtcatacttaatctccaaatgaaggaaataagaagttcataatttttcctaatatgatacagctatcctgtgtacagttgaaaatgtactaaacccttccccagaagaggaagtagagttcttgattaatgtttactcttcttcaggataatgtaatattaataatacttaaatattagaatatgaagtcaacataccttatgttacatgatgaggaaataagagaaggaagaaaacaaagatattttctatacacatgaacatattgataaaaaaaaacaaggaatatgtatgacaatgacagtcctcatttttgtaactgttcacatgggcatagctggtgtttataactaccttcttccactgccaattttgtattctctttgccttcagcaagcatctctgctgattgtgtttctttaccaggtggagtgacctaagccctgcctggatgaggttgctctagttttccattgatcttaatcacagggaatggtatgctaataggcgccctaaagatctcctacagatgcactctttcttacctccattggggagtgctattccaattcccccttggtagtcaggatcaatcatgctaagctggaacagtgactcttttccctgatggctaattcagatgcgtgaggagctcaaagtggccaggtggcagtcttaacttccagttcaatggcatcattgtgtctcaatcaacatagaagcattcctccctttgtaactaagatctctaggccagcagaggataaggtcatagggacaggaaacagaaacttagaaatttggattgtggatcactagaggaaatagtgaatgatgccacttccattttgccctgagctgagaaaaaaaggaaacataacagttattgagttatgagccattataacaattaccgttcataagtaataacaatttcactgttttcagaacattatataatatttttagaacaaaaactacctcaataaataaatttattgagtttaatatttaaaataagaaattccagttatcacaaaagtgatctccctaaccagtagtaatcagcatatcatttgcaaagaattcaggtgcaaatataaacatttaaaaaaattccttaatactacacttcttattactattgaaatttcacagttgtcttagaagtaaataattcttgacacatgatttatctatgttatgcaagttttattatataacaaacaagtataaaaactaaaaatcataaaaatataaaagaaagtcatatttcagatttgctacattttaatagtatcgacaatttatttaaaagatttgctaaaataaatgagttattaaatgctcaggattcactatttactgagcattactaaacatttactaaacatttaattcactgagctattattgtccttatctctgttgcatagaattcctttattcacagagaatcatttattgaatacattctatttgacaaatattatataaattggcaagaaatccaaatttaggcaaatttttcctggaggaaatggtgcctgagcttatcttaaatgataaaccagcatgataagagtgacgaatcatgttggttaataaaatttcttgcagagggggcattataagaaaagacatgtgagaatcagcatggaatagttgtgtgagtgtatatggccggcagtacaaatggcttagtctcctggaaagataagaattgagagagcagaggcatataatagatggtgcagcattttgtaaaatatatttttgagttaattcatttaataatacatgtagtcatttattattatgtacccagcactcttctaagtgcttgggaaatagtaaacaacaaatcaagattccatccctcgtggagcctatattgtacaacattagaaactaactagtgcttttgggggaaattgaataagataaagataatccactgtggggcagatagagtaggggctggtggcagtattaaggaggagcataggagtagagataatagagaaggtgatatatgagcgaattcctgaagaagatgagggagatagccaggcagatatttgggagaagagcattccagacacaggaaagagatagaacacatattctaaggttaaattgtgccttgcaatgtcaggctgaaggaacaataaggaggcaggggtcactccattatagtaaacagggaaaaaaaataacaggaaagcagtacaaaagatgaacagagagcaagacgatgcagggcgttataagccattgtgacaacttacacatttactctgagtcaaacagaaaatcactggagggtttttcagcagaggaagcaggatctgagatctgacttaggctttaaaactgtcattccagctgctgagatgtgactaaatttcacaaagtgcaaaggtggaagtaggaaccctcctaatgaagctattgacttaatcatctctagctgatagttgctccagcaacgctgctagtagtggaagtggtgagtagtcaagttatttatatgactgttaggtagagcctgaaggattttctcatggattggatgtaggatcagagcaagagcagtagtcaaagataacttcaagttttggggttgggaaaattgagaggaaggaatgcttctcaaatgagattggcaaggcaatgacaggacaggtttgctgagaaatgtgaggagttcattattggacatagaaagttgatgatgtttactaaaaaatcaaatagagacaaaaaacgagtaattagatattcagaaatttgcatggccccttaagcagtggaaagcctctgcaaggttttaagtttggaggaattatagccaattgtatgctgtagtttagtgctctctggtgataaataaaggagatagttctgaaagaataaaagactgagctaagggagaacagttaatagttttgtatagcaagataatttcaacaaataaacactgagtggtggcaaagatgggtaagaataggatgacttgagaaatactttacaagtaaaaatcatcatggccatgattgtgagtccaagagagagggaaaagtaaaatagttttctaaattgattgacttgttaaatgtaaatgtcattatctgaaatcaagagtgcagataaaaagcatatttaggtggaagatatttttgacttgtttcaatttcagctcatatggaatattcagatggaggcaaccagtagacagttgtaaatattagagtaaaattctggggacaggtccaagcagagcatataagttaaggcaaaaattagattaattttaaagttgaaaccatgagatcagatgtgagcatgtttgagagtaaaacatggaatattcccaagatatccaaatgaatgcaaccacttaaaatttaggtaaaggaagagagacatgtgaaagaaattatagactggttatagcaaggaaagtcatgagtcactggtaaaggaataaaaatttcaaaaataatatgatccactatgttctttgcacacagtcactctgtaagataaagactgtaaaagtatgctagaaatgagatcttggtgatagttgtgatagcaggttcagcagagggacgcaggtggaagtagaaggacacagaagtgggctgtgtacagagtcaggtgacaacaggggctcagagagtgggagtgaaaacagggcctacacttccaagaggttctaacaagaagggaagggataaggtggaactgtagctttggttgtgggcaaagagagaattacattatcctctaagagtatcatgtctccctcattactgggaggaaggaatataggaaacaggacaattggagcaaagtcccatagaaggtaagatgtgcttaaaggggaattttactttactgttaacagcatagatgttgatgaggaagaacaatccttcagataaatgtataggggttaagaggaagaaagtcaaggaaaactatgttttttgaccacgaactttttgatggagccctaagagttgtctttattggtaaacaagggttgagtacaaacttgaaatacttgcagaagaaaatagaagtaaatcctagacttagggagtcaaaaggattaatgggtatattaatttccttttgctactgcaaaatttaacataaatgtaatgactttaacaaacactgctttattactttacaggtctataggtcagaagtctaacatgggtatcagtagctgaaattaaggtgtcagcaggcctatatatctttctgctctaggatttccttgtctttttttttttttttttttttttgtttaccatctagaggctgtcttttttccttggttatgacttctcatatactcactgtcaccaatggtcagttgagccttcctcacaccacaatgcactgaccatgactcttttgtctctctcttccacattgaaaggatcctggtaattacattggacctccccgaaaaatccagggtactttccctatcttaaagtcaacttgttaacaaacttaattccgtctactttcttagtttcctgtgccatgtaacctaacatattcacagtgggctgtgtacagagtcaggtgacaacaggggctcagagagtgggagtgaaaacctaatatattcacattttccaggaattaggaggtagataccttctggaaactgatatctttgggaaaccaatgtcttgcctatgacaatggctgatgttgagggtcaagctgaatttagatacagtgaatggaaattatacgaatttgtacagggacatttacagagcacaataaaggaatataaacccttggttttagcatggattcagggttcaaacttgtggttttcatggaagaataggaatacagatgaataatgtgataatgagagagtattttttatactctctcagtataaaagaaaaccaaagtgtccagactcatttgcaaaagaaaaggctgatcagttgcagagagtggctgtgaggtgggaaatggaggaatcaaagaactggtggaaccaatgagatggaaaaatagctactatatatttaagaaagtaaaagaaccaaaagagaatattcagagaataggacatttgaatataaaaatcttagagtcagattggtactcggtgaaaaaaaaacaaaaacaaaaagaggacataagcgttagaataagtggttaaagaacagtggaaatgatgatcattgaagtggaggcagtcaagcatttgttaagttatggtgtcaaatggaccttacataccctaaaatcacctagggtgatggctgaccttgcagtagcaagaccatgagactcatctgtcctaaatcactgagggagaactgtcaggaaagtagtcaaatatggaggtactcacagtggaggtacagatggcatgagaaaaaagaagcagagatttatacttgaatctagaaaagaaactatctggaagcagctttagaaaaacagaagaagcctccctctacctcctgacactggagtctgtaagaggaatgagaataaagaaccatttcctagagatgagtgcagaggaaattttgggttgagccaggttttatttaaggcacaaaaatgatgacacggcaccataagcaggtgaagatgcagagacatttgtttaaccatagaggagcacttaaatggcacagtggaaagttttgcaagggagagtagcatttggagccagagagaggaattgtagagcagtattctatgctggtgagaacgcaagagaagttaaagggctctaagttattgaacttttaaatgacaacaaaggatagaagtgataagttttcacaaagaacgctctctatatatttatactaccacggatgaaaacagaggttctatggtttgtaggaagctgatcaagttaagagtagatggtatcatttatagatactacagcaagctcaggaacaagtctcaaatagatgggtcatctctaaaaaggaagaagggaaaaagggaggcaaggaagtaaagatggaaggatggaaggaaagaaggaaggagtcaaggaattaaaaagagagaaatagaagaaaattcattagattttttcccagtgctataatgatagtaaatttgtcctagaatactatcaacacagcccctgatattatcctttatttttcaggatggcattaaaaaccaaaaattttgatagttgcattttttgtttgttttgtttttgagatggagttttgctattgttgcccaggcaggagtgcaatggagcgatctcggctcactgcaacctccacctcccaggttcaagggattcacctgcctcagtctcccaagtagctgggattataggtgcccacaacatgccaggctaattttttgtatttttagtagagccagggtttcaccatgttggccaggctagtcttgaactcctgcccatatgtgatccacttacctcagcttcccaaagtgctgggattacaggcatgagccactgcacccagccaatggttgcatttttaaatattaaaatgtaagccttaagttaggtcaattctgcattaaaataaacacctatctaattggccacatgcacacacacacacacacacaaacacacgcacagtcttcctgaaccataagtcataggtttgacttatgatttttcaatgttatgatggaggaaatgtgaaatatattcagtactctccttgacttactatggggttatccctgcataagttcattataagttgaaaatattgtgtttgatgaatttatcatcatgtagccccattataagtcaaggagcatctatatagatataaaatgtttttatctttagagatctctatttttaaattggcattgttttggttttgctaggtgagtgtttgttaacatcaagggatgaggatacgtttgactgagaaaaaaaaaactcacaatgttagtaaggtcctgctttgaagaatggcatgaaatagtggcataactgttgtgtacctctttgtctagttacagtctatcactcctaatggaatctccatgcatttagtacaacaaaagagagaagtaagattttataacctcttacaatttgaataaatgattctgattacattactacactagaaatgtaaactgagcaagaaaatgattttaaaattgatttcttcagttttggaaagtgaatttgaaattatcaaggctactactttatacatatctgcacccagtgtatgttttaaaatgataatggtctgccatttaatctgtgttatatatatgtaactcaaaagggtttggacatactcaaaaatatcttttagctctatgtgggaagaagtagcaggaaaagggagatacagtattacaaattataatgggagatatagtcatctgagatactaaaatagctgaagcattaaatgaatatttccaaatacatttacaacagagaacatttatgactatctattctatatcagaatcactatggcaaaggtaataagacagaaaaaattcaagtgtgaatttttctcacttagtgtgttagtagcataagacaaacctccaaaaatgtataagttaaagtgcaattcctttaacatttcatgagggattgaaaatgagagtgtaacatttgtttataaagccaacctgcaacctcaaactttactaaataatattattcagaaaacatttttccattttatgtgaacatagcattattgcttcctaacaacatagttattgatcacaataattcattacagggtccaggttacagtgctccattcttattactttgcttttattttactgtaaatagtgacagtaataatgctaaagataaaaacaatgatatttttgacacataatttgaatcactgaattttacagcttgcaaaatatggagaaattggttgaattggccttttctggtaagttagtatgagaagtaaaacttgagatagcatcatcaaaattactcttcttaaaacacagcttaggtggttcatgatttcttttaaacaataaagaaactgatcagttaactggaaaagataacaaaataagtgtatgtacaagcaggcttggcctcacaaattaaccattcttacttgggttatgaatatatatatatatatattttgagtatatatatatatgtattcaaagataattactatacatatatagtaattatgtaatttagttgtatcatcttaagaatcattgtttgaagattgatccttgtattctttgtttcagtatttaaaactttccttttccaaataagaacaataatgttacaaaatagaatgtgacattgtcaataactttcaaaattattaggacataaaattaatatccgttcatttagatgggatttattttttgttcatataagcatttagaacatatgctatgtttagcagcattctcagggtatactggggaagaaatgtttgactgtaatcttgagaaagtaatgagctctttaagcaggcagagcatacatacatgcggggaaagccagctgaagaagtgtgtggtaaaattatctaactcagctctcagactgtaaatgaaggaaggggtcgaacatacttttggcagcctctgaacatgctccactaaagtcgtttctttgttctaaatccaagaacatcctgtaaaaaaaaaaaaaaaaaaaaagtcttgcagaaaggaaggatacttcatacacgggaaaaatatgagcaaagaagtaggaataagcaaaatgtgtgtgggactggtaaaaagtcttttcatatacagcagagtaatctccttagaacatctaagtgaatcttcaatttaggcaatggaagataggaaactgcaaaaagataaaaactccacagtagatgaattctcttgggacgtgagtcaaaagaatgaatgccagaaaccaacgctgaacttcggtcggggatgggagggctatttagagtgcaggtaaggaaaacaaacataatgtgctttacaggactaatcataattcatcattatcatgtacttatcatatatagaaaggactgccctaggcattgaagttttggcaataaccagattgcccttgtttttgaagcgcttacaatgtagtgagagagagagagagagaatgacaaacgtgtatacaaatcgttcagccacgtaataggtattatacaatcacagagtcttcctaaaggctgtttaagggaacaaatacacagatcaaaatgcttttttcttctgggacaatgagagaagacctcattgaatagctgaatttgaattcagtctgaaaggatgaatactgatttcaagagcagaaacagaggagatagggattccaggcctaggaattatcaggtacaaagacatgtgaaaacatactgcaagttcaagattaccaaacagctaaatggaactgcagcccagtaagcttactggggaatggtagaacatgaagttggcccactaagcagggattgggttgtgaaaggcctggcttggattttaccctgagaagataatgaggtgttaaaggatttaagcgttttaaactgtcaaattatgttatcagattctgcacttaggaccatctcttcaatagttgtgtcagggatgaattgcaagtaaaagctagagttatagaatctgatatgatggccattgacatgaaatgctgagtatatttttcttaaattgctggcagtagagaagcggagaatagtaaaaagctttagagatagacaaatcccggctacaattacatatgggtgagaagaggaagaattgtagacaacatgatatactttgagttggcaactgtatggagtatatgtatagagtgtgaagaaagagtaagtaagaaagagaaggataagaagggttttttttttttgaataaataagaagatcaagcatttatcctaactttactctaggtactgattttatgcagggaaagttccttgtttagagatgatatccagcaaatgcagaaggatgatagaattagaaaatcaccattttcaaactatcataaaataatagatctaggtgatagtcattgatgaatacggtaatcacatggatattgacagagaatttcaaaaggcaggtatcaggctgatattatctgaatgtgtaaataagtctcagcattactaaaagtaatgccttgttgtgtgatgcaataggaaaaggacagtgcctcatacgaactattcttctattaaaaatcaccctaacgttttcaagactttggatctaattaccaacttatggaaaatagtgagaatagtggaaaaagtcaaccactaccacaaaaaagtgagtgactagtacagaaaaaaaaaaaaaaaaagagagacttccgagacacgagaatcaaataaattttgtagaatttgtctgggtccttatttgtccaagttaactttaaaaagaggtccttaaatggctgggcatggtggcttattcctgtaatcccagtacattgggaggccaaggcgggcagatcacgaagtcaggagcttgagatcagactgaccaacatagtgaaaccccctctactaaaaaaaaaaaaaaaaaaaaaattagctgggcgtggtggcgtgtgcctataatcccaactactcaggaggctgaggcagaagaatcacttgaacctgggaggtggaggtttcagtgagctgagatcatgccactgcactccaagctgagtgacagagtgagactccatcttggcggggggggagaaagaggtctttaaaacaattcccaaatttgaatataaatttggccttagatatttttaagatttattgttaattttattgtgaatgttacctaaaaagtccttattatttacaggcatatactgatgtatttacaagtgaaaaatcacaatgccttggattttatttaaaatcaaacaaaaataaaataaaaaaactttgtggggggatagataaactgagattggaaatatttgctaatcactggagcttagttttcggcatagatagatgttggatcaatgagtgtttcttgtagtagtctctcttttaatgtttgaaaatatgcataattaggaggagaaaatagtttaattttaagcagattcattttagatgaccacgagatattcaggtatagtttttcagtagaacataatgtaaaaacacagtctagattaattacaaatgaagtatgactagaaatgtataaaaagagtagaagatgagaatgaaaccaacaaacaaaacatggagacaacaacatttagtgggaaggcagaggaaataaagttattggaaggtaccaaaaaggatcagagagatgggaagaaagctaagatgatgttacaaaaaaatggagagtcactaaaatgacccatgtgtacacagaataagtgttgaaatactaactacattttgaataggtcatcactggtgatcatatttaaagaaattttagaggaatgatcatggagagaacagaggagatggaaaactagatagaaatgaatttatgagaggactagaaaatgagacatttaagagggtttttcctgttattaaaaaccatagctatgacagattttcctttttgataattctcagttttttttcttcatttttaaacttatctttcagtagagaaataaaatagatgtcagaaatgtaatgggagattaatgagagcatggtcaaatttaccaaaaaactaattcaacttatgtttagagcagctcattaacgcaggccctactagcaaatatctttccaagatatgccaatgtgtgtgtaggaacacaggattttataaaagtataaaagataagatgttatctctttctacttaacttccaacacattttccctcaaatagagttgtggttgagtggccactagcatttttggaatcccactaaaacaactttgaattgggaatgaattcagtttctgttgagtgggatatgttcatgtagttcagttagagtttaaattattctgactagtcaggtgtatgaatggtttacaggaatactcctacctactgtgaaaactcattgtgacagggaagtgcaggatcacagtttgtgttgtaatatacaattgtccaatgatacctggccctacatgtatgcaagaagttgaggaaaaagcaaagtttgaaatatactgagctgtaaaaattaaaagaaaaggatttggttatcatcaatacctaggctaaacagaatttctccttgtcggggatttactaagcaacacaacaacacaacatatataatcataaatgtaccggatatgttccccttttttgatgataatcatgtgaaagtgtaattaatcagagtcccttttacagcacaagtcttcagtattcaattatgtttataattgcccgtgtgtagaataattttaaaagaagtttttccaaatttgacaatagatggcctctaaccaataacgttgtcatacgaagaaatgagtttagagtatgtggtcaaaaaaggaatggaaaaggtatttatcaagctaagtcatgtaaatgtaatatgtttattttctacatttcatgatgtctagggtattttgccattttttaaatttgtacttctagacttacagtgtggctcacgcctgtaatctcaacattttgggaggccgaggcaggaagattgcttgagcccaggagttcaagaccagtcctggcaacatagcaaggccctatttatacaaaacagaaaataaaataaaattaggtaggtgtggtggcgtgcacctgtagtccagctactcagctacttgggaggcttgcttgagctcaaaaattcaaggctgcagtgaactgtgaatgtaccactgcactccagcctgggtgacagagtgagatcctctgtccaaaaaacaaacaaaaataatttttattctccctttctgttcagtctaaataaatattcattgtcatgcctggccctagaagtatgcaactaactgcacaactttggtgtgtttttttgttttttttgttttttttttgagaaactttcacaaaacttggatttaaatctgtatgggagcccaaaaaggtacaagaaagtagaggaaaaatattcaacatttacacacacacatacacacagaaaactataaaagctttcatctttcttagcttttgtccaagaaaaaaaagcagttggcttttaacaatacagaaatcatttttccttaaaagagatattgtgaaaaatcttaatgctcaaagtactaggacacatacatacatacatacatacatacatacatacatacacacacagggtaccttacacattaaaaataaaatgtgtttcattcacatctgaagatttcttttcctactctaccctgttagtcactcctacccctatgagagaaacacaataactgttcatcccctttctttatttttttgttgtcaagtctgaggacagaaggcacataacacatatgaagatggaatattttttaaaaacaaggagacaaaatattaaacaatatggtagtgttgccttttagggaaatccgaataaactatttactatttcttggaaataaatctaaaaagtcaaatacttaactgaagtactttgtccttgacaaactatagtaacaccacaatcagcagacttaataatttatcagtacaacagaacatttagatgttctgttagctgtagattctatagatttaatctataattctatagattaaaaaggaatattaaaaaggaaatttaaattttagaagtatatttgtattctaaattgatatatatttagaagaaaataaatccatatatttaattattcatatggaaatatcattgttagtgttgtgtggatgtatcctttcaagtaaaatagcttatttaaatctttttgaagtaactcttcataaattcacagtctaacaatttcttatttttcgggagcaaaggtatatattaatgtttaatcaaggatccagcgtttgatctaaggtcatcttttgaactagaagtaaagcttttatttcaaagaaagtctatcctcttaccttttacatttacatatttaacaggaatgtagacatacttgcaaaagtgactggatgatattttgctgttgtagcacacttcaaagattagaattatccattcatttcatgagtgtagaccagcccaatttgacccatagtctttctgtgaaaatataattatcttctgaagataaaaacagggtaaattataggtggttgtagagttggggaaaatcaaagagggggacaatttgtggtagtcctgagtttaaatactgaacaagtcatctacttcttatgtgaccacaggtgagataattccttcaattataaagtatgatagcaatttaagtgttactatgttctctaataacatgagctaaccctctttttcttactgtcagaatgacactataacaaatattgcatttttccctatgaatccaaaagcttctgtcacagtcgtgattaggaatgctgtggatggaagccttacatcactggtgaatgccaaaacaaagcagtatttatcactggctttgatttcaacattattttaatattttcccacctttattaaagacgttaatattatgagtgagtatatttcaatgaaagtagcctacttgagcttggaaagactaaactaattaacaggaaagtaatgaaatagcaggtttatatcttgagcccccagtgatgaaaacctttagcaaaatacaggttacatgtttaggatttggttaattattttaggagcaaatatagagaaaaaatattctcatattttaaagaccaatattctcatttaggcctgaatataacagtgaattctctaccttatatgggctaactatccagttttgacagcagagaaaattataataccctatagacctaagtttcatcaaccctgttctctgaaatatatctgtaattattctggtacactcagatgtttatattttaagaatctatatctacaatgtagttaaagaggtgttttataattaagtaattaaatataagcgtaacttttaagtgttgttagaattcaaagtaaagcactcattccaaaatatttcaactttcttataaacatttctctttgtactacaatattctctttcccccaagtgctatgattaatgcaatccttaaaaacaatggaaacaactatctttattactgattttataattttggaaattccagggactagattccctactgttaaatttggaatatataaacttcctgggattgcagttatgacctaatgtactaaggtagcactcaaaacagctattaatttacatggaacaaagtcataaaaggccagaggaacagcaattattgtcacatgcaattaccaagagacaagctaaaaaagaacactcgtctgcaagtgtatcaattaaactccattattattaaaacaagtggtaagtgaacctgccctagaaatctattgtgtctggaactggttccttcagtgggttcttggtctcgctaacttcaagaatgaagccacggaccgtcgtggtgagtgttacagttcttaaagatggtgtgccaggagtttcttccttttggcgggttcgtcgtcttgctcacttcagcagtgaagctgcagacctctgtggtgagcgttacagctcataaaggcggccgcatctggacttgttctcctcctggtgggttcatggtctcactggcttcaggagagatggtgcagaccttcgtggtgagtgttatagctcattgttacagctcataaaggcgttgcagacccaaagagtgagcagcattaggatacattgcaaagagcaaaagaacaaagcctccacagcaaggaaaggaacgtgagcaggctgccactgcttgcgccggtggcctgcttttattcccttatttggccccacccacatcctgctgattggtccattttacagagtgctgattggtctgttttgacagagtgctgattggtgcatttacaatcctttaactagacagaaaagttctccaagtccccacccgattagctagacacagagtgctgattggtgtgtttacaaacctttagctggacacagagtgctgattggtgcatttacagtcctttagctagacagaaacgttctccaagtccccacccaacccagaaacccagccggcttcacctctcactacgttgcatagtactagacagacctaccctgtagaatttaaattaatatcctataaatactgataactctcccatattttttattcacaacttacataagtgcttaaagaatgaagatgaaataaaaatgatttacacaaaactttaataagattgttattttaattttttgcttacttttctgttatttcttcaaacctgaatacatatgtgaatatggaaatatcttcaaaatcttgctattttagttctttcctttaaaaaataattttcttcccagattttttctcttatatgcctcttgctcaccagtttttcttccttaaatgcaaatcgtctgagagaaatggatggcaataaatgcccccaagaatgactaagtgtaataagcagctgttaagatgcggttttcaaaattagacctgaaaaaaatgtttcttttctgtttgtttccatatgaataccctagatgagtagttactatgtatttattagccagtgccttatataacataacacgttcaggagacagttagcaaaagaacagtagaattgtaaatactcagagaaaaggagacatgcacagtcttccttctataaataggcttacttcagcttcatatccaataggcttaaccaagcatgaatttacactcctcctctttatacccttcaatacacaatttcactaaataatgataatgttctatttttaaatattttacaacttttttcttgacaaatttaccattgtgcactcattgtatgttggagatgagggattcactttggttatgaacgtgaaatcttattctaagttgttgtatataatttaagtaatttatatacatactattattaattagctaatattttcccctaaattaataagcgtttagttcataaagagaataacacatttttgatctacatcaggaatagtgaaagacctagattgatatattattaggttgcagtgagctgcattgaatgtgtccctttagctacagtggtaaaatagatttataattaccaatcttcaattatgattgaatttaaagcagttgttttaattggcacttttttgtaatgactgaaaggagaaagtatttggatttcaaagttttcatgcaaatatattttcttatatttcttcctgctacaatctacccagaacaaatatgctatattatatgagtaattatgttttaataggcttgttctgcaagcaattctaaatagtacttgtcttgtgagcagtgatcatggtttgtgtttgcaaacagtctattgcccttttcaaagacattcctggaatacaaacagctggcaagtgatctgctttccaaaaacttgcggtgtgtgtgtgtgtgtgtgtgtgtgtgtgtgtgtgtgtgtgtgtgtctaatttgagcaagaccacccagagaattagtagtaataaataaatatacaatgagatttcatatcctattttgacaatgtattaagtagattgaaaaccctctctccatctctataagaaaatgttatcttctgtccaatcttcatgttgccatttccctatttcttctggttcttttctcagaagtagtcattatgattcttgtatgtaaccataattaaatcattttacttttctgtatttattagttacttactatagatctgttagtgattatatataataactatctgtgagatcttattaagggctaattttaagggctaacattttgcatgttctctcactagtgttcaaaacagttcatgagaaacagattgtaatctgaacccaagcctgtaggactttatattcaataaccctaacaattgttctcattcttctaaactcttttcaagattaaaatagttatcagttttagacttctcaaatttcatcattgcctgataaatgtagattctaaattgagtgtacagggatgcttctttttcatctatatgatcctgtaactcaacaatgtgtataaatgactaatgtgctcagtgtttttattagttgcttgtaagaaaacaaaacaaaggaaatgcatttgcctattgagtctcatgagaaagtatgacttggagctccacaaagcaattacaaaagggataagttgtatccagcaaacttgtctaacaaagttgttttgaagtttaaataatataggtccagcccttggcatagtaaatactccataaacagctgttactctacatgctctgtgaggaaatagacatcacacttgtctattactgcattcctagtcttaggatggatcccagcacaaggaagagtcacaaaataatgtattaaatggatacattaatgaatgtaaggtattgtaataatggcaagtcagagtatggtgagtgtcattattaaaaatgcctaatagtcaggagatcaagaccatcctggctaacaccatgaaaccccgtctctactaaaaatacaaaaaattatccaggcatggtggtgggcacctgtagtcccagctacttgggaggctgaggaaggagaatggcgtgagcctgggaggcgcagcttgcagtgagccgagatcactccactgcactccagcctgggcgacagagcaagactccatctcaaaaaaaaaaaaaaaaagtgtctaataggagatgaattttgagcaaaactttaaggaatgtgattgacatcaattgagaaatgtgttccaaagcaggggactatattttattaatactcaggatgagaatgggcttatttcttgagatagataacataacacaatatacgatttgcagttcaatatagtgtgtactctatttgtttctagacttgaaactaatgagtgtttaactatcttaaatttacacagagaaacatgttgtgtctgtaaatttattactataaaatggtggccttttcctgtgcattaatggtgacaaaaaattagcaaatgagtaaaacatagcatttatttgtattaaaatattttttcaaggtagaaatataatttttcttataatattaatctactgttccataggtaattcatttcaaatattaatttaaatttttattacttttggctgtttttttggtaattataatcctagacaatccattattttcatttctctattggattatttacattacagatagaaaagtaaacttccaaatggttatatttaaagatatttctcaattactaacaattaaatgattgtcattgctaccaaattagtaattgctgggatatatgatatatgcattagaaaagcagttcttatatgcctatacattcttaaaattagctgtccatgaactggatctcatgttctaatatgtttctttacgtaaaaagtgaaaaaatgaaggaagaaagaattgtaaaaataattatcactgaaatgtcctggactgtttgtgagaaatcaaaatcttgaagtcgggtagctacctgacttcaaactatactacaaggctacaataaccaaaacagcatggtactggtaccaaaacagaggtatagaccaatggaacagaacagaaccctcagaaataatgctacgtatctacaaccatctaatctttgacaaatctgacaaaaacaagaaatggggaaaggattccctatttaataaatagtgctgggaaaactggctagccatatgtagaaagctgaaactggatcccttctttacaccttatacaaaaattaattcaagatggattaaagacttcaatgttagacctaaaaccataaaaaccctagaagaaaacctaggcaataccattcaggacataggcataggcaagggcttcatgtctaaaacaccaaaagcaacggcaacaaaagccaaaattgacaaatgggatctaattaaactcaagagcttctgcacagcaaaagaaactaccatcagagtgaacaggcaacctacagattgggagaaaatttttgcaatctactcatctgatatagggctaatatccagaatctacatagaactcaaacaaatttacaagaaaaaaacaaccccatcaaaaagtgggcaaaggatatgaacagacacttctcaaaagaagacatttatgcagccaaaagacacatgaagaaatgctcatcatcactggccatcagagaaatgcaaatcaaaaccacaatgagatatcatcttacaccagttagaatggcaatcattaaaaagtcaggaaacaacaggtgctggagaggatgtggagaaataggaacacttctacactgttggtgggactataaactagttcaaccattgtggaagtcagtgtggcaattcctcagggatctagaagtagaaataccatttgacccagccatcccattactgggtatatacccaaaggattataaatcatgctgctataaagacacatgcacacatatgtttattgcggcactattcacaatagcaaagacttgtgaccaacccaaatgtccaacaatgatagactggattaagaaaatgtggcatatatacaccatggaatactatgcagccataaaaacggatgagttcatgtcctttgtaggaacatggatgaagctggaaaccatcattctcagcaaactattgcaaggacaaaaaaccaaacaccacatgttctcactcataggtgggaattgaacaatgagaacacatggacacaggaaggagaacatcacacactggggcctgttgtagggtggggagaggggggagggatagcattagtagatatatctaatgttaaatgacgagttactgggtgcagcacaccaacatggcacatgtatacaatgtaacaaacctgcacattgtgcacatgtacccttaaacttaaagtataataaaaaataaataaaataagagtcaggaaaaaaaaaagaaatcaaaatcttgacattcaagaaacaattttttggtcaaagaaatcaaaaaatgttttagttatatgataaaatcaaatgaaaactttaatctttatatttgaaagcttcatggaatgtgaaaaaaccatattaatcttatctcaattttccaataataataataataatatctaatccatctaatttttttcacaggcaaatttatagcaatctatgttcatattaaagccagtactatttatcaaaatgaggattaatacatggggatacatgatttggtatgcctaaatattttcatttaaaacatgtataattaatatgagtggtcaaaaataaaagaaaatattgtttttaatgaagagtgaagagaaattaacacattgattaaatgatgatagtgtttgcatccatgtagagggtgagagtgggcaatgatccagacagatatttctggaaaaaaaaaatcttaatttactgttagagaatcctggttgttcacctttcacctggaataactaccaccaccacaacaaaatattgtgattttttttaaataggtgaaacatagaaaaaagaagaggaagatttctaaaatatatttttcctcaaaattatgatttttagaatatgattgtgctgagtgaagtgtgtttgtgttcttttttattttaactcttaatcctttttttgcaataaggttcaagaaaggccatatcacaatgtaataactgtggttcttaggtcaagaatatttgaaaatgtagttcccaaatgcatatcctcattaactttttagaaaagctgatatggtataataattatggagtgaccaaaagtatagcagttctgagtatactatttattctctacttgggagatgaagatgggaggatcacttgagcccaggagttagaggctggagtgagccttgagcacaccactacactccagcctaggtggaggaaaaagaaaaaaaaagattatgaatccattgtacctaaacttttcttgaatgtgatcaaaaagaacagttttacctgctttcttcacagaggtgttgaaaagatggttaaagttaaggatacagtgaaaatgttcctcagccataaaaagaaaaaatgtcatttatgaaataatggcatttgcagcaacgtggatggagttgaagatcattattctaagtgaaataactcaggaatgaaaaaacaaacatcgtatgttctcacttataagtgagagctaagctatgaagatgcagagcataagaatgatataatggactctggggactcggtgggagggtggaagggaggtgagggataaaaggctacacattgggtacagggtacactgcccaggtgatgggtgaaccaaatctcagaaatcaccactaaagaacttttccatgcaactaaacataacctattccccaaaaactattgaaataaaaatttaaaaagaaaatgctaagatggcataaatattaaattattagtaagtaaacaatcagaaggtaataattgattatagtacgtgtgggttctagtagaccctgttcttctaaataataattcttgcatatctaatgagtttttattcattttgcatttttctgtttcagcattatagttatatgtgcacacatgatgcacttctaaataaacaaacagtaccatgataggctcatcttttttggaactcatgtattctacaaatatttactaaagttaaaaaagtgcaaggtattctgtcagatattataaaggaagagagatgaattttccttgaacacttggagtctaggaggaaaagaaagatatataatataatattggtaatactgctcctgcatgccaaacacactactatgttatttctgctcttctcaaaacccagcacaaaacagcattataatctccattttgcaggttaggaaattgcccaaggtcacactgctaataagttagcagagctgtgtgaacagtctagagaataagaaggtaaatgttattttcactatagcacataatattaaaaataaccaatttcaaatagtaagtgctaagttctataaaaattttatagcaaaaattcatatactttaagaattaacttgtaaatatttattcttataatatgcacatcctattagccttaatgaaaattcactttccaatcatcaggcatttattttgttcactccatcaaatactttagttttgcaagaagcatttttatatgtgcattcgcttttgaaatccatgaagatgattaagttttttctaaaaccaacaccagaacctggaatgcccaataattgctgaatgaatgaatgaatgaatgggtggtgaattagcacaaaaaagtaattctttccctaatatttttagtgcaggttaacattttatgttggtacatgagatagatggaataggaaaaaatgacagtgtcaaaattcaaggcaataacaaaatcaattcattgtgggaatggtagcagaaatcaacagatcattttggtcagttattatcagagggaagcttaataattttgtttaacatagtgcttacagagttttaccagtggtgtgagaaccagttatcctaagggctaattccaactctgcacacagtaacatcatgttggtagcttgacaaagaacatggttggagtatttatatcttgaaaattgccaaatactagtcatgactttttcctgagagcagacatgttgcacatcactggcttctactcatgcttagtggctggcagaattcagaggtgataaatatctgcaattcttggaggagttcctctcaacaaaatgttgccctgtaattatctgagctgagacccctgactgtttgcttaaaaggaaatttaatttttgcctggttttgaaatttaatgaattttctgaaaatgtaactgtcatgtaaactgatgaaccactgaactttgcataatcatcattttataaaaatctctttactgagggaaatggcttttatgctgtttgagtcgtacaactggtattagtttttgttgctgccatgtcattcaatttgattctgttgaggtgtaagcacctggtgacttcagctatgtcttcaatgtggttgcgccagagcatttatatactcaagtatacatcattttatcataaaaattgctcatttctcttttatattatactcaatgcttttaattgattttttgaagccaagagtataggtggctatattatctgtgaactgcattttaacatattaaaagagcactgacgcagttcagccttttcatttccagaagagagagtgtgacctgatgaggtaaagtgacctgaccaaggtcacataactcactgacatttcagttttttaatttatctattttccattaactttcagtaaccaatattatgtgttagctttatctggaataacacatgcatagtatttgtgaaaatacacacgtagtcctcttgactttatttctaacagaagcctctgctagatttgagcaatatagcttcatctaaatcatgccgcattcttatgttcaatgacagggatttatttattaggtaatgagcccagaaattatgctgctacttttacacctttattctttttatggcacccgagaaatacatcccatatttcatatttctaagcatttggggagccacttgctttgattgaaattgctggttcatgctaccacctagacaaaagccactgacctgaatgccagagctaatgtgactgttgcatactaagctgacttttagcttcaaactttactaatgtgtttacactgaaaaagaatgaaatgaaaacctattttcaatttgctatgtcagctaaagaaagtaaaaaaaaaaatgtgtggtagatgcttaaggcagaggaaatgaggactattgctggaaatttagcactgcacaatagagaaaaacatggctttatattctaggtccccatggatagctgcctatgaatatcatagcaatgctgttctaagcaaggtaattcttctcataccagtttttctcttgctcaaggtcatgtctaagagtagaatgaaatcagcataatgctttaaaatatacgtccagtgaattcaggttaaattctaaaacgtcaggttgattctttttgtaagcttggttccagattttagcttgtgcaatgagaaaatgttgcctgaatatttttctgtacttgaattggcatactttaaagttcaaaatgggaggcaggtaaatttaagttctagaatttaaaaggtttaacattataatctgttttctgtctctgtatgtttgaaaatctttaggatatagccaacatattattctcaatatggtgctttattttccatttatgtaacagataaagtgggtctttgattcacttggctgcgacactcatttcatctatttatgcaattgcacgttcatatgtacgaaagccagctcagatttttcttcctccaaagtcctccttcaaggacttctcagagccttaagtaaaggctaacataaaatataaatctccaaatgaaaaatattactggcactgttcccaaatttatttttcctcaatgcaactttattctaggagcatctgaaaaaatgtacttctatttggcaaacttttaaaatgctgctcttttacatgatttactttttgttgttgttagtttccgatacaccaaggcctagcttccctatcacaatctgcctgttcagggaagggacaatcctctttatttatctggcacagttaatttaaaaaaagctgctcaacctttacaatgtgactgtatatttagagataactaattacagaagtctctttgattaatatatttatgtgtgtgatcattattgtagatgttgttttttaaaagcacacagagaaaccaacatgcaaaagaaaggaaaaatattgtctgcttgtttgcttcatgaatgtgatcatttagattatttttcgttatcacacttttccccatcgtgccatgttttcagacagacccttttatcatggagagaaaagcaacggcccataaaaagagtgttttgaaagctagcactatgacattaccaagtttttctattattattttttctttcaccacgtgaccttatgttgttcggtaactaagaaggtcttctaatgtttaaaattatactgatgcatgtgtgtgtgtgcgcgcgcgtgtgcatgcacctgcacgtgcacatgtgcacgtagttgtgtttttcaaaatcaaacgtaatataggaattcaaaacatagaaatgcaccttagtaaactgagattaccctttctggacttcctaaattgaagtagaatttaaactaccagtggatacacatgcaagtctgagattagctttaggattcctagtcttactattatgatatatactgcctacaaaggaaaaaataatcagtagtaattattaatatgttcagtggagattagaccttgagaatgattttcagaactgaggcataatgtgaaagtcttcaccatggatgctcatagctaaacaccaaatagttggtctaggctccctacatccctcctgtttaaggtcaggattgttcctgggtctttcagttatgaggttcacaaaccctgagagataagtagccaagacagagctagaacccagatcttttaagtcttactcttgtatcctttgagaattgctcttccaaaaataggagggtttctgtaactttgaaccagcttctccgatacctaaatatttggtctctattatatcttatctcattttagttaacaatgtttctaatgagctatgagcctcagtttctcatgtataaaattcataaaataatacttgtatatagactattaaatatgtatacacatgtataacatttattcagaataatagaattagcttaccttactgaagatacactttagacatagaattataatagttcttgtattgaatatttacaggcacagttcaggtactatactgaaaatatatactcagtacatttttgaatttattttgtttttatgtatgagttgattaaacattttaaaacaattggaacaaacttagtgagatttgaatgctttagagttctaattctctagtgaacaaacaaagggaagcttaattggaaagtaaatgattttgtgacattttcagtttatatacatacaaaatgacaaatcaaaaaatactcacattttaaaattttgtcttacccaaaatggaaaatacaggacttatattgttatttggggtaaatagttaaaaatcctgaaaaggaactttttttttttcattgctttctttatatgccagcatacctcatgcacacacaacttgcagcttctttttgttctcacacataatttgatattataagtagggaggatttaaatgaggatttagaaatgaatggaaacctcaatggaagcaactgcatgttgaaataattctaggttctacaaaaagaaaggagaatattggcaacatagttgaaggaaatgaactttaagaagtagattccaacaggattagtctactactgtgaaatggaagaagtaaataaaacaaacagaaaaaataattaagtagaaaaagaacttacaagacctgaattcttctgaattccagacaaaagagtaggcaacaataatgataaaatgtatacatctagaatggtactgaggacagaaggacaatttggaataatataatactctgaagtttaacatggtcactaagaagtatatagaagtagaaaaatatggaaatgacaaaatcaagacttctcaattaaagatgtaatatgttgagttaggtgcactactcgctgaggacaaggtgtatgtcttccttatgtttacacttctagtctgcttgtgctcagcactgcacttgccatgtagcaggtattcattcaatgcccttttatttaacccagtttggtaatccaggaagctcattgtattagtccattctcaaactgctatgaagacatttctgagactgtgtaattttttttttttttttttgagacagagtcttgttctgtcacccagactggagttctgtggagcgattttggctcactgcaacctccgcctgccgggttcaagtgattctcctgccttagcctcccaaataactgggattacaggcactctcctggctaatttttgtgtttttagtagagatgggttttcaccatgttggccaggctggtctcgaactcctgacctcaggtggtcagcccacctcaacttcccaaagtgctgggattacaggagtggccacgacgcctggctgatactgtgtaatttctaaagaaaagaagtttaatcagctcatgatttcacaggctgtaaaggaagcatggcagcatctggtcatattctggggacaccttaggaaactttcattcgtggtggaaggtgaatgggaagcccgcactacacatcgccagagaaggaggaagtaaagaaagggcaaggtaccacacacttttaaacacccagatttcataagaactctatcacaggaacagtaccaaagggagaaatctgcccccatggccaaatcacctcccaccaggacccatctctaacattggggattacaattgaaaatgagatttggttggtacatgtatccaaaacatgttactcttatttggggaatgtaagaaagaactaatgatagatgatgataggagctaaagatttttaggtcttccgcaaaaaaaaaaaaaaaaatgaacacttaccaagtaatctcaaatagatgagctttaatgagaaaatgccacattgattttgcactttgaaggaatgtataacacttaaatatttgttggatgtaatttatacggtacctactgaaaatgaggaaactgaggctcagtaaaattgaacattataccattaatgtgatctgagatatggttaccctcagggactatataccacaccatgtcaccatgttgtattcatatttagtcttcttctctctaggaagtgatctcatttttgtcattcttcactcattggatgagtcctcattcacacacatcacacacacctccaactatctgacaattcttagtcttagaaaattctctgaactctgtgattcccaagtgatgcagagtcaaactgatgttattaaatgacaaagggactgagggctatttaagttttaaaaatctaaatcttagcctgaggcctttacagaaaaagaaaagaaatccccaagaattttaaggcattttttggtattatttttgtgatttccatttttgaagggctaagattcacagtttaggttacaggtaagtcatttcataaataaatatgtagtagcttaaaaaagatgatgcccgtgatgtttcttaaaatcctagtggtcatgtttaaaatgtaacatgacacttgataccctgcataatctatatgactatatgtacttgagaagaaatactaatgtaatctagtaactctttattctcttaatgaggtatgctattccatagctctttagctttttggtagggtaaaactcaaagagacaacccacataacattaaaaagaactcattaaataaaatgcaacattttgagatgcataattttcaaatggaaccactgtgtattacagtgagataattaaatattttatgttttacctgaacttccagaataagacattgatatatacatttacagtatatagagccactgattttaccatgcatagaagtggatggaatatcaaaatgctttgttccagtactttgtgattataatgaagacttatggttttttaaattttgacaacttttaggcaacagtaaatatgaacacatagattatattttttgtttgtagagtatttattaactatataagcaacatctgtgaagtatagaataatttccatctacaaaaggaaaatgttgtaatacatatttagtttataatagtatgttaagaaccatcaacttattcttttaattccatattccacagatgttcattagacacctaccattaaatgttaacaaaatttcttcatgggtgaattgaatacacttagaggcaacccattttttaaaaaagtatgagtataatctggattcctgtgagtataaatgtagctcatatttattaatgattgtttactctaaaaatattcagactggtttggcaggctctctgtctgaggcttgaagagcttgctctgggatccttgttttctcagcctctctaattgagggcaccttcacagtttcagggtactttacagcacggagaagaacctaaaaacaaaacgaaaacatgatgggtcataactatgaggaaataaaaagaactgtataaattgcaaagtctgaaaatcaaaaatgtaatacttgaactaaattcattttaagataatattaatgtggaaaggaatgcatctgattgatataaaaagtgtaagaacacttgcagtttaatgttaagcagttacattgcaaagactagtctcaaattttagaacttcattgaaaaatcagtcataaattgtttctccataaacaattaaaaaccagttttctgattctggttaattgtttctttttcattaaatttgttaaatggggatcactaaaagtaaggtctcacaagatagtgtgcatattgctttacattttaaacttccatatggcagatctttcccctgtgaacttgaaaggatagatagtatcattttattttataaatgatgacatccacagaggctaagtgattagctgtgtcattccaacaaatagtagactggaaatctaaatcagtatttctttgaagggaaatatatacatctacacctgtgtgtgtgtgtgtgtgtgtgtgtgtgtgtgtgtacacgcatttcttatgtcacaggactaacacaatgaaatgttattttaagaattgaaacttagtgtgagaagtattatgtgcaaatgtataaaacattgtcacacattatacaatcgatcccagattgtgtcccttagttgcctgtagcattgacatttaacttgtctaaaactaactttatcatctataaaatgcaactaataatatctgccttatctcagagatagataaattctatgtgtcagtgcctgggaggattacatttgttttagctaatcattcatttatgcatctattcatgcaacaaacatttattaagtgcattcaatgtacaagcattagtgaagatgttggagataaattaatggacttatactgcatgaagaagaaatgtataaatcataaacaatagtacaaacacaaataataccatcgttaataacatcagacaattataaacatgttgcattggttggagaggaagctgaggattgctgcagtagtctatgcatgaagtgagaagggcctctactggaaagatgctgctaggaatggagaagacttcatatttatgagtaatgcattttaagtaagagagataaggtttctctctctccagtagaaaggaatagagaaaaaaagagctgaggaaagtcagttatgatgtaaaacctaagataaaggcaaaatagtaataagaacactaaggggtgggcagtattagaggaacagtgacaatttcagttttgatcaggttgattttgaggtgactgatacattcaagatgaaagaaaattcaaaattggaatttagatgaaagggtagtgcatgtattcagagttagcagtacttcggtatgaggaaaaactaagtttctgattaaatgttaaaagaccaaagtcagagcttaaaaccatactgatactagaatgcagaatgggcaaagcaaaaatgaaaaaaaaaaaaagtagtaatatcccagaaaactgtgaaggaaagaatagaaactttgtgaacattaaaattagcacaacagccaaaaatgaatactgaagagaaactatcttaatttaataataagcagatactttgtgacatttgatagagtagtttcagaaaacttgtgggaagtacaatgggttacagaaggaacggttggagaggaggtagagaaagcagatgttgcactgcaaaatggtgtgaagtagctgtaagacagagctattcaaatgatgaattagtaaaatccatgatggctgaagagaagagatggaaactaatggagaatataggagtttccagaggaagacgttctcttaagatcgaatgaagcagattttaaaagctcagctacagtagatgactcttaagaatctaaaggaaaagatgaagggttatgtcttagcaaatagggagttgaagttttggggagcaacaaagaatgtccagacgaagggaaggcaaagttcaacattataactaataaaagttggattggatgacttggggacttagaataacaagcaaagcaagtctcttaattcttccctttggaattatatagactgaactgacccatctcaggcatagctgaacaattccagtcttctctctcagtcacctttggttgctccaatgattttgccaaaggtagatcagaatgtgtgttttggtgagcagatttgctcacataagtgaaacaatgaaatgggggcaagcaagaggcaggctgcaacatacctacttgcttatttctttgatatcacctataggatgagtcattcttctttttggtgggtggggagcaaggctaagaggccataatttttctccttcgaaattctttccctttatggaacttagaatagggtgattaccaattatagcttaatatctaagacggacctaactttgttcccagaatgcacctgcattgggtaatctgtgtaaaacacaacacatcatataattctttatatgaaatttttataatgtgttttgaatttttttggtggtataatctgtctttgatagcataggaaaggataattcatataaaagctgaagaatgatggtttaatgtgttgaacagaatataccatgagcaaaagcttgttgatttgggtaagtctctaccttgtttctttaggagaatgtcatttatgactcctcctgcatttgtataccttcgtaattctcagtaacatagaaatttgatttataggtatttttataatgtatatattttacataaaatattttgatgcatctcacttattttttaattgcataaattatattgaccacttacatctattattaatgacatacctccccaacttcccaaatccttatcattaacttttctttttttttatttttagacagtctctctctgtcgcccaggctggagtgcagtggtgcaatctcggctcactgcaacttctgcatctgggttcaagcaattctcctgcctcagcctcccaagtagctgggactacaggcatgtgctaccatgcctaactaattttctgtatttttagtagagacgggcttttgccacgttagccagagtggtcttgatctcctgacctcatgatccacctgccttggcctcccaaagtgctgggattacaggcgtgagccaccgtgcccagcctatcattaacatttttatttatctcagaatcatagtatcaggatatcttgaaggatttggccaaatatatttcagcaacatattcaacaacattatgttaaacatgaaaaacatgaaaatcacataggtatgtatatattgagagactaaagggagcagaaaagcaaggtactgataatacagaagggctgttgttcctagaatggaaatagctgagattgcaaaggggcaattagaaagatgtcatggtgttaacataactttatatacgtatacacatgctgtgttcatttatgagcggcagtaaacctatagtgatgccgtctataagaaagaaacagagaaatcgagtaatatgatttagaaaataacaaagaatctgttataaagtaataattatcacatgaaatctgactttcatattttctcaagcactttgaaatgtacaaggttctgttccgagtataaagcttgctgaagaccatttttttcaaatttatagacaaaatgtaaaaacaatttgataagttctcatttcagaaagtttatgtcagtgacatgaaaacatatcagtaaatgcattgttaacaacttaatcgagtaatttgcctgtcatcatgactcctgggtaatgtcaagctgtttacagctaatgtaatttttggtagaaaaaaatctatccattggacatttttcatttcaccttatgggaaatattttattatagtagacaagtttccaaaaagagattattatgaaagtagttattctagcagtaacttctcagataaatgatctgtataaatatttttctcaatctctgaatagaatcccaatcaggagtattggtattacatgtaatccaacttctagctctatcgttatgtatttgtgtcatgtcagacattattttttactggttggccctcaattttctcaccttttgtccttagctttgaaccaatcaagttatggtaattgtgtttattgctcgtcagtaaaggcaactataataagatattttgcataaggttagaatgtattacagttgtttaataaaattaactgattaaaatgcagggaatatttttcaaaaagagaaggatgattttcagggtgggatccagtcgtgagagttgcatgagtttgcaggcagaagtaccataaaatattaaataaaagaggttcttgaatgccaagtcgaggagtgtgaatatatttaatatctgtagggtatggaaggcagtttccctcactgagtgaatataaaaggccatattaacccatgagagttatccgcagttagcatttgtgttgaagtaaagttgcactaaatgtatgtagggttataggagaatgatttagatcatatgaaactgtgaagggagaagaacataccaggatgaaagaagtaatttaagagtcaaagctacagatatttcaagtaatatgtaggagaaaaagaagcttaacttcaatttcattaaggatagtgaaaatccatctcagtagtgttcaggatgataacagattgcaaaagaaatggaaggaagagatggtgagaaaaatgaaggcagctggcatacatcatatcttctaggggtctggcaatgaagaaaaatagagaaaaacttcctaaaatattgggatgaaatttacttaattgcattttggcatgttctcgaggctttttaacttctcgtctgtggtttgtcagaagtaaagacagcttttcacatttcctgtcttttcaaatttggcttccaagccatgttgaggatggagttatcttcaaatttcaggggtgtgatgttgcgtattggaccacagatgctcctcaattctgtgaggatttttcattattttgatttcttttttcctataaaagtttgcatttcacccttctcatttttccctcagttgttagaggctgcctcagtgagctctaaattctctggcagatggtactcagggatgactttgagagaattcctagatttcaaagacatataccttttccctgcctccttgaataatttatgttctttggcttctcttacccatgacaatgggccctgaaggagacccaaatctaatctgagatgtaatctccagggaaaactgaaccactggggaaagctcagttgtggacaacctgtgtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcacatttgccatattctaattattagatacaaatcaataggctcgaggtgaggggattacacaaggacaaggatactgggaggtggaatcatgggaaaccgttttacatgctgcctaccactcacgtaatatcctagtataataaaatcatcagctcttactaataaggacattttaccttttagttttcattcataaaacatctattgcccaacagagaaaacgatgctgaattttaattttataaggagaaaccacaaaataaaagacttgtagaagtgttctcttttgccccttcttggtttttgtttgcaaaaaattatggaaaattttcagcagtaaaagattaaaatattaacaaaattatatatagcttttactattttttaaatgcaaaaattcatttgtttcctacacaagtaaccagattttcaaattctactatagacacttgtaaacacaaacattcatatttaaaatgtattaaataaaatattttaaattttcaaaattttaattttataatgatttgatattttattcttaagctagtaatgacattggcttttttgatcaggaaacaggaaataagagatattaaagacatggaaaattatgcatggatctacaaatacaacataaatttaacttctcagtatatcctaacacatatattttttcttctaaaatggaaataaattgcaaccaaataaaaccttatatttctgtattagatattttaatactttactgcagaaatatatataatatataccttatatttgtgtattagatattttaatacttcactgcatatatatatatggttatatatatatatataaccaaactgtcgatttcatatacttctagtgaacagaaatgtgtatttatatatggcattataaatttatagaagggccttggacatcctctagtcctaggtttgtactgtgtatctaactaaactgaaacacaaaggcatcaggtgaaaggctgaaggctacacctaagtagctgaagtaaatccactttaagtacacgcatgcttactacactttaaaaaacttttatgccttgacattattgaaatattctgcagatactttgcatagaatcacagggccagaataatttttagttttatttacttggtctagattttgtcatcacaaatctgagaatggagctaaaaatcacagcctgtaggattcctccattctatttttggagccaatgaagtttcttacatttggccagccctctctcaaatgcttgcaattgggtaacattgttcctgtgagggaaggtcgaatatcacagaggttatcttataaaacctcatcatttttacaatgccaagatatatagacacttagatggggagtttggaagagtaaaataaaggtcaattagaaaactatgcacatgttcatgtaagagatgatggtgacattgactgaggttataatcatggggatgaaaaggctattttttgaaaatgtcattctcctaatcaaaaaacttcagtactatcccattcacattttttaaaggccaaacttctaaattgaacttttataaacgttgttgagcatttgcagtatttttctttcatagaaaaagaagcactatttttcttacagtaaatgcaagaagcttttaatctacttgaaattcactccacctgaaattcactctaccgtccattctttaaaaatataatcctttcttcaagtccctgctcaaatccctcctgctccaacaagacatccctggtgagcctagctgcttttattcctcctacctctaatctctttaatatttctttgttttgttgtgcttttatcaaaggcaccaacagatgctgccttttatgacagttagggttatctatctgtgaaccactagatcatgcttcgcaaggcattgtattccctgtgtccagcactgagctttgcaccaagggcacatttcataagtattttttgtaagataaatggaaataatgaattcattactagagctgatggtgccctcagagcaactgatctcagatatatttgtggctgaggtcaacaaaagacgagacaattactggttttatatctcttaaaagctgagtcaaacctttaataaatttactgtgactggaaacctattccatatttatttcactattaactgttctccagttttcagcataatttatatgcaccttactctatgaaaacttctaagaacagtttgcctgttcattatttatgccaatgcctataacttaaaagtaaattattcctattttgcttaatttaattttattatatataagccatttgataaatatacataaacactttcatagttatgtaacatttactaatatagattttaaagcacatataatttgtatagttgccatgcaaacatcagactatcaaatattgataaactggttactgatagaaaatccagtctctacatttaagaaagagtttttttcttctaattacagaaggagtatcccttctctgaaatgctcgggacaagaagtgtttcacattttggattatttcagattgtgggatatttgcgttatacttaggttcagtattcctaatccaacatgcctcaatgagtacttcctttgagcatgatgttggtgctcagaaagtttcagattttggaacattttggattttggagttctggattcgacatgctcaacctgtattattttcttatcaacttcaccactttattgtcttccacagtcaaagcaaggtatgagtcaaagatatcaaacttagagggaagaaaatcccattgaggctactgtctatgcataaacaaaggaaattcaaatatcaccacataagttattacaaatttacatattaaaacatggatcaactccccttttctaaattggcaactataattccactcaagtgacaggtttgtatacaaataagaggataagctgttagcagttactgaacactgagaccaaatcataactcaggattgcaaagtgctcatgaatgtggagagatatagtcattgcctaataattaattttaattttttaccaaaattagacttcttataatttcattaaaagtcacaaaagaatcaaatcagtataatttttaatttactctgaaaggcattttctttacattttcctaacatctgtattattagaatatctttggccttatatcattactaaataatgagatagttgaaggaaatgacattttaggagttctaaatgagggacatatctcctccatattccataatccaaaatggtgccttcttgaggaaggataaatgtggagaagaaaggagaggggagcctgcttaatgagatgcagctggattcatagtgtggcctgatagtaagtcccaaatcaaattcttactcacatgcttttgagatagcctcccattagaacccctttcctcttttcccaccccacatacttagcatggcagagggtaggcagatgccaggtgtattttattatgaggtcaatgagtaacaattctgttcctctctcttttgaagcctgttataatacggctacaatgttataaagcaatcatattttattcttttccccagcccacatcatgaatgttaagcaaaaggggagactgaatattacattgaggatgaactgcaaaatactaaagtcccttatgatagtgtttaatcctttattgatcaatgtttcacaaaggtgcattggtcattaccactgctgtacctttggttagatccatttatctgcctggaacatcctctcatttctcatttatctcacttatatcctactgatatttccagaccttgttgaagcccaccttctacatggaactaattttttttttcttgagacagagtgccactcttgacgcccagactggagtgcaatggcaggatctcagctcactgcaacctccacctcccgggtacaagtgattctgctgccccagtctcccaagtggctgggattacaggtgcccgccaccatgcccagctaattttttgtattttttgtagagacagggtttcaccatgttggtcaggctggtcttgaactcctgacctcaggtgatccacccgcctcagcctcccaaaatgctgggattacaggtgtgagccaaggcacccggccgctttctaattttttaatctactttaggtgaatcacaccctcctttgatatcttcctgaatatttcctataccttgtgatagagacagcagagtatagcacagtctttcccaaaatatctttctaatatccttatttgaaaggaaatgttgaagacttaaaaagcatattgatgtgtggaagtctttgaaaagtccttgagtaaatgaagaagtttgttcaactttttaaaactgaacatttcttaaacttctacaacaattgcatctttatttcatgtaataaccttcttgcaaaatacactggagaaatagaaatatatacaggtttggggccagacagacttgagtttataccttacttccatggcttaataaaccatctcattacatttacttaaatcactttaagcttctgtttttgcattaggcataaagaaatgtttcataccagtaggtattccaaaatatgcttcttttatattgtttctccacaggccctgaaattcaattgttttatgcagtttagtgtgttttcttctacagagcaggatatatgttgtgtgcatcttttaaatattaattacaatcttgcacatgataggtgtgggatagattatttctgcctgagtaaagctttatagtgtggctacattgtttagcatttctgatgtagaagatatacaacttttagattcattaacaaaaattttttacattagttctaattttgaatgcccgatgtcattattctcttacatcaaccatatatttgagagttggtggattgttgggttgtctatctaatttcatgagtatattcaatctcagttattcctcatgctgaaactgtcttatcattattgttactgctaatgcatgtcagaagatcacgtgattctggtggtgctgtgactatgaaaatttcataattcaagatatttataaaatcacattatgggaggattccttaaatagtggactctctttaataggcaaactcacacctacaaataaataactttgttttagccagatatgtagtctttatctctgagaaagtttggattgtggttttgaaagatgattacttttggttttgaattcatttcttacaattagtctaatgatccattctttcctggagggcttaatttgtgagttctgtcctctgtaacaacatgaaatctccttgaaaagaacaagttcagtttatttagactgaggccattgcaataaagaacaaagttcagtttgtgctgttctctaagtgccatagataaaattattctgattttccccaaggttaatgggcacagggtgacatttaaatgatattgtaataatctaataatttccagtgctaattagtacaatcccaaaccatgagtgaacataattaaaaatgttttctctttttgagggtaagtaccataacttcacaactaatctaatggtaggtgcttcattacagtttatgcaaacattgaattttactataaatatttggataaattatattccaagtagtactaacagtcaattctcattttttctgcattgcctgctttatgtagagcccccacacacagatcagtgaggagctgctatgtctcctgtgcccggtaggcccgacctagaaacatgaaggaacatagatgggcaatgagtatcatgagaagaacctgggctttggagtccaaactggatttgaatcttggctctccaaaccacattttatttatctatgatgcctgcctcacaaaattttagtaaaaattcaatttatctttactaaggctatattaaaatatgtaatcgttttacatacatcatgtatatgtaaaatgcctggcagagtgccctgatgctaagagctctcatatacatagttcccttttactatgaaattttactacggaatcactttacagtcttatatttatcaataataagtaatgtaggtattctatttatagttctaaattacccaggcctactctttttctcttggagtcagctgcatatttgatagaatcttcttcccatgactttgagactgcctcatgagtggcagtggcctttgtggagtaactattatcagagtgatttggggaaggattaaattgtcatccctccaccatgctccccgtttctagtttaatggtttaaaaaatggttttatggttgttaggattatgtgctaataatattagttaagcttttagaaagtttggaaagtgagaagctgctaaggaatggaatgagttctctatgtcctcaactagaagctcttttcccctccactacttgtttgtggtatccttcaagagctagtaggcttattaacttttctgcctcagtaatgtgtgcataatatataaactaaagaagtgctgagctggaaaattgattttatgcttatagtggtttaaaatttctaccaagcctaataatattactatttttttctctaagagctactattttccgttgcaaaaatagcaggagaggattatgtatagttctaattttaccacactcctcctgaatacaattcttccagaaacacttaatgcttttttcttttttattctttaatgactgcctagtatattgtctcagtattataagtctctttccttaccagattttcagcatatgactaatgagggaagccagtcaactcagatcattttttatttctgagatttatgtaaagttaatgacatcttaaatataattgtgtcaaattagtcagatatttttctgtatcttccttctagttccaacctactcagttacctttacttctctctacaccttctcatggaccctagtgttcagctaaatgaaatacctatcagtgcgcactccatacattatctacttccatgacttttcttacgctgttcctttctcaatttgtcctttctttactctttaatgtcttacttctacctattcttcaaggttctacttaaactatattcttctacataacattctttcatctatccatgatttctgaatctcttttaatctttatatatttaatccaaatacatggattatgtcacattttattacatatttggaaactcatgggtctgtcttacccttagtcctagtctatacaccaaatgaaataagaaattatgtctgtggtatttaatacttaggtttcatccatatggggaaaaataaactctaagaatcagacaaaaattattttaaataaggctaacttatttagaccatagtcatacccatatgaaattaatgtgatttaattaattactagtatgcacagaaaaatatgaggtatgaaagctgattttaaaaaaatcattgttgcccctgagggataaaattttaatggagaagaaagacatataagcattacattagtacaaatcaaggttgatagacacttaaacaagtgccaatagagcacctgataatatcgagaggagaggtcatttcatcttaaaattcatgataatataaagcattcctttttaaatgaaattgaagaaggccatctctttagagagtagaagggtttctatcccttatcagtactgagaacaatacagttttgaaaataaagaaatataaatttaacatctaaaagaatctcaagtgctctcttcggcagtacatacactaaaagaatcttaaacattcctaaggcaaatgtttcagttaaagggggttaaccaatacacttaaaatgcaaacattactttgtgaaacatgttgaaattaaaaataataaagccaaactatttggaatgtcatatatttataaaatatatattttcgtgctacaaggccaaatatatttttttctttccagtcctaaaatatgccctgtatcgtcagtgtagtttgtaggtctgttcatcaaaagagtgggaagtatatcatgccagaatgcatttgctgttcccctatcaagtgatcaccattgttattggctttagaattattagcttctgtacctggatctgaccttaattttaaccacaaatgtgggaatggttttgacaaggcatacagttttggcaagtcacctcacttgggtactaattacttctgggtacccagttactcctgggtcctaattttatctttaaatgcttgttatgttacttattactttcatatgagaattttgataatatgttgtattaaaaaattattagttttatagtgatcaatcaatgaggaaattctctgaaagtgatgtttctttacaagaaaagcacccaggctggaaacaatataaacattgtaaaaatatgtgaatcaacactgtcaattcatattatttttcttagtatagttttagtttactgaattcatatgcttgctaagagctagaagctttatatatattcccactttatatgacagtataagaagatcaaactattatatcccacaggggaaatattttaaatctttcacaattgctggttttccccttaacacaatttcttgattataacatttaagctattatactgctatctatctatctatctactaaattttatctatctatttatctatccatttctatagctagactataatctcttcaagactggtatctgacttcagtttctactactagttcctaacgcagcggtacagttcctggcatatgtacatactcctatagtgtgtgctaaagaaaggaaagaaattaacaagtctttttctcccatgttgtataagcccagtactagttgctctcagacactagtgaataatttattactgttcatagtttaaagaatgctgataattgagtgtattggtttgttattgctgtgtaacaaattaccacaaacttagcaatttaaaacagcacatatttattaattcacagttttgtatgttagaagtctggcactgtgtggttctctcctcagggtatcacaaagaagaaatcaagtattacctaggttgagtttacctatacaatccctatgtgtaagctaggaatatttggaaacagtggaggttcatgtgttcttcgctgaccgtttatggttttgaaggcctaagaggtttcaataaactatgtcgatatgcctagcagctggcgcaaaatttttggtgaagtatttacttaatttggggaggtatgtgtgatgcatgttaagataaaagtaaagctgctcaatggagagcatctcaaaatatgattttcatgcatagaaaaaagctaaaaaatattattcaattcaatatggaaatatttctgtttttttttaagatggaaaatgatgccccagagtcattattctgcatagcacgtaactatctaattgcatttagagaaataaaataaagtttgccaacaacgaaaaagggggaccagaaaatttgttgacagcatatccaatgaacacagtttcggacaataggatgcatgttaagcctgactggatctattcattctcctgtcaacagctggcatgcctccttcacaatggcagaaaagctacaggaagtttctctttggaaaacatgttgagaaattttcttgtctctctatgctccttactgtacactgagatatttttctagagaatgagtgaagaaattatgctattactatagagtgataactaatttacactatgtaaagggatagcacagatattgttttattcacactaaaagcaaataattggaagaatttctatgtaactatgaaaactagaaataaatggtgctaaaatgtgcaaaagatgatacattttcaggcacatattacagagtttcactcaaagtatgactagtatgtgaaatgctggtactcagttgtggatgattttcactgcagtggttaggtaggaaagcttactattaaaagtttttgaatcttatatccccgtttctgaagagctgcccactctggagatttgtttcactgtgattaacattgtacctctcatttacttacttgtcagaggttttattcagttagtatctttttctaaatagttacaccttaaaagtttaaaaatgatcagatttgtatttgattgttcactacttcacttgcaaaaacaagtattacagaaaagtaatatgttaacattagtttatgtatgaaataacctgcaataccaccaaaacttatcggatcagataacctccagttgacattagcaagctttctaatggtgtcatttcttcttttttgaattcctttataattccctctgacatttttaacttcaaaattatattcttctcaaataatagaatatgttgttttctactacatataaatgatttaactacacagtggtttttcttatttttgagttagatacctgataggcttacatttgccacttctataggaaaatgtgcttgcttagattcacggcatatttgaatatctatagcattactgaactgtgatgatttctgctggttcgtcatatcttaattcaagaaggatacttgggaatttgttaaatatttgcgctaataaatctaattgcatttagagaaataaagtttcatcgggaaaataggatgctagagcttgcagcttttcaggacactcttcaattagtgatttataaaagcatctacaaggtgaagtcaaaggcagataaacctcagatatgatctcttgccaacaattttgtctcaagaacttggtatacatactttaagtattctttagaagtcttactacactattaattttatgattgttgatatcttttaaaatattcaatcatataatcgtattttatctatctattcaatgaatttctactacttacctaatatgcgatgaacacatttctttgcattggtaattcagagttaacacagcaaacaaaaccccttgccctcatggaaagtgcatttgaaagagaaggaaataataaacaagagatatatagttaagatatgtaatgcatcagatggccatataaactatgaagtaaaataaagcagggatggcagaaagggattgaaggcagaggctgcagttttaaacagggtcatcaaggagggtctcactaagaagttgagcaagacctgaagcagttgaggagaagctgtgtttttctgtaagagaaggagcattacaactagaaggaataacgagatcaggactgctgagatgggaatatactttttgtattgcaggagcaacaaaaagacttgggtaactggatgtcagtgaggaagaggcggaatactaggatctgaggtctgaaatttaacaaagtgtctgattatagaagactcaataagccctgggaggattttgacagtttctacaggtgtgtcgagatgccattcaaggctgccctgacatacaaagaaacttttacaacaatcttttgtctccccatggtttctctcaagttttttgttggttcctcagatatgtgctacctttattcttctgaagtttctgaatatttgattttggtggcgggaatgaggaactctactagtctgtcatcttgtcagaacttgaagtgcaaaatttcattaaaaaatatgtattttttcagttttatttcaagttcaggggtacatgtgcaggtttgttatataggtaaacttgtgtcatgagggtttgttctacagattatttcattacccaggtattaagcctagtacccattagttacattttctgatcctctccctcttcccaccttcaccctccagtaggtcccagtgtctgttgttcccctccatgtgaccatgtgttctcatcatttagctccaacttataagtgagaatgtgctatatttggttttctgttcctgcattagtttgctagagttaacagcttccagctccatccattttcctgcaaataatatgatcttgttctttattatggctgcatactattccatgatgtatatgtaccacattttctttctttttttaaattcccaacttttaagttaaagggtacatgtgcaagacatgccggcttgttaaataggcaaaagtgtgccatggtggtttggtgcacagatcatcttatcacccaggtgttaagccaacatccattattcttcctgatgctctctctccttccaccccacaccctccaacaggccccagtgtatcttgctacctgacatgtgtccatgtgttcttatcatttcactcccacgtataagtgagaaaaggtggcacttggttctctgttcctgaattagtttgctaaggataatggcctccagctccatccatgtccatgcaaataacatgatctcattcatttttatggctgcatagtattctatggtgtatatttaccatattttctttatcctgtctaacattgatgaatgtttaggttgattccgtgtctttgttattgtgaatagtgctgtaataaacattcacgtgcatgtatctttataataaaatgatttatattccttcgggtatatacccagtagtgagagtgttgggttaaatggtatttctgtctctaggtctttgaggaatcaccacattgtcttccacaagggttgcactaacttatgttcctaccaacattgtaaaaacagtccttcattttccacaaccttgccagcatctgttgtttattgactttttaatgtctattctgagtggtgtgagatggtatctcattgtcattttgatttgtatttctctaataatcagtggggttgatcttttttcatgttttttggctacatgtatgccttcttttgagaagtgtctgttcatgtccaatgcccactttttaatgttttttttccttcttgtgagtttaggttccttatagatgctggatattagacctttgtcaaatgggtagattgcaaaaactttctcccattctgtaggtggtatttttactctgttgatactttcttttgctgtgcagaagcgctttagtttaattagatcccatctgtcaatttttgcttttgttgcataacttttgatgttttttcatgaaatctttgcctatgcctatgtcctgaagtgtattgcctaggttttcttcaagggtttgtttagtttaccactttacatttaaacatttaatccatcttgagttgattttcatatgtggtgtaaggaaggggtccagtttcagtcttctgcatatggctagctagttctcagagcaccatttattgaacagggtatcttttcctcattccttgtttttctcctttatcaaagatcagatgcttatagttgtttagtcttatttttgggctctctatgctatttcattggtctatgtgtctgtttctataccagtaccatgctgttttggttactgtagccctgtggtatagtttgaagtgagatagcatgaagcctttgggtttgttctttttgcttaggattgtcttggttatttgggctctttttggctccataagaattttagaatatctttttctaattctgtgaagaatgccaatgtgagtttaatgggaataatattgaatctataaattgctttgagcagtgtggtcattttcatgatattaattcttcctatccatgagcatgaaatgtttttccatttgtttgtgtcatttctgatttatttgacagtggtttatagtttttcttgaagagagccttcacttcccttgttatctcctaggtattttattcttttggtggcatttgtgaatgggagatcatttgtgatttggtgctcagcttgtctgttgttggcatataggaatgctactggtttttacatatttatttttatcttgagactttgctaaaattgtgtatcagtttaagcagcttttcaactggatgacggagttttctagatacagcattatgtcatctgcaaacaaggatattttgactccctgtctttgtatttgaatgtctttctttctttcttttgcctgattgccctggctagaacttccaatactatgttgaataggagttttgacagtggacaagcttgtcttgtgccggttttacaaggggagtgcttccagtttttgccactcagtatgatattggctgtgggtatagcatatatggctgttattattttgaggtatgttccttcaatacatggtttattgagagtttttaatatgaagggatgttgaattttatggaaggtcttttctgaatctattgagataatcacatggattttgtttttagctctctttatgtgatgaatcacatgtattgatttgccaacaaagatcaaaagagacaaagaaggccattacataatggtaaagggatcaattcaacaagaagagctaactatcctaaatatatatgcacccaatacaggagcaccaagattcatagagcaagtctttagagacctacaaagagacttagactcccacacaataataatgcgagactttaacaccccactgtcaacattagacagatcaatgagacagaaagttaacaaggatatccaggaattgaactcagctctgcaccaaatggacctaatagacatctacagaactctccaccccaaatcaacagaatatacattcttctcagcaccacaccgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaaagacataacataccagaatctctgggacacattcaaggcagtgtgtggaaggaaatttatagcactaaatgcctacaagagaaagtagaaaagatctaaaattgacaccctaacatcacaattaaaagaactagagaagcaagaacaaacacattcaaaagctagcagaaagcaagaaataactaagatcagagcagaactgaaggaaatagagacacaaaaaacccttcaaaaaattaatgaatccaggagctggttttttgaaaagatcaacaaattgatagactgctagcaagactaataaagaagaaaaaagagaagaatcaaatagatgcaataaaaaatgataaaggggatatcaccaccgatcccacagaaatacaaactaccatcagataatactataaacacctctctgcaaataaactagaaaatctacaagaaatggataaattcctcgacacatacaccctcccaagactaaaccaggaagaagttgaatctctctgaatagaccaataacaggctttgaaattgaggcaataattaatagcttaccaatcaaaaaaagtccaggaccagaaggattcacagccgaattctacctgaggtacaaggaggagctggtaccattccttctgaaatgattccaatcaatagaaaaagagggaatcctccctaactcattttaagaggccagcatcatcctgataccaaagcctggcagagatacaacaaaaaaagagaattttagacatttattgatttgcatatgttgaatcagccttgcatcctggagatttgtgtatgttgaaccatccttgcatcctacttgatcatggcagataaactttttgatgtgctgttggattcggtttagcagtgttttgttgagtattttcacatagatgttcaccaaggatattggcctgaagttttctttttttcttgtatctgtcagattttggtatcagaatgatgatggcctcatagaatgagttaaggaggagtccttctttttcatttttttttggaatagtatcagtaggaatggtactggcttttctttgtacctctggtagaattcacccatgaatctatctggccctgggctttttttggttattaggctatttattactgcctcagtttcagaactcattattgccctgttcaagcattccgtttcttcctggttcagtcttgggagagtgtacgtttccaggaatttgttcatttcttctagattgtccagtttatgtgcacagacgtgtttatagtatcctctgatggttgtctgtatttctttggggtcagtggtgatatctcccttatcatttctgattgcatttatttgaatattatttcttttcttctttattattctagtgaggagtctattttatttttttcaaaaaaacagcttctggatttcagttttcgaagggtttttcatgtctctatctccttcagttctgctctgatcttgattatttcttatcttctgctagcattggggtttgtttgctcttggttctctagttcttttgttgtgatgttagagtgtcaatttgagatctttctagctgtttgatgtgggcagttagtgctataaatttccctcttgacactgctttagctgcatcccagttaatctggtatgttgtttctctgttgtcattagttacaaagaacttgtttgtttctaccttaatttcattatttacccaaaagtcattcaggagcaggttgttcaatttccatgtagttgtatggttttgagtgaacttctgaatcttgagttctaattttattgcactgtggtctgagggactgtttgttattatttcaattatcttgcatttgctgaggtgtgttttacttccaattatgtgattgattttagagtaagtgacatgttccactgagaagaatgtacattccattgctttggggtagagagttctgtagatatctatcaggtcaacttgatccagagctgagttcatgtcctgagtatctgtgaatttactgtctcaatgatctagtattttcagtggggtgtgaaaggctcacagtattactttgtagaagcctaagtctctttaaaggtccctaagaacttgcttatgagtctgggtgctcctgtattgggtgcatatatatttaagatagttagctgttcttgttgaattgaaccctttacctttaggtaatccccttctttgtcttttgttctttgttggtttaaagtctgttttgtcagaaactaggattgcaacccctgctattttcctgttttccatttcctgggtaaattttcctccaacgcctatgtgtgtctttgtatgtgagacgagtcccttgaagacagcataccaatgggttttagttctgtacccagcttgccattctttgtcttttaaatgggggcatttatcccatttatatttaagattagtatttttatgtgtgtatttgatcctgtcatcatgatggtattataactggttattttgtacacatgtttatgtgattgctatatagtgttactggtctgtactttagtatttttttttttttttttttgtggctggtaatggtttttgctttccatatttagtgcttccttcaggagctcttgtaacacaagtctggtggtgacaaattccctacacattttcttgtctgaaaacgacctctttctcttatgaaaggatctcctctcctttatttttgaagctgagtttgtccagatatgaaattctagattggaaattctgttctttaaaatgttacattttgccctccaatctctgggttttagggtttctgctgagaggtccactgttagtctgatgggcttccctttgtcggtcacctgcgttttctctctagctgctcttaacactttttctttcattttgaccttggagaatctgatgattatgtgtcttggggatgatcttctcatggagtatcttattggggttttctacatttcctgaatttgaatgttggcctttcttgctaggttggggaagttctcctgataatatctagaagtatgtttgttaaattatttccattatctttatctctttcaggtaccccaatcagttatagattctgtctctttagataatcccatatttcctgaaggttttgttcattcctttttctctattcttgtctgactctcttatttcagaaatatagtcttcaagttcagaaagtcttgcctcctcttgacctattctgctattaatgcttgtaattgcaatgggaaattcttgtagtgtgtttttcagcttcatcaggttggttatgttcctctacattgtggctattttgcctgtcagcccctgtattgttttaccatcatgcttaggttatttgcattgggttacaacatgctcctttagctcagcaaagtttgtttttatctgcattttgaagtctacttctgtcatttcagccatgtcagcctcagcccagttctgagcccttgctggtgagatggttcagtcatttagaggaaaagggacactctggctttgtgagttttctgtgtttttgcaatggttctttctcatatttgtggacttatctacccatgatctttgattttgctgacttttcgatgggtttttttgtggtttttgttgttgtttgtttttatgtttatttgttttagccttgctgcagtttgatgggggtcagctatagaccctagtcacctcattttttcccaaacctggaggtatcaacagtaaaggctgcaaaacagcaaatatggcagcctgtcccttcctctggaagctccattccaggggatactgactggttgccagcctgaaccctcctgtaggaggtggctggagtccttgggcaactcttcagctcccaatcctttagggctctcgaaggcccacagtctggaccagctgagatatttgaacagccaaggtggtggccacccccgttgttctccagacactccctcccagagagaaattagaactgttggctcttgaacatggacagggtggccagaagccctggctgggaggaccctcccatgagaaggagtggatcagggtcccccttaaagaagcagtctggatatgtcttgacaaacagctctgccatgctaaggaaccgcctctgcccattggcttggactctccaaagcccacaggctggaatggctgagttgtctaaacaaccaaggtggcaatctgcctttgcccgagggcactctgtaccagagagaagtcagcactttatctatagaatatgtgcaggcaggcatggctggagaccccagctgggaggtcccatccactgagaaggaatggaccagggtcctgcttatggaagcactccagccatgttctggcaaagcagctgtgctgcactgttggaatccttccttgtccggaccatttggactctccaaaacccacaagctggaatagctgattggactaaacagcagatatggtggcctggtccctcccccagagggctccatctcctctcaggcaggctccactctgttgctggtggctgctctggattccaaaccagtgggtcttatcctgtgagatgctatggaagttgggcctgaagactggcactgctcggctccctggattcagcccccttcctagggacatctcctaggaaggaccttctgccttgcttgagctgcagacaaccttgccagggttcctggggctggagtatgtaaagctcctggatctctgcatgtgcctgagcatctggtctcctgagactttgcccagcttagtgtgtcagacactggtggcatgggcccatgatgggacctcctgatccatggtttgcaaagctctgtggtagaagtgtggtttcctgggatcacacaatcactcatcgcttcccttagctggtattggagatcccttggctctgttgctcctgggtgggccattgctcctgggtgtgccgttgccccaccctgctttttttcattctgggtctgggatctgttctagcccctcttctttctctttgggctattttttaatatgataacatcttgtctcagatttttaatttccaaaggtaccttgattactttcaaatatatgtctgcagttcagacatctttctcttaagctccattttctacatatttaattgccaacataaattctccattttgattttaataggcttcagaagcatagcatattcgaaagggaaccattgatttacctcttgttactttgtcagttatcactgtttctgtaaaatggaatctccatcaactcagtgatcaggggactggaagtttctttgtggctgaagaacagatgtaatggaatgagtcttgaaaaaaagactgtgtagagtgttagataatagatttcaagatttctcatatagagtatacaggggatgtcagggacctgtcactggctgtgggtttagtggaggtataaacattaggattaagaaaaatgagattgagttgttactaaggtaaataagtcaactgttatcaccaaggatgatggtaggaccgaggacagagagaaagatgttgaaccaggtttcaatttacaaaatgaacttagtcatctgggcaggaggtagtcaagtgacagtgatgagaaggatcagagggtaggacagttaaatggcaagggattcagaagagatgattttactccataatggaagagtaactgtttggcattgtttttgaggagctaagcaatgttagctggttgtaacaggacttggtatgtgaaaaaataaatctccagttgaaaggactacaggaagagcaaggtcctctagagaaagctagaatttaataaaagctaggattcttctataaaggagttgaaaatattaatgaaatggaattaccatggaattaggtggtcagagtggagaacaattagcattgtgtaaaggtatggtgggcttttgtcaaaggaaaaacaatataaagaaaatgaggagctgatgaatggttagagatatacattttgggcggtaagcaaagatgccagtggtgaatcacgatgggattagctggcctcaaagtctcagtgagaatctcacataaattaaatggtgttttttccaaggttcaagtgaagatttgggatgacttactaaaattttctgaaacttagtttcttcttcttcttcttcttcttcttcttcttcttcttcttcttcttcttcttcttcttcttcttcttcttctttttcttattattattattacactttaagttttagggtacatgtgcacaacgtgcaggttagttacatatgtatacatgtgccatgctggtgtgctgcacccattgacttatcatttagcattaggtatatctcctaatgctatccctcccccctccccccaccccacaacagtccccagagtgtgatgttccccttcccgtgtccatgtgttctcattgttcaattcccacctatgagtgagaacatgaagtgtttggttttttgtccttgcgatagtttactgagaatgatgatttccaatttcatccatgtccctacaaaggacatgaactcatcatttttatttaaaatggaattattaaaagatagagcctctcaggtctggctgcctaaagcttgaaaagctacctctttaataaagcaaaagatatatggaaaacaacataattaaatagagaataacatcttcagaaatttatggaagcatggcctagtgactcacacctgtcatcccagtcactctggaggctgaggcagttgcttgagttcagaagttcaagaccagtctgggcaaactcatttcaacaacaaaaatatcattatctatctatctatcaatctatctatctatctatctatctatctatctacatatttgaattcttgtaattaccattttgacatgcatcatatatattttgttcaaactcttaataatgtagtaccagattacttcatcattagatcacaattttcaaaacactgaaatgcacatcgaggtcactgtaaattttcatctatttaccaaaaaaccagaattcacagatacaaatgtttgccaatttgctttatagcttatgttaaaggaaggaaacttgtttcttttttatttaaacaacaatattttttgagttttaatctgaagtcttaagatatatatcatagtagaagatcccgagaaatctccttatgtttcccttatgtacttcaactatggtcttcatacaccaggagggcataagaatttatccaaacgtgacttttattttattttttttaacttgagctctgtggtaaattacttaatatcaagttccataagtaaacattcttgctggacatattttgacttttagataatttttcaatatgtgtttaaaaggccacagtgtatactctatcatcgcttttaacatggcccacaaatcatttataaattattcactctttccagctcttttttgtttctttttcttcaaaagaggattactacattccatgtcttggtgtcaaactgtctaagaaaataaattaagaacacagtttgaaggcattcactgtttttctctttccctaacacattattccaaaagcagaatattttttctcaagaatggactacatttttaacatagatacagtttatataggataaaaactataggtcttggaacccagagagttttagatttaagtcctatatcatgtatgttttagcatgtgattaagtaattcatctaacttttctgattcttagtctcctcaactgtaaaatgaggattaagagagataacctacaaaaatgataaagtttaaaaacattatttcttttttcttagtatgaataaaacttacagtggcaagcatacacaactttgaccattttgtaaggtttattttctagcaagttattattaaaatactatttagaaattgatttttcttaagtaattgatatacaaaatgtcagagactgtgactatgatacagatcttaaaagatgaaactgagtctattatactatatatgtatacatatgtatataatatatatattttatatatgtgtatatattttatatatgtatatgtattttacatatatattttatatatagtataatggactcagttaatttcatcatatctacatatatacatataaatatatatatagtataatttgctgttatatatattgcagctaataaatacctagaaaatttgccgtccttctgagggaaactcatgtctcctttacagttgtctagtctacagttataatagaatttctgttttcttaatgcttttgaaatattttacatggcaattccctggaaatatctgtatattttataggacatattggaaaaataatcagtggatatctgtaaaatcttcattgttgctagttaaatgtacattcatgtaataaagaagaagaaaaaaattacaaatgagttcagagttaataaattatgaagtttgagatttatattggaagagtaccattttcctacctgaaatattctacaggctgcaatctgttactttagaactaaaacagtagtttacagaagttttaaaatgctcaattacaagaaacttatttattttggcccattcagataggtaaaatgatttttcatctcaaagtagagtaaatttttgtcttaaacataaaattagaatttttactctgtagaagacagcctacactatattatttgtgtgcaaaatgagtttgacccttctaagaggatcacattcacattatggtttcatacagatatttctttggcatatgattttacttatagtagtataggccaattctcacattttttttgtggaagttgaaggtaatactaaaaaggtagagtaaattgttacaagaagaaaaatgttaaatctgttcaatttctaaaaatatctgcaacttttctccatgaacatacttttcagtagctaccttatcagctttttgcctatttgtttttttttttttttaaatgcatcaggtcagtttgggaagaatttgaattggtgtgcagtgttcaaagtgtctattgtcaaaccaattctttttgttcttgtcatggcagaattttgtaataataggatattgtttcaattagatgtatgcaatagagaaagagactgcaacatagcacacaaggttctggttgaatcttcacggattcagtaagaagagatgtaaactaatttagagttaaacattgctgcctttatacaagaaaaaatccagatatttgagctttcactgtccagtccccccacccttttttttttttttttagaaatagtcacaagtactctttaaaaaattgcaaagtattcctattcaaagaattgatctttgaaatgtttattcactaaactagtataaaatgcataaactattctgagaggattgatattccaacatgaaattattttaaaaattaacctcttactatgctccatgtggatgactcagcttacctgttccttaggcaagcaccctacatttccttttctcccacatacttctggaagacacacagcagtcagacttttccagtgatagtattatcagtttaaatgtgctttgggtttctggataactatacaggttttccaaacgaaatgtgatttcacatgttattggagagtaaggctaagaaaagggtcttgtgttagaatgaagaatccctttgaatttgacttatttcacactatgagcaaatgtcacattcaaacataaatctctggagaaatctctggagacagtactgaaaatttctcttcttggtctatgatttagaccttctcattttaagtcactatatcaaaaatatattgaagaaaacagaatttaaaggtgtctgaattattaaaaatatttcggacactagctaaatgtaaattacaatgcacattcaaggatttctgtataatcattttaaatatctgcgtggaattttctccttccactcatacctttctacactatatcataactaataccctctgtgatcttgacaatatcctctttgaacttgatttcctatgtttaaaataaaaatgatgctttcctataggctaactaattatggtgggtggaatggaagttaatattataaggcactttgaactctcagaacaaagtgctaagtaagcactagacagtggaaaataacgagccagatagtttctgtacctggccacaatttgaatattatagacctaagtaaattatcaatgttccttaatatataaagtcaataactttatatattttatacaatttttattttatattttattgtcactctcttaggattattcgtcactaaagtaagcaacaacaacaacaaaactccttagaaattgaaaggctagagatttgttctgaattctgcatttaaaaatatgtcatagtccatattctattggaactcacttaacactattccaaggtaactgcaaagattgttatttaaactaaggtttagaaattcatatcaatttacatctttatatatattaattatccctaaacacccttaaatataaagtttgtataaaaacaggtaaatcaacttctgatatagtataaattaaatcactgagacaaatattgaacttcaaagtatgcaaaaagtactagaaattttataaaaatatgcctaattaataaaattttataaaacaaaatgtaagactgaaacctatttgagaattttaatatacaataaaattttattataattattatgaaatgatgggtgttgtggcttatgcctgtgatctcagcgctttgggatgcagaggtacagtgatagtatagtttctcaagtgaggaacacttgagctcagaagttcgagataagcctgggcaacaacgtgagaccccagtctctacaaaaaatttaaaaattagccaagcttggttgcatgcccctgtagttccaactactcagggagcagagacaggaggatcaggtgagtcggggagattgagactgcagtgagccatggctgtataattacactctagcctgggtgacagagaaagactctgtctctctctatatatattattatgaaagtaaaaatatacatattattttcttatctggaaatttgttttaatgtatatattgccagttattaagcttctagtgttttcagaagattgctaagaaactgagagctgtggattctgcagcaattattactagcttgggcctagggaaagttacttaacctgagtttcatttccctcaaagggtttttatcagaactaaataaaataatgtctatgagccacttagtacagttcctagtactaaaaaatattaactgccagtgtttctaatatttcaattattataaattggagagaaacacaacagagcacaattgtctctaattcagaataatatttgctaattgtcatgaatttgatgtatatccagcacctcctttccaacaattagagtcattgttttggtttccttctttagtcagtcagagtgcttgtgaagggttagataagatgaactgagaaaaatatacctcatgataaaaagatacagggttctgaaaaccctatttcatgcctgcaaggatattagcatagaacatattaggaaatgttctgttaaataagaggctgctgaaacatttgtaatacagaattaaattgtgaatgatatatcaacttaattaatatttcctgagcagataataattatatatatatatatacacacacatacacatatataatatacatataatttatatataaacacacgcacaaataagcacatttattacatacacacatatgtacattcattacatatacacagttgtaatatatatgtgagtatgtaataaatgtacctatttgtgcatgtgtaatataaatatataaacatgaacatgtattacataaatatatacacatatgcatatgtgcatatatatgtgtatatatttatatacacatatatgtatatatatatatgtacaaacattgccttcaccttcattgtaatgatatcccactgaaatagtagctgatactatgctaagtgaagatgcttattggtgtcaaagatactatctatgcttaagtaaagatactaaattgtatcaaaaacgctaatctcttttggtcataatactgctaatttctcttactacctagtagttttgaacatgcttaacattttttctccttgaactgagggtaacatgaatgagacaatgaaataaaggagaaatctgatttttacaatatttataatgccttttattatttgccctccttttaaaatgcctgtataatttccactggcaattgtaggaatgccatttgtagatgaaaaaaatgttataaatctcttgacttggatatatgcttacagtgcaactaacgtgtatgcaaaatgcattgtcagaattaaattaaaaactcacttgtgaatagtagcatctaaaacagaaaggatatatgatgatttaacaattctgaatagctctgcagaactgtaaatcctactgtgactaataaactccccaaggcagaaggttgcacttttttctttattttaacttcctaaactaaagtttttgaagcttctcaggcaaaggaattaaatttcatgtaaaactagtcttacgatcagcattttactacatttcatcaattttataaccttcatggcttaaaataaatggatttaatatgctaatcatcattatagtactatttattgaatatatatgtatatgtgtatatgcacacacatatatgtactgatgtaccctctgtctatatatagccaccataaaaaaaaatgcttaaagtgaaaaaagcataaaatggcagacatagctccaaacttgaaacaaggacacctaacctcctactctacatcttgtaacctttggctgtgtaatttgggtgaaaacatttaaaatgtttgcactacaatttatgaagcatgagaaggttttcataaaccatctctaaaattcctttcagctatgagtttacaaaaacaacatgattccttcttttcatgatcttcttatggcatcttatttccactatggctttattaaacacttaacccatttcaaatatttggccactaaataatttgttaaagagcacagtggcttggctttgatggttttctctgtgtttaggaaagattggtttgatgaatagatggatgaatggctggatgcatgaatgtgtgaacacaaagagaaaaagtgaggggaaaaatttggggggtagagagagtgagagcatgcacaaaagaatcatctctgttgttaaaaagaaaataaaagattcattgcatgtagcatctttgctaactttcagttaagtttattccttttatgattacctaccatatataatttatatgttagtcaaaattaagtgagtaaagagattaaaaagtttgaactttctgactaaaaaataaagatcagctatctttgattttatttggaattatgaaatccaacgaaatatttatgcacaaatgtttttatataagtttttctagatgatatgctattgatttgcaagaggaatgtagatgtgttgatgcttggtttcaatatttagagtcttttattttaaacacaacttgataaggttgttatagaatatgtatatcttccaataattctattcgctgtggaaaatttcttcaagatatatcaaattttttctcaatattgttagaggaaattatgtgcaggatgaacacataattttttctctactatcttatcaggtaaataatgtttactccacttgcctcttaaatttataagacacaaaattttcaatattcaaactaaaatgcaagtttttagtatgattattaattaccttgtgtatgattattaccttgctaacttgggttttctggaatcgtaataatgcctgtgacaacaaattaacatgcaagtacattttcaagtctacttttgttttaatttaggtttaggtgtaacttatattttatccatacatctgaatttaggtattttattttataagattatatctattttataagattatacctaatttaatgttaaaaagatttaatcaatgattcttgagtgtctaaactattcaggctcttttatacacagtgtaagtataaaaatagattatatggcctaggaaattatattttgctaattgataaggactacctctgtggtagaggaaacaccaaaaataaaaccaagaaggagaaaaatcttcgaatgtttggagacttgttgagttggttaggttagtgaacttataaatattttatttaaaaggcatatttgtgaatgtatttttgggtgaaatgattttatgatctgaagtactgacttatttcaagcacaaaaaatctacacacacacacacacacacacacacacacacacacacatacacacacacagacaccaagcatatatctattaggttaaaagaagaaatttggattgtcattttaaaaattggcaagtaagtatatgtattttgggaatatttaaatacctttctaaaacataattatgtttttttaacagaagtactgtagcttgtcagttagctttgaattgtacaataatttatgaattttcaaagggcatacctgcattaatacttttacatatgacacttcacaatgaaaatttaagccattatcattgctttaatattactataaattgtaattaagttgacaattatatttttgtagaactttgtctaaatttggtatttttttcatatatatgctaattggtccattagtccgtgaaaattgttttcagtagcattacatgtagtacaaactcataaacattaatatttttctaagatataagaagacatgtaaacatgatatagttttcatttaaaaatatatattttggccacttgcatgtcagtatgtttgtataaggattacataaagcctttatttctccccccataaaaggaacagaatatcaacctttagtgatggaaatgactaaaaattgctgtaataggaatattcaggaggtgttcctttcctgctttattgattggttattcttcccttcagtttggccaataagaaatatatagagagtactgatgaaatgctgtgtgtgtgtgtgtgtgtgtgtgtgtgtgtgtgtgtgtgtgtcagtggtggaataattattttatattgacaggtctaatctgcttttcccatgaaggttataaaataaaactgagtgtaaaatcatgctaataaaaatacctgagaaggatctagatgctttgacatcatgttaactacatagttaagaatgttacatttgagcaactatatagttaacaaagtagatctagtacctatagtattggattatctagattggtaatatttgtatattaatacaaagaatagagatgactttgctgtgactattggaagtgggtgaaattagaaaggaatttctgtcccaggatccttcctgtggaactaatcacattgttttcagaatgcttgtgttgaagacaaaatactgcatgcactcctgtagtacaaagtcagtttaagatgagatttttatagctgaagaaaaaagtaaataaataactgggatttgaaatgttggataagattttctgttctttgattacactgtttgcaataagatgaactgtttcttctgtgtacttccttgctgtttgcagaaagatgaactgtttcttttatccattttttcagtatatcttaattctgcaaaggattgactaatgtgctatcatttctgcaggtttctgctgtttattaacccaagtttaatgtttaaggcaatattaagtgttctgccatgtaatagtaaaatgcttccatcaaaaatgtattaccaatacagcagaagtcaataacgtcacctgctataaaacaaggttgataagaagcccttttttaaagactcatttagaacccacgacaacttgaaacatctttgtataaacacacattactactttgcgaatagacatttagattatctggtttaaaatgaattggttatttcagcttcaattgtaaaaaatttgtatcatacttcctaacaaactattaaagaaatttgtatatctaaacctgagagtattaaatttcaatgtaatgattaatctagatctacaaaggattatcacatattaaaataattcttatgaaagctgcttaaattagcaagataggtcaaacatttattgtctaaatgtttttacaagagcttagattaaaaagcattatctggttcagaaaagacaggttaagtaaaaattaaagtctataatatatatttgattaataaaataataatattctcactagtaaacatctgataacatattaaggaagtactcaatttatatgtcaattttaaaaattctggccaggcgcggtggctcacgcctgtaatgccagcactttgggaggccgaggtaggtggatcacgatgtcaggagatcgaaaccatcctggctaacacagtgaaaccccgtccctactacaaatacaaaaaaaaattagctgggcgcggtggcaggtgcctgtagtcccaggtaattgggaggctgaggcaggagaatggggtgaacccgggaggcggagcttgctgtgagccgagatggcgccactgcactccagcctgggcaacagagtgagactccgtctcaaaaaaaaaaaaaaaaaaaaaaaaattcttcattagtttctctcaagttctcagccatggacaggtattcaaaatatataggaaacaaggctatggcttgaggagactgatacaatccatgccaatataaaagagcagtgatggccaggcacagcggctcactcctttaatcccagcacttttggaggctgaggcaagtggatcacgtgaggtcaggggctcgagaccagcctggccaaaatggtgaaatcccgtctctactaaaaacacacaaaaaaatagccgagtgtgttcgcgtgcacctgtaatcccagctactcgggaggctgaggccggagaagggcttgaacccgggaggcggaggttgcaatgagctgaaatcacgccattgcactctagcctaggcgacagaacaagactccatctcaaaaacaaccaaccaaccaaccaaacaaaaagagcagtgaaaagataaagccagctccacactggctttataatacacactgtgtatataatgataatacacacaatgtgaggtttaaacaaatgtgtttaatacacacaatgtgaggtttagacaaatgtgtttaatacacacaacgtgaggtttagacaaatgtgtttaatacatacaatgtgaggttagacaaatgtgaggtgtagaatttgagcatgttgctcaaggtcgtatacttaacaagtgacggtcagtatttaaaatcagtttgctcttagaatcaatgtgtttaccaaatattccattaccaatcaaatagtcaataaaagttagcacagtgtttatcatcatcatatttacacatggataaaaaatgctataattatccattaggacttacattagttccttgagaaatatttatccattccctctgcacagagatttgaatgtctttacattttctataaatattattgactttactattataaaagataatgaaacccgtgttcaaaaaaatggggggagtaagaaaggaaggaaatgaaaaataaattaagatcgcaagaaaggtttgattcctatatattctatgaatggacctcaagaagttttctgaggttatttccttttattcagaaaagaaatcttccagctatgaattccttaaaaatttcatgatataagatatccaatgtattggatactttgtcatgtagaagctttttatacctattatgttttcttccccatgacctccccgcaataacactttgaggtactatttatcattccatttggaagaagtaactatattccttctcagctattacactgcttccagtacaatgtgtttcattaataaataaagtgcatgctctaagtgaaagtatatgttttttaaacacataagtctccttgtcatatttccagaggggatgacagaatatttatgttattatttaatggcaaaattcacttctttctaggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaaggtaaggtcatcagtatttattttggttttttggttcaattcaagtggcaatgaaattatctttgatgaaacttattaaacatggacatcatttttgtatcttgttgataatagggcattattttccttggagatcactgttttgtagatgttaatcttgtattccagttttgaaagggcagaatgtggaaagttattatattaattgaaatataatatgaaaatgaacaaatatttacatgtaaaagctttgcaacatttttatgacttcagtgtaaatgaaacatctttttaaaatagtattttctaacagaaagtttactttggacttctctgagataactgccaccttgggtattgttacaacttgggatgacatatcaggtgaactcatgacaaatgtactgctgaaagaaaaacccttggacactacatacaaatcaaagattttgtattaggactctaacatactgacctacgctataaattttactctctacgaggcaccaaatattaaagcactttcctccttttcctctgtaaacctgagtaaattaaattttttcattggtgcaaagtaatgcaaataccaattatttttaatatattggaatcatcattcctattatgaaggttttgattgaaagatcctagaaaaatggaattttctgtttgcttctattagtctaattaaacatttagccttgatccagaaagcactcactttaaatgaaactattggttgataattgggaaggtctgaatgtttgtgtcccctcctaccccgctgcataggttgaaactgaattcccattctggtggtattaagaggtggggccttcaggagatgattaggtcatgagggctctgtcctcatggataggattagtgcccttataaaacaggcccaagggaacttgcctgccccttctgccattcgaggactcagcaagaaggcaccgtctgtgaagcagaagaagatctctcacaagacacctaatctgctgggcccttgatcttggatttgctggtctccagaactgtaagcaataaatttatgttacttataaattacttagcctgaggtattttgatgtagcagcctaaactaagaaactagtctaccttattttttattgtgatgatgtatttaaactgaagataatgaatgcaaaattaatttagtcaaataaaacatttgcctcattaaaaatttaaatagaatttggcagaagaaaaggcagataccatattaactgtaacaaagttgggcaggattttttttgtaatgcaaacattgaaagagtaaggaaaataaaagtgtctgaaaatgtgtacttttcatttactgttttatctgcttgatgcgcaggtaacatttattgaaatatattttcaatcaatagcactggctactgttgaaacttatttatgttagttagaaaatagatatgtgattggtggtctaaaagttttttccttgttaatggaatggagtaaaaaatcattattttttgaaatgaatagaactgttttaagtaaaaactggctttacaaagaataggataataatgtttataataatacaatgagattttaatttttaataagtaaacattaatgcaaaaagtcagattgaaataaccattcagttatttacattttaaaatcagaatcatcccgacaatataaggatttcaatactggaaatgttaataaatattaataaattttctatggaaatatttaaaagcagtataaattaatattagaaataatagaaggatctggaaaatcataacatagaatttgaagataccaaatcattttaaagatatattcaataggaaatatatgtcattcatttttaagaaatctgtattatttttctttcttaactcttatttgtaaggaccagaatgtgagcaggaaaaacgtgaggactgatttctttctttatcttcttagtaactacatattaataattgtgaattaacttcaaagacaggctaaactacctatgctttttaaaaattaaccttgagtaaaaaagtagtaagaaaaaaaatgaaatgaagacaacacagtggtgagaaaccggaattataaattaagaagaaaaagtccctcacccctttattaaagactataatttgaaaagtaatgacagttttttaaatactacacctttttttttgtttcaacattgctctctttaattattctgctgccagctaaattctgaaaacaaaaatatcttgcaatagtgacgtgacggcactgaaagcaaattgagagaggcaataaggttcccagatagagaccactaggtatttgtcaagaaaaatgaaagagctggacagtttgcctgatggtttctgatactaacaggatgttctccaccagttattgtgatggtcagctttgggtaataaacctgaaatgagttccaggaagctttaaagacaatttgtttccctattcaatatcaagaagggtttcagttaatgttagaagtaaaaatacttatttatagaattttttttgtaaaacggtggcttgaaaaaaataagagaaaatattctattgaaagataacaaacaacccattcagaagcactattttcttcaatgttttgaggaagtaatttaggagaaaacctcaactgtgccattgaagatagtcaactttctctcacatgtttactgcaatactatgcaaacttgtattgagagggactaacatcaccttgtctgttttcatttttttacagtctaaagaaggaaaaaagattcaatgatacaattataagtgattgcttatatattagcactcctaatgaatttatagaaaaactcatggttttgatccctctgcctgtttattcaaatttgaaagtctcatccttgaacaaatagcatcatcaaacatatagatagtaataatgacaaatgataatagggatcactcagaggttagataagtaaaatctaatagcttgaaatcctcaatttattttattgttagaatttcctctaatcagccacatttaagagctggttttttattttaaaaatcaaaatttctgttcactgtatctttctactgttatcacttaataagagagaggaattcagtgacagcctatataacccataaacagtaataaagagtattggtgttttggaaatcttcctttgtagctttggctacagtacatttttggatagcaattaatcctttagaaaatgagtttctagacagatacctcagttataacacggggtacacattccattctctggagatcaatgactgtatctgttaattttgtcagtatttggtaacattgatttcagatctttgaaatacatgaataatagaaaaaaatttctgttttcacaaaagttatctggaaataaattacctattttgagattattcttttttcctttcttatgaatgtatttgttgataagccatttttcatcttttgtgtactgagctgcaggatattaactaagggcaaatacattttcaaaccttaactcacgaggttttcttgacaattttttttttcatttggataggctattttggtatctaggatgtagtgttctccgtaaaaagataaatacaaaaagaaaaaaaaaacgtatatgggttatttttaaaaaccttgagaattataggggtggaaaattatataaatctggttgaatattttcacaatttagatgaaataattgagacccagagaggttaaataattttccctagttcttctagggttaccatgcttgtgtgtagcagaaaaagaactaaaccaagacctcctttacatcactagtccagtatttttcttgctatatacccacccatgcatatatatagacacacatgagatagcacaatgtattataggacttcagtaaataatgtaaggactcaaaaaagtagcagatttatgttttgatatttatttgctatttattatttatgttcaaccatggaatagtaggaaaatttcaatctaggtgataaagaccagttacattatataaatcaatcttgttcttttggccttggttttcctcatttgtaaaaaatgaaggaatctgaatataatgtatttttaaggtaactttcatctctatgcttctatgacccttaagaacacagttctagaattagaaccttatagaaacgatcattatttagtgtccctttagagaaagtttcacgttgctgaaattgcctcctagtttttctgtgtctgactttaaaatagattaaacagatatagggtatccattgtttgttctgccacctcattcaactattcaccacaacccacagtactcattaccaccaatagaattcaaaggatcttgtgctgattcccttaacctgaaccaaagtagctgttcataggttactctttttattcataagttactctttttattttctcttataaattttttcttctgtggcatctatgtacaacatttagcataaatgtacaaatgtttttgtgaaaaacactgctgtcgtttctgaaagcagtacttattgtttatattgttagctcttagctgagatgaacataaaatgggccatgaaaggtggaaatttataagaaaacaaagtcaggaaatgtaaggatggtatatttgtagaaatcctcaagtcaaaaggtgaatgaagtatgaatccatatataattcttacatgtatttgatgtattaagaaggaagtgaagcatcattctttgatatttaatgacaagattcagctaaacaattttgaaataattgctcttattagaaaaatacctaaaaataagctgcatcgtgaatataagggcaacattatactataaagtcacaaatgattctgtttgaaagaaaatgtattaaactataatacttttttatgtattgcaaaacattataaacaatatcattataatttaaaaacacaaggtttttgaaaaaatgtccagtgctttttgaaatataaaaatttgaatcaatatctcaaagtacaattcaaagaagcaaactcttattgtaatatgcagtaatgggattcattaaagttaaactgttgtgatgctggaaatatgaacacaaaataaatgatatttttaatatatataaaaaagttgtagttaatagagatcatcttgcaagtttcagtctggtagaccttacgactacttctttgcatatcttaacaccagtgttgattacccattgctcttgtaaaaggtaaacatttcactaataaaatgatgatttcaattagatctgcctcatatatcttctaaaataaaataatttccagtatatgattatgcttataaaacaataaaactgcattcatttttggtttatgttaccaatctcatttctttatagttataaaaatacatacatatttatttcatgtgtgtaaatgggatgacaggaaattagcacagtcagaaaaagtgcaaggaaatataattaggaaaaagcacatctccaaaacacattaccatccatggtgaatatttctggtcattgattaaatctaaatagtctagtccaaagaagatgtaaatagaatgatttgtgtggctgcattatttgacacttctttccagggattattctcatttatatttcatttatttgcccactgctttaatatgacatttttactgtgattaaaaaatctgctaatttcaaacttcttacactggattctgcaactttcctagcataatactacagtatgtgtaccccaacagcctgtgtttcctggaccaattttgataacttcaattccagcttattttctgaattgtctgacaataaactaaacttgagaattgttgtctgtaggagctgagaaacaaaactaggagatcatgtgggtatgattctattcattcattcattcattcattcattcatccattcgttcatttattcactgttttcattcctactttccttcccacatcaaagtcaaggttgtgccttgagtctcaatgtctatcccagtgctctggttaactctggaccatctacatgtgtgaattagtggaaggagcaaatcgtgttgttgaacagccatctccaaacacctgcacatcaggagggatgctggatgtctattcagtgactaaaccccctgttttcctctatgagggaagatacttagcttggtcctttccccagcaatctcctgccaaaacctgtattactttttctccttgcctgtcacattctaaagactgggccacaaggtctggaattagaatctatcttatgtgtgatctttagtgtccatcatcaatgtagtattaaaggacaaataattctatgcttgttagagacaacaccaatatgcattaagaaaaaaaaaaacagctcacacaaaccttttccactgcagaatttcccattaagagcaattaaaaatatatatatttagaacctaattttgagattactcagtcaaattaatttattcaagtgcttattaaatgcctagtacttccaagattgagccagctacaatgggagataaccaaaaaacaaaagaacacagcatataactccaggaataaaaatgtatttgaggaaagctgtggatttttaaccatgaaaaagcatgccgttcccctctacctttaacttgaggtttaattgtgttaataatagaaggaacaagatggtctagctttttaagtatacttttcaggaaagacaggtattttcttttttttacgatcattataccaaatttatttatttttatttttatttttatttgtttaatttataaaggaaagaagtttaattgactcacagttccacatggctgaggaggccttagaaaacttacaatcatggcagaaggggaagaaaatatattctttcttaaagaaggttattactttacctttaaacaaaatattaatgaagatacaaattgcatagtctaatcttttttcctgttatttgttgttttactgctgtatttgtatgtctttcccttacctcatttgatatcatactcttgaagtaacaggtctctactacagtgaatggattgaaattcagatgtttacagacctctacatcataattttatagcctttgtgcttcgaggacttttacctcactatctacaattgtgatctgttgtgttacctcataaaatatatattttagcaatttgtgctgctctggattttgttttatttggaagagtctttagcagcgttctgtgaaagctgtgtttaaaggaagtaaagatttgttcttttgttgtctgtgttctttcttctaccaattcttttctcctaataatagcacatcactttcttgtattcttctatgtctgtatgtatggtgcatggatatggtaacataattcacttttaatcagtcttttttgaaactgactcattagaggaatcactacatatcttaaattaactctgaatatctggttgatttgattaaaaaccacatttacctacactcgcagttgtaatgagagatcattatgtagtcataaaataatttaagttcatgttgacaaaccaatgatgacttcagtatatttggaattttcaatctgttatcactattatcaatatccaacttttatatgatccagtttacctggttaattttagaagaaatagcaagctgacatttactttcacatttaacacctattttttgttgtccttgacaagtgtaatgaggtttatgggaatcacactgaatagtcttttgggactcatgcaatagtttgttatcttgtaattttcaaaataattattacagaaaagctctcttttaaaaggaacatgcaataagccagtgtgcaataggaaattgcatattctgggaaaaaaaagaaaatgaatccgccagtaccttttgggtgcctgtgaacattcagtcttgtgccaactactctgcacactgtcatgctctccattggctgccctgtcgtcttacatggttaatttggcctttactctgtaacctagtgttaggtcctgacctatgtgtacctctcttctttttgccctcccattatagtactatttttaaactctttatttagcccccttttaatccttgactctccatattatactgcagacactcaaaatgtctgcatttagttcggtatgtaaatcttaaacttggtttcatttacctcgcagggaaaaacatatatattaagttcatagcccatggaattagatacctgcctttattttatgtatgaattctgctctatgtcttattatctgtgggcccttgaacacacctactatttctgagtctcagtttcttcacatgtaaaatgaggataaatacatactccatagcattaatatgattatgtgattattgtgtaatgattatatgggattgtaaatatggtagatgggttcctccactaatctaattacattttaatgatagtgctgtatgtgatgatttagtaccattgcatgtgtccctcagtaagttttcacccgtttccaatatttccttcccaaacatattctagtacttttattagtggttcccatggatacctctgagcctaaccttattacctgcgtagtcagcgacatatttttgcccaaatgggactttccttaccaagattttgagtgctgtggttttaaatatatataatgaaatgcttttcctttttttttttttttttttttcctgtctctctctctctctctttccttgggctggttctgctagtcagcacaggaagatgagaattatacatgtagtgtaatttatttggcaaatagtagtgatgttgcaacatgtgtacttagggttgggaggatttaaaataccttgttaccatttctgggaagtagagaaaggccatggaggccaaattaaagctttctgatgatttgtgtaggcttaatacaatcggtgaagtaaataaggcgctgagtcatagctaaatggaatttggctgtagagcaacatagtgttgtaggagagtgatatatatgaaggttgaatatagaaattaattcaaggaaagctttatgctttgaaagatggatcatctctggcaaatttatatctgacatgattgtttaaaaggttatctttccatgctttgcacatttcattgcaattatacatagggaaatattaactttaaaaactcagtcatttgcttatttgaatttcttgtactgtacttcaaaaacacatgatatcatgttattttcttaagaatttatgcctcacttcaaaacagatttactttttggtctttgatagactaacgtgatatgatggttagatgggttaagtccatttcttaagctatatttcaaacataaatatacattaaaatgtctactatatataaaaaatatatattccaggccatgcaccgtggctcacgcctgtaatcccagcactttgggaggccaaggcagatggatcacgaggtcaagatatcgagaccattctagccaacacggtgaaaccccgtctctacctaaaatacaaaaattagctgggcctggtgccatacacctgtagtttcagctactcgggaggctcaggcagtagaatcgcttgaacctgggaggtggacattgcaacgaggcgagattgcgccactgcactccagcctgggcgacagggcaatacttcatgtatgtgtgtgtgtgtgtgtgtgtatatatatatatatatatatatatatatatatatatatatatatttctcagaatgtattttaggggagggtgtaggtggggaagcagttgacaaatcaaagtcagaaacaatcttagtatagagaatattcttgaatagtattaccttgaatgctaagaaatatttttgtatttttgaatgtatacttatacaaacagaaagttctgaagtggtctcatgtactcattcatgttattaaacctgagcaaggtatagagggctcaggtgagagagggtaactagaggattaaaaattaatacacaaaacagaaaaggtcacattcttacaggtcaagggatgagaagttgtcatattagcctcattctacctgctcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaagaaaagaaaagaaaaaaagaaagaaaaagaaaaaagaaaaagcttcaggccagtatccctgatgaacatcgatgtaaaaatcatcaataaaatactgggaaaccggattcagcaacacatcagaaagcttatccacaatgaacaagtaggtgtcatccctgggatgcaaagctgtttcaacatacacaaatcaataaacataattcattacataaacagaactaaagacaaaaaccacatgattatctcaatagatgctgaaaaggaatttgataaaatccaacatcccttcatgttaaaaactctcaataaactagatatcaatggaacatacctcaaaatattaacaggtgtgtatgacaaacccacagccggtatcatactggattggcaaaacctggaagcattcaacttgaaaactcgcacaaaacaaggatgccctgtctcacgactcctattcaacatagtgttggaagttctggccagggtaatcaggcaagggaaagaaataaaggttattcaaataggaagagaggaagtcaaactgtctctgtttgtagatgacatgatcttctatctagaaaaccccatcgtcttagtccaaaagcttcttaagctaataagcaacttcaacaatgtctcaggatacaaaatcaatgtgcaaaaataacaagcatttctatacacaaacaacagacaagcagtcaaataataaatgaactccaattcacaattgctacaaaatgaataaaataccttggaatacagctagcaagggaagtgaaggacctcttcaaggagaactacaaaccactgctcaaagaaatcagagaggacacaaagaaatggaaaaacattccatgctcatggataggaataatcaatattatgaaaatggccatactgctcaaagcaatgtatagattcaatgctattcccattaaactaccgatgacattcttcagagaattagaaaaactactttaaaattcatatggaaccaaaaaagagcctgaacagccaattcaatcctaagcaaaaagaacaaagttgagccatcacactacctgacttcaaactatactacaggctacagtaaccaaaacagcatggtactgacagaaaacacacacacagaccaatggaacacaacagagatctcagaaataagagtacacatctacaaccatttgatcttaaacaaacctgacacaaataagcaatggggaaaggattccctatttaataaatggtgctgggaaaactggccagccatacttagaaaactgaaactggacccctttcttatccaaaaattaactcaagatggattaaaggcttaaatgtaaaacccaaaatgataaaaaccctacaagaaaatctaggcaataccattcaggatagagggagggacaaagatttcatgaagaaaacgcccaaagcaattgcaacgaaagcagaatttgacaaataaatataatttaactaaagagattctgcacagcaaaataaactaccatcagaacagaaaaccaacagaatgggagaaaattttcacaatctatccacctgacaaaggtctaatgtccagaatctacaaggaacttaaacaaatttagaagagaaaaacaactccattaaaaagtagtcaaatgacaagaacagacacttctcaaaaataaaataaaaaaacatttatatggccaaaaacatgaaaaaaagctcaacatcaccgatcattagagaaatgcaaatcaaaacaacaatgagatactatctcaagccagtaagaatggcaattattaaaatgttaagaaacaacagatgctggtgtgactgtggaggaagaggaacacttttacactgttggtgggaatgcaaatcagttcaaccattgtggaagacagtgtggcaattcctcaaagaactaaaaccagaaataccatttaacccagcaatctcattactgggtatatacccaaaggaatataaatcattttattataaaaatacttgcatgcgtatcttcattgcagcagtattcacaatagcaaagacatagaatcaatccaaatgaccgtcaatgataaactggataaagaaaatgtggtacatatacatgatggaatactatgcagccataaaaaggaatgagattatgtcatttgctgggacatggatggagctgtgagctattttcctcagcaaactaacacaggaacagagaaccaaacaccacctgttctcacttataagtgggagctgaacaatgagaacacatggacacagggaggggaacagggaggggacttttgggggttatggagagagaaagcatcaggataaataactaaggcatgtggggcttaatagctaggtgatgggttgacaggtacagcaaaccaccatggcaaacatttgcctatgtaacaagcctgcatgtcctgcacatctatctcagaacttaaaataaaatattttttaatcctatttattatgtctgacaaaatggaaacaggcaggctttatgtcaaaccactgtccttcagcttacccacaatttatgccagggatccatgtgagcacagaataaatcaccagttgatatagttaggcttcctttttccacccaaatctcattttgaattttaatcttcataagctccatattccccacctgtgaaggaaaagaccaagtggaggtaattgaatcatgcgggcagtttcccccacgctgttctcctgatagtgagttctcgcaagatctgatggttttataagggggtctttccccttgcttagtatttctccttcctgataccttgtgaagaagatgccttgcttcccctccaccttctgctatgattgtaagtttcctgaagcctttcccagccatgctgaactgtgagtctattaaatctctttcctttataaattacctggtctcaggcagttctttatagcagtatgaaaatggactaatacaccagtgtacattttctttctttggaaactgcttaatgcttaaataagagaaggggaggccaaatgacggaaactaggaatttccaaggtcaatttattctttcaaaaataagaatcataattgttcacttatttgtaggatacttcttattcacggtacactagattgggatttatacagatgagttagactaatttaattcaagtactcaaggaatgtatagtctactaggggcaatatacaaagagatctagaaaagttgataattttatttatagtggaaacaagtgacataaaataatgatactaaaataacaggtagaatgtgtatgatttaaaatcaagggctcattttttataagatgatgatgatggatgccaaaaacaaacaaaaaacctttaagatttcaggttgagtagtagacagacatgaaaatatgaagggaatagcattccaagctatttcatatgggaaagtaatttggaggtaggagcttgctgtgttgaggaactatatgttcttgtggacactcaaatttttattctgttgccttacaaatatttatttccatcatcaatgtcattccttgcttgtcaaccatattacttgtgagttttttacctaaatcagctttggttccttatactccccttggacatggtgtgtattccgaaggaaaacctggtattcctgcagatctcactgacattttggcatggagacttttttactggaccctttttagattttaaattcacctgctataattctgattttgaatttaattatggaaacataagagcttttcctgtaagtgttcttctttccaggaaaactaaaataaataccaaaatttgtttttgaaaataaatttactcagttttcctgttcttctaacacagagtaattcacagagatatattattgaatcctaagaaagaaacctcattttgtggcttttatagttttctgtacacttgtacaaaagagcctcatttgataaagccaatagtaagagacatttattcataacttatcacatccaatgaactgttgaaaatactttgttttctcctgatctttatactgacttatgaggtataaggtagttactattcttattagcgttttacagatgaagaaaatgagcaacagctgggttaggttaacttattacacctggaacctttagaatagtggctagaacactagtttcgctttaagtctgctgattgggaggttcaggcatgtttcagtgagaggaagaagaaagaaggtaaggcatttattttctgtcttctgtgtgtggttgtcttaagctgactgtacctcaaacaaaattgatgtatctcttgatgcatcctgctctgtatcactctcttgaaattcactgtcttgtcctttatcctttgggcctggaactggtaccacctcactgctactagctctgggtttttgcactattcccctttcgttggctgcactccacccagacctgcgtaatttaacccattgaaaaagaagccctacctaaattatcctattttgagttgccattgttttctattggaattttaaccaacatcattatttaactcatatttgtctaatctaatcagaaagtgttacatctttgattgtattataaagtcaatctatgtatcacattacaaaacacagtaagggtgcctcacaaagatttctagcttctgtgcattgcaagataaaatctgtatgttcatggacactttaatgttgcagcaaaggtcgacatgatgttggagatactgagtggcagcaccccttccaaaaggcagtaagtctgagcagaaacacagctatctccaaattgccaatacacagcatagttgagtgtctgaacttactcatttatgcctggttgcaattttttgaatttttgcaatcagaccttggtaattaccttgagcagcaggatataaataactcccacatgcttagcgttccaataatggaacactaggcataagtgggtgaaggaaacatcactatttttaatttaaataatatgacaaatgaaataaacacgaatgttaatgctgaagttatatatttaaaatgtcttcttttaagcctctactttggttaaggaagttgatgaatcagttattcaaaaatttcttaatattttattttttgtgataagaatttttcagtgtttttcctttatttcattctttgtaggagcgttatactgtgtaaactagactcattattaagttactgggggtggggaagaaccgcaagttactggtgaacatttttcatagccaagattttcttttgcttggtaactttctgtcacctattacctagaataataatgagaaagtaacgagttacaacagacctgtttgcatctcatatctttttgtttcccagacttactcattaaataagtgctaatgaacagcaaatggccaaacaccaggcagtagagcaggcagaagagtaggaaaggtcttacaagatgtgatcagtataataaggttctcaactccatcactaattcaacattgttcagcctttcagcacaagacactgaggtagaattagcgaagaatgtagaggtaacttagaagcactctacctcttccaaagctttaaactatgaatgaagatgaaaaatgtgtgcgtaaacaataggataacaaggcaatatgtgtaagttctgtgaaggagaaacaaaatacaaagttcagtagaaaaagaggtgacttataactaaggatggcaagttgaggggggaaggaaaaaattaatgaaagggaaaagtagtaagctctgctttcctttctgaaaggagaaaaagtctaagcaacagaatcaggtatattcaaaaataaatccttgcgactgatagaaaaatgggaggtaggggctggaagatattgagaatgtaaacatcatgctgcaaggacagaaacagtaacttttctctcaagatctgtgtcctattcccaacttcaaggacacctctttcccaaactagtggtgcaatagtgaattcagcatggaaagactcatgattcagcaagtaaaattgaagactaataaagacattaataaagatatcaatcttcatataccaaagtcttattatttcttttaaaatgcagcaaaagtaatgaaaatggtttgagttcaaagatgccgcttcaaaggtacaatgcctccactgtgttttaagagcaagtgatattttaaaataattattctacatcttcaatggagtaattgcttttcacattaaagaaagagataagcgcccaagttttataatataaaaagtgctatgcatgtgtattaactaattctctcaaaggagttttactacacatttggcattgtgtgctataactcagagtgtcatggtgctgtgctcttacatgaaaacatggatggtttcctaactgagttagacagaagtagataaagaatatcaatatcatgtactgtggttcctttatatgcatagtttatggttactatttttttcattaagtgagataatgttttaacataagtatttttattggtctgattattacaagtggccattgaggtttgtttattctgaataaaacaagctcttcaatttgtaaaaattggccactttgttaatcgttcatttattctttcacccaaatatatattgagaacttataatttgcaaaatactgtaagtgctaaataccaaggtgcatcaatgtgctttctggcttcaaaaatttgttgtttagcaaataaaagacataaataacattaatatagatgtaaacagtcataatacaaagtacagtaagttataaagttttcattagtaaagatgaagtgttagaggattttgagaagcactgatgttggtatgcttactttctgttcttcacacacagcttgaaatacttgtttttccttacatgcttagtgtatccccaatatttggtaccaaatatataacagtctgctcgaggttatttaacattatttcagtcttgagagccttactatgtggttaagttttcattaatttaattaatgtaacaaatatttatcgagtgtctatgtgccaagtattagtctaggaattcatggtaccagtgtaaaacacaatatcttgctctctgggaatgtatattctagttgaagaaaaaaaataataaagacaattccagattgaagagttagtattaaaaaaaatgaagtagcatactaggcataatcatgatgatggtgaggtgccatttaaaataaagtggtcaggaaaatcgctttttgagaagatgacttttgagcagagacctgaatgatgaaagggcaaaagtgatgtggctctccagtggaaagcagagtgtacaacagttactggaaataatatatattatatatatataataatagtagatcactataatttttctttcttctcgtgaccacattagtaccttatttccatttatcatgtaactgtcatatctttgagaataccttcttcaattatctgaccactacttgcagtcacttatattttcacaccctgccttgttttgaaaattcatttttaaatcaaaattacacatactatagatgcagtttatctgcatatttgattttatttagaaactctgatcttgaaaagagagccagtgtatctgttaattaggcataatctctttactattgaaaatgtatgtggattatcactattatctgttaccataatttaataaacttttcatccacaatgttaaactattcaaaagagtcccttaccctcttctacagtagcagagttttagctgggtttatggtcccccaaataagattacatttcatacctttccttgatcctatacagagggccaatggaatgtgaacagaggtgtggacaacttccaagtcattccaacttaaacacaagctctttgccttagactgacaccccctttcaatgacctggaatatttacgttgctgggacccaggttttaccaggcagatggggacaatgcattaggggatgactgagcaacaagataggaggaacatgattctcctgtagagaagagttgccctggctggactgctatgagtaagagaaaggcatctctgtcttatttaatacccactttatgtgtgtgatattgttccacttttaaccctaaacataacgatcatacctgtctctaaatatttcactacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcatatgatctcttctttgtgtgtgcatgaaaacagagtgtgctcaagccctctgatttctctgcatagaaagacactaatcctatcagataaggactccatccttatgccgtcatttaaccttaattacctccttagaggccctgtattaaaattaatccacactgagcattagtgttcaacatatgaacttttgaggggacacaaacattcagtcatagcatcttactagggtagatatttagggagaaattgctcagttttatgatacattaatgtttaccttcttatgtaactggacagctgtgtactatttcacattcccaccaatttcttcacatttttgccacttttgtaaaatacgtgaagtggtatctgattattgttttactttgtatttctctaatgattagtgacattgagtatctttttactgacatctgtgtattttctttgatgaagtgcttgttccaatcatgcatacatatttatttgaggttttttgacaatcttatttattttgaagtattcctttataatcttgataagagtttttttttaatcagatacatgtttgcaagtatcttctactagtccatgattttcccccctattttcttagtggagtattttaaaatgcaaattaaaaattttgctgcagttattttttaaacttatgtgtttagctttgatattgtatctaagaatatattccaaggtcattaagattttttttcatgtcttctagaaaatgcctatatttaacttttatatgtaagtctatccgttattttgtgtttgtgtttgagtatggtatgaggcactgttttggcatggggaaatccaatttaacctgaactatttcttagaaaggttatcctttcccctgttgaattattttggcacttttgttgatagtatgttgaccatgaatataggagtctatttcagaatactcgtgtcttccattgatctaaattcctgtctttatgctagtaccatattgtagctttatggcaagttttgaaatcttgaactgtaagttttccaacactttttttctttctaccgacttatttttggttattgagttctccttgttttcatataaatattggtgtcagcttgccagttgctgcaaaatagcatgctgggaaattagtaacaattctgttgaatgtataaatcaatttggggatgattaccatcttaacaatattgagtatttcaatttatgaatttagaatacatatccacctatttatatctgctttaatttctatgcagaaagatttttttggctttcattatacaaatcttgctcttctattaggttatcttaggattttattcattttgatattgtgaacggaatcatttcttgtagttatattgttcttgctaatgaataaactctattttttgtattttgatctgaaaacttatggccatgaggaactcaattgtttgttaaagtttttgtggatctgtcaggattttctgcaagtaggatcatgttatgcaaataaatacatttacagtccttccttttaaatctagatgccttttctttcttttatcattttttggttgcagtggcttgaacctccagaacaatggtgaatggaattttgaaagtaaaaaccatttcctgtttctaatattaggtagcaagcatttagccattgagctttaaatatgatgttagctgtatattttccaaagatgctatttatcatgttgaagaaatttcctaatactcatagtttgttgagggtttctaatcataattgatgctgagttttttgaaatactttacttgctcattgaggtgatcatgtggtttttatcctttattctgttgagatggtatgttgcattaattgattttcagatgttcagccaaatttgcattcctgggataagtctttaaaggttatggagtaaaatattttttacatattactgaatttagtttgccaatattttgttaaggactcatgaatctgtattcatgagatatattgatctgtgatattctcttcttgtgatgttttagtatttctttggtattttaataatgacttcaaaataacttgggaagtctgcctttcccttttgttttctagaaggctttgtgaaggattggtattattccttctttaaatgtttgatagaagttagcagtatgttctgaagactttttgcaataagattttgcattattcaattatttacttgctttgatctattcagatttttctcatcgctgagtgagtttgatactttgtgtctttctaggaatttgtctattttatctgctctgctaacatgaagttgttgataattttttttataatcctgtcttgttggtagagaggttctctttcattccagattttggcaatctgtaccttctttaaatttttgtcagtctagcaaatgaatcaacttttgattgtagtgatttttctcctttgtgtttcttttttatttcactgattttgctctttattatttccttacttctgtttaatttgtgttatttttgttttttaaacttttttacttggcacatgataattctgcatatttatgtgatacatagtgatgttgagatacatataatatatagtgattatatcagggttattatcatatccatcacttcaaacagttgtttttctgtgtttgttggtgcattccatatcctccttctagctatttgaaaccatatattattattaactatagtcatcctacagtgctatagaacactggaacttattcattttatctagctgtaattacgtgtgctttgacaaatttcttcctatcctgcctcctctctacacgttccagctgccagcatcctcagttctactttatgcttccatgagaccagttttcttttagcttccaaatatgaatgagaactatttgctttttttctgtcttaagttagcaacttaggttattgacttaggatatttttttcttttccaataaagtcgtttaaagccataattttgcggttaacactgctttacctgattgctataaatgtaaacatgttgtatttctgcttttattcagttcaacaattttttttccaattttgtcttgtaatttatttcaccaatgggtgcattgtttaatttctgaatatttgtggacttctcaaatttctgtatctttatttctgttttttccctatgtgaccagatagaatactgtatgatttcaatcattcttgattcattgacacttactctatagtccagtgtattctattctggagtatattcatgtgtgcttgatagaatgtgtatttgctattattgggtagagtgtactacagatgacaggtcaaatttgttgatagacttgttctggtattgtctttccttgctgatttcttacctattaataactgaaagcaagtattaaaatcaatagcattttattattgaattccctagtctatctttgattctgtcatctagatttgcctcgcatatttaggtctcagtttcaggtatttacatgtttagaattattatattttactgatgaatttagtcttttatactttgctatgttttttttttttcttttagtaacctcatttaccttaaaacttattttatctgctgttaattatcttagtctggtcaggctaccaaaaaccaaataccataaacagggtggcttaaacaatagtaatatatttcttaaaagtctggagactaaaagtccaagaacaatgtgccaacagttccagtgcctggtaagggctttctccttgggttgcaaatgcctgccttctcactgtatcctaacatggtctttctttgatacataccgaggtggggtggggcagggagaaacacaaagcatgaaaacccaaaggatcaagctctctgaggccttttcttctaaggacactaatcccatcatgagggctctgcctattgacctcatctaaatccaattacctctgaaagacaccatcttcaaaaacccatcacattgaagcttagggcttcaacatataaatttgagaggaaacaattcagttcataatatcagtgtagctacactaattcttttatggttaccattgcatgcagttcatcgttataccatccacctatttgtatttgtgttttaaagtgtttctcttacagacagcataagattagatcttttttcttaatccagtctcaaaatttatgccatttactataggtgtttaaattatttatattattgtaatatttcatatcattggatttttgcctgaattgtgctttttattgctatacctcatcatattattctggctattcttttttactgtgatctttttgttaaatatataaattgaaatgtgtcattttaattccttattagtttttgtactatatatttatgaattattttctatttgtgctaggtatacaatatgtgccttaatgtatcacagtctacttcaggttaatattaacttgattccagtaagatatacaatattgctcgaataacttctacccactgttgttatttctactcactgttattatgctgttattgtctttatatgttgtatgttcaacaacacagttttgtaattgtgatttatgcatttcttttaaatcagttaaagaaaagagaaaataaactatgtacactatcttcatatttgcccacataattatcttttccatttctttcatttgtttgagtggattcaaattagtgtctgatttcatttcctttcagaatgagtgctgctgtagtgtttattggaagaaaaatctgctagcaatagattctctcagtattttaaaatgtggtaatattgtgatttcaccttcaattttgaaggatagttttcctggatgtaggattcttggttgacagattttttttttatttgtttaagcagtgtctttccactgccttctggcctcctttgtttcttgtaaaacatcagctgctaatttattatggtttcattgtaactgatgagttacatttctcttgtttcctttaagtttttttctttggccctgtctgtcagtagtttgactatgatctgtctaggaatggatgccttcaggtttctgctaactagattcattgaacttattgaatatatgaatttaatactagcttcttgaaatttggggaaatttttacccataatttctttagatttttcccctctttcagagactcttattacatcattattacatatgtgtgtttttgttattatatatgttttgtttttgttctttgtttttttcctcaaagaaaaaaaccagttgttagacttagcatacagtgttcctgtatttgttgactacagggacattgaatttcttccttgtatttattgatatctgggagtatttagataatatattatagcatattaggtttgcaatcctttgatatttgttaatatttttgtttgcttttttgattgctgtttttttctagagaatcattctctgctaaatcttttgtgcatttttggcagtcttttaagatgcttaaacttggcccataataatggcatatatttatggggtacctagtagtgttgtgtgatacatataatgtatagtgattatatacactaatgtatagatcagggtgattagcatatccatcatttcaaaactttattatttgtttatgttgggaacattcaatatcctctctctcgttatttgaaactatataatatatagtttcaaactatatatatcctacagtgctatagtacacaagaatttgttcctatctagctctaattttgtgtctgtgtacccttactaccctctagtatcctcagttctacttttgttttttaaaggatctagcatgcaagtacagattgtgcaggtttgttacataggtatacatatgccatggtggtttgctgcacctatcaacccgtcatctagcttttaagccccgcatgtattaggtatttgtcctaatgctctccctccacttgtcccccatccccgacaggccctgctgtgtgatgctactttttacttccattatataaattatttttggctttcatatatgagtgagaacatgcagtgttttacttctgttcttggcttatttcacttaatgtcctctagtttcatccatgttgctataaatgacaggatatcattctttgttatgtctgcatggtaatgtattgtgtaccacattttttatccagtaatctgttgctagattccttggtttgtttcatttccttccttttctctacatcccggccagcattttttattttttgttattttgataatagccattaaaactacagtatgatacaacatcattatggttttcattttaatttccctgatgattagtgatagtgagcatttttttgtatacttgctagacatttatatgtcttctttgaagaaatgtctattgaggtcatttgcccttttcttaattagacgattttgtgttgttgttgttgttgttgagaaatttgagtttcttttatagtctagatattaatcccctgttgaatgagtagtgtgcaaatattttcttccattctataggttgtctttttatgctgttaattgtttcctttgcagtgtagaagcttttaggtttgacataatctcacttgtttatttttgtgttgttgccggcgttttgaagtcttcctcataaaatattttctcaaatcaatgtcctgaaatatttttcttatgttttcttctaaaaattatatattttctagtcttacatttagatctttgatctattttatttctgcatagtgtgaaaggtggaggatctagttttatttttctgcctatggatatccagttttcctagcaccatttattgaagagattgtctctgccttaatgtatgttctggatgcctttttcaaaaatcagttggctgtagatgtatggattaatttctgggttctcttttctgtttaattggtctatatttctgttcttacgaaagcaccctgctgttttggttactacagctttgtagcacattttgaagtttgatagtgtgacaccttcagctttgttcattttgcttaagattgctttggctatatagatccttttgtggtttcatacaaagtttagagatttttttccaattctgtgaagaatgtcatgaataagagttgcattgaatctataggttgctttgggaaatatggtcattttagcaatattaactcttcctatccataagtatgggatgcttttccatttgtttctgttattttgggtttctttcatcagcattttgttgttttctttgtagggatcattcatctccttggccaaatactatacacttcattgaataaatacttactattccgaggtaatttattacttttgtatctcctgttagtgggattatggtttttatttatttttcaggtaatttattgtctgtgtacagaaagactactgatttttgaatgttgatattctatcctgaaactttttgaatttgtttagcagttctgagagattttgtgtagtccttacatttttctagatcctgtcttctgagagtggggacaatatggcttcctcctttccaatttggatgccgtttattgctttctctctgatatctctgtttagtttttgtttgaatttgtctttgtttttttaagcctggatatctaggagttgcttttgagtcactatagcttaatggtcagccaaggattattcagagcttgtgtttacgtagtatgagtaaattttccactctttgctgataggtcagtggagaaacttatttaaagttcaggcactatgttggcatgccttggctttgcattttgataattctatttgtgtttcttctgtgacagtgcaaggtcttatgttggagaagcaatatgtaggcagctagagccctctccagtatttcctgagcatatgcataactttgctaatatatgcagcttcccagaccaggaggggcttatagagtttatcaaggaccactgtgttgctgtctcattcctcagatcttgtaaaatttctgactagtattctaatctgttgcttgaccaagcttgtattgcaacctcaggtttgttgagatgttggccttccttgatttttttaaataccaaaactgttatcatttttggcaattccctgagtattgttttctctacacaccattccaaatcaaatcagctcccctcccaaccccggcatggaagctgttggtttttatggctttcaatgccatgctaaaattcagtgtcatgctaaaatgacacagacacactcttcttatgtgatgttcagtattttcagtatttgctattaaataagtgatttccaatttgttgtatgtctttgtttttttgtttgtttttagaatccttaaatagtttcacacatgagttttatttagttttatcattgcctttaaggagatttgctgagctccttatttggccatttgcgaagttacacatgcctttttttttcccccacaggagggatagagaaatttagaccatgtgattcagtttttatggaataagtgtcattgtaggtgcatcatgaattataggcaatatatgaaatttacttttcatggtaattctgatgaaaagaagaatgtcagaaatgtggattatgggtagataacagccaatagtgtggttagtctggaatactatctattttgaggaccagataagactggcatgggagattgaaatgagctagtaaaagattttgaatgtgaaactaaggtttctaaattaatatctttaggtaatatcaaagagtggaatggtttgagtgatggaatgacatgatttatagatgtgcttcagggaaaagaaaatagctgcctacaatgtaagtgatggattaagggtcaaaaaactgaaataaaaccagtcagcagtcttgtaatagtccaaatggaaactaataaagtctcaggatagttattatcagaagggaaaaaagtaagctactatgaagctatgttacaggaggtcttgggaaggacttgaataacttattatatatctgggaccagtaaaagagagactcaaagaacgcttctagcatttggcatttggtaactggacaagtatacaattagcacaaataaagaacatagaaggaaagacagatatagggaaataattgtaaatggtagttcatatttattgaattgttactataattagatatagttatgagttttatgtaaattattagttactccttacataacactttgcatataataggaaacaaagggagccagattagtcaactgtaccaaaataaaatagctaatatatgacagtattaggacacaggaagtggaacatcacacaccggggactgttgtggggtggggggagtggggagggatagcattaggagatatacctaatgctaaatgatgagttaatgggtgcagcataccaacatgacacatgtatacatatgtaacaaacctgcatattgtgcacatgtaccctaaaacttaaagtataataataataataataatgaagacacattagctagaggaacaaaataaagaatgccaaaaaaaaaaaaaaaagaattttaacccaggcattctcagatcagagctgagatttttttctgacttttaagttgaggggtacatgtgcaagatgcacaggcttgttacataggtaaacatgtgtcatggtgaattgctgcacagaccatcccatcactcagattttaaacccagcatccattagctattcttcctgatgttagattagagctgagattttaacccctgtctgaatataggtctcaggacacatttagaaaaggaaagatgaagtgatggtttaagattttattgtctgagggtgaaaagttaaaattgtgatattggacaagattgtcaaagataaacatatgagagaagagaaactcattggcaactatttacattttgtgggaaaaaaagtttaaaattaaaagatgaaccagtgcaaaatattatctctaaggaaaaatgattattttggtgtggttattttaactgtgatgggatgttgcttggatcaggtgtataaaaactccatagatgaatagttggtgcatacctatagtcccagctataggaagctgaggtgggaggattgtatgaccccaagagttcaaggatgcagtaaactatattacatcactgcacttagcgcagggcaaaaagcgagacatcatctcttaaaaaaatccataaattccagagataaggaaccaagtaattaaattatggagagaattttcattatggtagtagtggttttaaaagaagagcagtaccagcagtaaggagtgagtggatggaaaggattaaatactgtaagtagaatttttcttcaaagtttgataatgatgaaggtaaatacataagaatagctagagtttggtgaaacatgaaacacacagaaattttctgaagaaagagaaaaaattcgaagagagagagattatgatgacagtttggtttagaaaggagctaaagaggagaaatttgttaaacattgaactattgagctaatagaacaatcatgtttgttattagtgaagaggaaaatggaaattcatgtggagtggttataataatctcagtaataattgaggcaatgtggaagtacagtgcagagtgaaaaagatttgaaaatgctactggggagagtcaattagagatgatggataatatttctgagtcatagtaagaattaacctgagatttcatagcaagaatctgtaagagattttataataaccatttcatattttcctgtaatattaggaatgccaatactaaaaaggtcacaattttagatatggatgttgctttactgttttcatggttaggcattattttctgaattttcttataactttaagaactcttgagtgaatgagtcttcagaaagaaaaaaattctcttggagtggatgctctttcccgactctcctaatatatgttaaggagattttaggaggatattttaagagatttggtaatatttctgtacaagagagtaataagaatgaggggaaaattaagtggtttaacatttttggaataatactattttttccccttgggatttcccaaaatacacttgttcaaagtgaacatcagtccctcatttttaaaaaagatttcctaaagatatttaagaggttttatttatcagatagcattgatagagtgtattatttaccacttggtctggatcagtcatcgtcatcatcttaatggtaaagtggagagtgcatcaaattttgagtctaaagcattagcttcattcctgcctctgactcttaggaaatttatctaagtacatattcctgagctgtaaaatggggataaaaatacctaaatgacttcacaggtttattgtaatatccaataggtgatagattggaaagtctatgtgaattattaagtcatggcatttgtttttaaatgccatatttatcaacaagcaggcccatgctaggctgaagctgaagcttctgtgtcttccaaaaacattttgttagtttaaataaggttcatcactattgggaatcttttgaagatgaaaaacttgttttctagaattaatatttaaatcaactttaaattggtctataaaaaactaataaaatttcaaagatttcaggctgattatctttcattataaaaatattttaaaatagttattttataaaaaacattcacctgcattagtttatgtacatcaaggcaatatgttcaattaatattgtattcaatagaataagtactttgtattcttcatatgattagaaagttctgtactagcatctgaactataaataaataaatcttaggatatatatatgacctgcttatcctcagtgtaaccctgcgacacaaggataagtaagtacaaaaaaaaaaagattaataccatcaaaaaaatcactctctggactggctaataaaagtgattcatccaagatacatgaaacaaagccataatatttacttaattattaactgaaaactatatgtaagcacagagctaagttctgaaaatatgaagttctccatctgtgatcatgtgtgcaataagaatttgagtggaataaaatgtgtgtatcttggtagtcagagacagtagtggcatgtgttcatggcaaaacagcttgaagaagaaatttattctgttaatgtaagcaagatttatttatttttatttctgctatgattatcctggagaaattaccacagtaaaagctgtggcaccgctaacacccacagtcatgttccttctgtttatgtgaaaggcagaaccattgagttggaactcaagtttttacttgaatgtattattcaaaaaaactttatgaatgtaactgatattttataccatattctataagattataatttttggcagttttttcaaaacatgctatataaaaggttagtctgcagtccctacacctaacacacatatacacacaatgacataaacatatccggtaaagctacttcctagaatttactatgttaagcatcattgattgtggtattatagactgcagaacatactgtagataattattcttttctactttcaattcaataaggtagcacagcagcaacatcatcacaatattcagcattaattaaataaattatgttccatgtcttattctacattcttcatatgtattaactcattcaatccttacagtcctatgacgtagtgttttaattatccaaagtatacacaagaaacttaaggcacacagaggtggagtaaagtggcacaaacaatcttattaagtataagagaggaactcgggcagtctggctccaaagctgcgctcacaacaacatgctatgagtgatttctcatagctttattatctacttttagttcatagcatttgcagttattgatccatggtgttttctcaaatgacaaaatagtataagattctgttttgatcactggatgtaaagtgattgtggttagcatgttgtgtcttttgattggacaagctataacagccaaatatctcttgatggaatgctcgtattgaatttctcatcaaaatatttttttccaaattagttttgaggtatagatttgctatcaggaagtcatatgagataacattacatttaaacttttcctttcagagtttctctcagtaaattcgaatgtttgaaaacaaggccactgtgaaccatttaagaatcttcaaccaaaggaaaaaaaaggttaaaatatccccatactcttgttttcagcaataatagagaatattttcacctttcaagtacagactaaatattgatttatacatacagaaacctactatgaatgagattattttattaaaaaggaaaaaaatttgaagagtataaatacaatctgaaaggttaaaaaagaggtaatactaagaagaattcagtttgataaagacatattgtgatttcctctggttactttatcgccttaatagttcagactaagaaagtcactaaatttttcaagttaacttaaatttttggtggtatacctttttagagtaattcattttctcactgtgataatatctttatatgctaaaaagcctgaaagtatatttttgtttaatgttcctgccatcatttaggagagaaatattcagtatttttatatactgaaagttatcttgattcctgagagcttacattattaaatcttagaatgcttgactatattaattttttctttaatttaaaagtttttcacattaatttttcaattaaatggttaatttgcaatttcatgatactcaagaaataattgtctaataggattgtgctatcacaaaatcttagagctagaagatcctcagagattaatctagcttaaatcactaattttacacttgaggaaaatgaggtctgagaaaatatgtgagtcactgaagatcaagtagataattagaggcaaaagtagaaagagagtcttcagactattgcctctaagtaagggatatttgaattggaaccagggaaatagtgtttcgatttatactatgagatagtaatacacagtggttagggcacaggctttatatcaagaaagcctgcatttaaaaaaacccaaccaatcacttattaactttatgaacttgacaaaatttttcagccctagattttttatctgtaaattgaaaataacaatattagttacctcaggagtctattgtgacaatcaagtgggctaataaatgtaaagcatttacaacgatgtctggtacaaagtgattcttatgctagcctatattattgtaaaattgcgactgtttctcatctccaatgcaatataaatctgttggaggaatgtttgaaaaatacaaaaaatcagaaataaaatagataattgataatacctaaaacgattagccatgtacttcaagatttttttatttgaatcttttattctgtgtacattttgctttttcacttacattttaaaattctgttttacaggattatacttagagatctgatttttggcatcagggaagtctagatatcctaattttcacttgctacaaaatacctaaaatactgcataaaatacaaaaataatatttttgatgcattgatgagctttcagcaaaataagtaactcaatcactcatttaagtccaacaccaagccatatgacaaatgaagatagtattaatcctgaagatgtcacttagcatgggggtatctataatcagaacctgagtggcctagagatttttaaatattgtggtaagagcatcacacaaaatgtaacctttaacaaggttttaatcattaagtataatattgttaatgtaaagcttttcatggacctttgcaatgcgtatggaaaagagatttgggcccatgggtggttggggttttctctcaggttgtgtaatcttgaatgcacaaaggactatcagtaggagtaagtttaaaacgaaaaacacaaaaacaccaaacaacatagcgattaaaggggaagtggggagtatgaaatttgtctcagccttgactttagatggagtgtggagaaaaatctcttctgagaatttattgtatgagaaggctgtcatgtggaagtggagccttagcacatgttatttgtatagtgcagaggaaataaacctagattaagtttaaaatggactcagggctttcccaagtattttacaaaaacatatgtaaaatcttccttgagtgttatatcttcaacccatgcattttatgattctcacagagaagataccacaacataagcaaaatcacaaaacaattatcaaatacacaagggatcaagggaccatgggtgagagacagcagacaaaaatgagaagcaaagtataaaataggtatggttaatttgtttaaacaaataagacagagtcaaatcattaataaaagcaaaatacattcacaaacaaccagccagaatcaggagaaaagggaaacataaaacaaaacacatgaagaaaacagagaacaactggaaataggaaatataataactaaggtaaaaactcactggaaagttagcagaataagcacagctgaagagaaccatagtgatcagaagactgatatgaagacattttgcagaatcaacaatagagcattaaacatactttaaaaattagatacaggttataagacatgagagattatcaaggacctagagatctatagtatacgtatggaatgggcaacaaacagtattttaggaggcagtggatgttagcatctggtagcagggagaatgaaggaagctaagggtccaatttcatagtagactttagcttacattctctatttttaacttaaatctctccgtttttacctacttgttcctgttttccagtgatgtgctaattaatgttggttcgctgaacaaaaacataacttaaaatgtaggtgtatatgttatatatatgtgtttattgtaaatttttctaatataaaagaagtgtaacaaataatattttactgttattagtaaattattagctgagtgtacattctctatagccaattgattctcacagaatgctttcactgatttttgctaacttcttatatccatagccaacatatttgtgcaatttaataataatttggccattggtgatgcatcccagcccactaattctttatacaataaaattatgaaaatttcttctgatatgttttctactgttaaactatttctcattcttctaaaagtatatttactaaactgaaatatcaccttgagcagcagatacaacacacttttaggtttgcctgcattatttatattttcactattactttattaaacctagacaaacaacaaaacaataaatcaagctctgatttgtagtgtttgctgatttccataagtgtgtaaatattgacactatggccaatttcatttgagctatcagtgtgattttactgagtgcagagttaaaagatgtgcagtgacacatcattatatagtattgtatagtatttccaccatactaatacagatacagacaaaatatgatcgagagcatagctaatagtaaaataattaggaagatgagaatttttattttatcatctttgtccttaatataattgagagtttatataatttaattattaataatgcctatgtttaacaattgcttaccacatttctaaggatacaacaatcagctctcattagccagcaggagaaggtgcctgtttccttctggtgtccatgatcacggagcagctcccacttattttctccagagagcattctcctcttatgtggcatgggagagggaaaaagatgacagcagtaaaagattaagaagggcactggaaattcctccctgttctttttgttttgtgttgttttgttttgttctgttctgtttgagactgagtctggactggagtgcagtggtgcgatctcggctcactacaacctccacctcccaggttcaagcaattctcctgcctcagcctcccgagtagctgggactacaggcacagccaccacacccagctaattttttgtattttagtagagacagggtttcaccgtgttgcccaggctggtctcgaactcctgaggaaaggcgatctgcccgcctcggcctcccaaagtgctaggattacaggcgtgagccatagcgccaggccccactgttctgtttacacactttcagcaaatacttttgttttcatccatgcctgcacccataacttccacagggactcatgcctccaatctgggcttctctgagggcaaattggatctattattattgttcctcccattgaaggcatttaatatgaaactgtccattctcctaaattggttgctatgattcctgtcgtctccaaatcacttgaaatcttttattttcttttaatcattttcctttcactttttctttgtgtgttagaattttattttgtgccagtaattgtggggtggcaggtggctgctggagaggtaaaagcaataattgctggtatcagtccttcaatatttaatcagaaatatcacttgatgtttcttatattcataatcccagggctcactagatacagttaatagtgaaaaaacgatacaaaatacggaatagtaaatattccatcatgtctttgtatatgttacctcagattaaacagtagaaataataatttgttgttttaaagtgtactttatcaacccattgaatttttttttctcgtatgtatgccaagaaaaaggtcagtcctatgtcctcagatatgcaacatttataggtgtcagagtctgagaatcttaataaggtctattattttggaatgttaataaatagtaccatggtatcaggtgctccatcttagtatggacaccatataagatcatttcaaacctcctcagtacatctgtcatcttatatattgctataaatcatccccattgaactacttcaaaatgtttcacaggcgactcccctaggtattcaattaagcactgaggtttgcagaaaggtgtcaaaagtgaaggggaaagaggtggaaaatggaattggatataacatgcttctttctgtcagacacaatttcttttcctcaaatagccagaaaacgtgttaagggtttgtaacaatatataaagaagtgatgaacagaaaaaggcataagcctgttagtgtgtatatgggaaaatgggttctacacatgtataaaaattagatttttaaaattttaatagctgaatgttagatcactaacataactgaagcacatattttaaaatatgttttttcttttttttttttcttgttctttactgggaagaacagggaagataaaattgtaggttttattcacaataacacaatgaaagtaattatataataaaatcagtaattatattatataatacatatttataaattatataattatattataaattatatattttatattattatataacaacatttataaaatttaaatgcaatgcttataggaatccatttggacagtagtgttagaataattcctgagctcagataattataacagtgtgataaaatgttgttttattcattttggaaacatttctgcactcaatattgtctatgttcccactgtgaaatctcgggtctagacatctgtcattttacaaaataggctataaggaaatcactgttgaacatggtgtagccgttatctactgctctgattatgtgttttgagggagcagaatataaaaaatggctaccctgatgcttgcatagcttatttctccatccttgtacttcatcacaaactccgtgtgtattctgtgttgcacatataatgagttagagtacttagattcaacttcttatatctcagttatttgtacttgtaagtggacttgtagttcccactgaaataacaagtctctccttttctgccccacgaaaaccttctcactctttagtaactgctcaagtgtcattttctttagggacttagcctttgctacatatgaaagctttccttaacctgatgtgttgtcctaaggattcctctctttagttcttccacagcatcctatgcttaatgcaggaactattttcctatactgtaatcagcctttttcttggttttagctcgctaaatcctaaacatctttagagcatggcttgtgtcttctttttattcttaaccgaaagtaggtatttgtaacattaatagtttgtcagtttcctctagtgaggcattttattgtgatggaattaggcattgataagagtgaagtaggaagaaaatacattacggaggctggaaagattagtaagttatactataaatgcttactaaattagatggttttaaactataatccaattgtagacaacatccatgtgtgggattaattaatgtattctatgcattgaaattgtgaactaaaataaataacaaagcttctgtataaagggttatcatattccaggaaggaactatttccttctttttttatagtgagtattaatgagtataatgagaaaaaaaaaaagaaaaaaacaagagatctatctctctgttcttctctttttttcctgtttctctttcagaagtaatgagttttgtaatgttccctaaagccccaaaattcagatatctgctaaaggctctcaaagtcaacataataaaaatcatgctttagataacaatatgtatcttccaaaaactatagaactcagatcagtgtccatacaacaccagaaggaagggtagaaagtaaactctgatttgagatgatggatagataagccttaatttagaatgtgacataaagcaaaggcccagggcttagtgctggtttactgagctctaggattatctatcgttagtcaggacttgaatgaaacccttgagttattttacctgtaaataacaggttaggttctattatgtgtttttaaaatttaaatctttttaaaatttaaaacatttatgtacaaatgatacttctcttacaatcacaggatttctaattaggaaaataattttaaatactttcaaatgttgttttcattttttaaattatttttttaaattagaaatcctgtaattgtgatagagaagtctcatttgtacataagagttttaactttttgttttaagtagagtttttatttaacttgggttgcagctgaacaaaacatgtttttaacattaaacaattttactttcatatctgtttgcctatcttcaactctgcatggaaagtatattgaatagatttttaggatattgtcaaatcttgtatcaaatccaaaactctgatatctacattgatataggatatttcatttagtcgcaagagaaactgttgataaaagaacactttccccaatgaacgttttaatagcttttcaagggtattggatatgcttgattttgtgttcaatttttttctgcccaagaaaacactttgtgttactgtaatcaactacaaataatgtcttcacatttaaaaggctgaaaggttctcagtttttaataataattagaaataatgaatgctttgttctgtctaaaatatatttcattgatgttcagaatttcaaacacttcatgtattcactatttcaaaggtcatttaaatttgaagactttgcgctttaaaatctgaacatggccttaaaatttatatcttttagcatccttgctaagtacaattagctgttttttggaattagactattatcacttttatcacatattaaaataattctttaaaagggcatcagtttacctatttttccactgaaatagtttttaattttgtattttcattcctttatatggtttttatgcacttagaaattcaaagaccagtccgggcacagtggcttacacctgtaatcccaagaatttggaggctgatgcaagcatgtcacttgaggcctggagtttcagaccagcctggtcaacaatgcaaaaccctgtctctactaaaatacaaaaatgagctggtcatagtggcacacacctataatcccagccactctggaggctgagacatgagaattacttgcacctgcagacggagtttgtagtgagccgagatcgcaccactgcactccagcctgagccacggagcgagattctgtctcgaaagaaagaaaagaaaggaaaggaagggaagaagtgaagaaaggaaaggaagggaagaagtgaagaaagggaaggaagggaaggagtgaagaaagggaaggaagggaagaagtgaaggaagggaaggaagaagtgaaggaagggaagaaatagccaaagaccatgactacaaattatacattgaaagtagattgggttaattaacaatttttacagtgttttctctttatggcatggcaaaataatttcggatttcattatttcatttcatattttaatttatcccctagtatctataagaatataaaatcatttactgccaagatacaatgggaaaaattaacagtaacttagaagggcacttgaattgatgagacagatgtagcaccaaatcccctacataagtaagccaattaaatctttgtcagtgaacatgcagcacccaagtcccacagacgtgaagtgacaggcttggactttgaacccagggccataagctctttctggtgcatgacacacattctgagcatataataagtgctaatgtatgttcaatttttcattgtatttttctgatttgatgtttgttgccaagaacacagtatattgagtatgcagacacatctcaataagtatttcccctataatgtgaaagggaaaaaaaaactttgtttctcagtagctttatgaaaatacaacttaaatttggaaaattagactgcctctaaaagagcaaatggtgcattttagaactcctgggagacacaacaaagggaacaaacaaaagagccagatggagaggttggaagggagaagaagattttcattttgttagatagcaacaaatttttcattcaactacatataacgaattcctagatcctaactacctggtttatatattcgtaccttctctctgtcttctgttttccactattcttgagtcaatcattatttgtgatgtcatggagaaaaaatgaggtaaggatttctgattatctcaggtttgaggttttgaagagattgaataatgattttggggtacagcttgtgtctaaatgtatttacattttcaaaggaccagaatatccatagattaaacttaagggcataatggccatatttgttaaaaagctaaaaacaaaattaccagtttatcctaaacttaactaaaggtgctctaaatacacagaaatcatcattttgccaagtcaactgcattctactatttttttttttttctgatgctggagaatttggcattttcactatatgaatcaccatcaagattattactttcacaaaagagaggaaatcggcagaactgaaatagataagcacaagtttacctctcttctctctgtttttaccatcgtctatagcaggggtgtccaatctttttgattctgtgggccacattggaagaagaattgtcttgggccacatataaaatatactaatgagctagaaaacaaaaattgcaaaaaaaaaaacaacaaaaaacaaaactcataatgttgtaagaaagtttacgagtttatgttgggccacattcaaagccgtcctgggccacatgtgattggtgggcctacagtattataaaaggacataggagtcttatgtcttatttattctctacaaatttaaaaatttgaacttctaatgttttccaaggtgatgtacaacagaatcatgtcagagctgaatattgtaactgtattgttcctagggcactcttaaaacttccacagctatggctgccacaaagtactgcatttgcttaacactcaaggttattggcacatgtgcccttttgcatttgaacaaaatctgtgttttattcacgtacaaccaagatgtcactttataatgctgcaaagacatagaggaaggtgtagaaacacacacttccagaaaaaaatactaagaggcaaattactgattaacatttaacattctaaatcattacttaaataaataccaatttttgaagatatggacagaaaatgaaagcagtcaaagcagtgtttggggcacatatgttaatgcattttaataagatggaagaaactaaatgacagggaaaatatattagaaacatttcttttttttttctttttttttttttttcagacattgcaggccatactgaaaagtcactgattttgtatttcagtgtaatatctaaaattgaattttaattcgcatgcattcgttgcagagagacagagagagagagagagagaaagagagagagagagagagaaattgagagatttaagttgattcactgggtcagacagaagtatttgcagctgcaataaagaagctttccccaaactgcattgccagatcttctcagctctgacccacagtcactgtgccaaaagctgccaggaatgccaagtgcatggtgattttgtgacgtagagaaatagggttctgggtgagaatacttaattgtcttgaactacaatatttgcttggtatccgagccaaagtttccagacataaaaaacagtggtaaaaatccacagacacaaaaatactttgtatctactgcctcaaagtaagcaggacctttgagcaagcagcactttgagtttgatttcggctgttgtttttaaattgtgatggctaaaggaaggcagtctagtttgtttatgtgtatccttgagactaaagatatgctctcagttgcccttagactcccgatatttgtaacttagatatatttgctgtatcttctcttctgaggttatatatgtctttattgtttcttaatcaaatttaagtataggaacatctctttgttatttctcataagtttcttgggattttaggtgttattcggaaagtttttttttccttaaatatttgaagtttggggttttaatctgcgttgtttgtattttaattgagctatgggaaattatggaattttttcaaattcttgtggaattcactctatacctttaggaaagaaaatacgttgaaaacttttatataatctccagggtaaaaatccttacaaaaatatatacaattttaagctaatttttattagggaacatttcaatacaactaacatttttgaaatacatttttagtgattgaaaatgatcttcagtatttcaatgatttcaggtacaccatgttgctaccaattaatccttagaaaagtcattttatttactagagtttattgcatctggttttgtcatgtaagtatccatttaacaatattatatttgcataagaactttttgagtacatcatagtagagtaagtgatgagcaccttctgttttctgaaaaaaatgggttgataagaatgaattcatgcttggagaattatgttaaaaattggtgcctgataaatcataaattggacaggctgcctgtcttgcataggtcttttatcaggtattatacaaacaactgattgtaggatgactgcatattttaaggactattgaaaattagtggatactgattttactgttagaaccctagagttggtgggcctgccgagtcctgcttgaattactatttcgttgaagattattaatcaccagctgccatcacacagtggcaggattccaaggcagcactctgaggactcctctgttcattcctctgtcgcagggtgacatagtatagaagcctttttggcttctctgcaaaagaacataactgcctctaaaatgtgtgcattatcaccaagtttaaagttagaggatgttcaggaaaaaaaaattctcagatattttattgagaccaactgagtacatatgctttttgttaagaatcatgttaattcaaaaataaaaaagttccaatatttttgctcacaatcctttgttctccctctatccatccatcacttggtgatacatttcacagtcacatggtggtaggggacagtgtgggaaagagaaagactttggcctttgagtcctgtaaattattcagttgtacattctagtggtttccatttcgtcagacttcaacatactgtgaaatggtgacatgtcaaaggttgcattattggttgataatgcagctctgtaaagtgtgtgagctcgggtcccagcgtcccctgccaacacacacagatcccaggacaggtgcaaatttgacttcacacatcacagttgaacaagccaagcctgaatataacctgactgggcttaacttttcacttcttttgcaatctgctttcttatcacttcttagattgttttttttaattttatttgtaagagtaagggaaatttggtagtttataagcctgagttcaaacttccatgatttctcagttgtcaaacgtattttctgagaaatgccctcatcaaagtaatcagcctaatattttttatttcttattaaaattacattatatttattcaaatttcaggtaaatttaaatataatgtaatttttcaaaataattctttaatattacacaaataaggaattattgcctttagtttgttctcataatgtttttgaataattgcctttcaaaatgcttgacttaagaagaggaagacatctacaataaaaatttactatgcagatttttttaaatttacatttgctactttttagtagcctttaaaatatcattttcatctaagaagcatgctgtgactgtgtttacagggttaatcacataaattaaaggaatgatgggaagaagttataagcagtatgtagagtaagttaactaaaagtggcatgttagctcaaaatagaatgtatatttttggcataatgaaacacaatgcttggtcttcttctaagttaactttttaaattaaatacttggagttgtattgtgaatatattcgtgtccttataaaggaccacataacttgtatctgagaacttttctttttgttgagatataagtttaaaggaatgtgaatttctaataagactaattcagttggatctcttaaatcttaatggattatggattagtgactgaagaaaaccaggtagagagagcaaggatattgaactcctatacatctttaaaactttaatcattgaacttatttgcgtgttctttggagggaaattagccctccagctggcttccaactgtgacagcagcttttattctaacattagtagaaagaattgtataatgatgctagttcagacttttttccttcctgatatatgttacaattatttgtcatggacaagagtccatgttttcaaaagagaatagtatctggtaatattatcattctattccagctagggtaatgtggggaatagaagttgttagaaacatgtgaatgcaaatttgcaatttaggaaactcaaaatagacattactgctcttcatttcaaagcaagttttagtgacattaaatcaaaactctccagttttatttttactataatctcctgacatgtatagctcacatcatgttttattgtaatgcttagtgtcagtcatttctagatttttttgcagtgactaattttatttttgctttaaaaatttatagaatagggggattatttatttaaaatctcttaaaataaatacatgagtgtaaaatctgagacccttgctgttgctcacattttaaatttgaccatgctaactcagtgtagaagagccagagaacaaactctgtaaccagaaacccagcttccattgccctctttagtatctacatgccatgttaccttgggcttactgtacaatcagcacctcagttccctcttgttaaataagactaatactagtacatacaagggacaaaattatatatataaaatattaaataatatataaaatacatatatgtataatatataatatataaaataaaattttatatatatagcacttaacagtaggtaaatgttagctattcttccaattgactcattaatgaatcatgagaatcttttatgtgataatgaaattcgagagtactaagtgaaataattgcacagtgcttataaatagggaaataagagtgaaagataatacaaattaattgaaatatgtaatataaggaaaaacagatgagaactcttgtaaataaaagattaatgaaatttagaatctattgaaagggatatttgttatttttaataacaaatttatttttaatattaaaaattttaatatttgtctttgaaaatttaatatttgtctttgaaatatctaatatccaaattctcaatatttcatatgatagtttttgttctatttgttcagtttttataaataggatatttcttacaaaatgtgtttgattttcaaatataactttatcattaaatttgtttagtatccttatgaggaaatttgcagtcatatttgataagtacgcataatttatttcactttccatgcttcagtattattttataatggtattttcaatttgtaaaccagactgtaatgaaactcttccctcataattgtttagaaataacgtatctttagaatgtgtcaataatttgtgctctctagaaagactttatttgttatactttaaaagtggaatctatttatatttctgttgcctaaccaaaatagcatatctaaaatatggatagagttactgcttttcaaagaacatatttaagatttctcttaatatcttaatttttatcttatatatagatcttatgtatgtctaaaagatacattaggtctcatatatctaatatttgctacagttaatataaaaacaaatgaagattaattgacttagtttaatatttctatgttcttgcttaaggaactgattggttttctcatagggcattgaaagagcctaatgaaaaaaatgctataaacgttagacttaaaaagatctagcttcaagttctgttctgccacttgtaacctgagaggttttgaataagcagtttagtatctgtgaagctttgttttctcctatacaaagtggagataatcacatagagttgtgataacaactatcacattaagatgttatgaaatgggggaatgaggggggcctggatgatgagaaatgacttcatggatacgacgtggattattgccatgatatatatactaaaagccctgacttcaccactatgtaatgtaacaaaattacacttgtaccttataaagttatacaaataaaaattttaaataaaatatcactctaacaaaatatgaaataaaatgagattacatatgtaaagcacttggaacagtatctgataacagtttttgcaataataattatataaatatctggcatttaactactaaagacatgttcgtatgtgtattatgtaaaattgaggccttcttgaatcttatgatttctaacacagacacttcggctgaaatgccataaaacacttagagatagacattttgcagagtacctggcaatggcatatataatataaaacacatatatttagtgcataatgtgcataatcctcaaataaaattagctacttttagaatattgtttttcttttaataccgttttacacaaaatgggctatcagaacagtagatcacatatttatttaaaaactaaaggagtgagttgagagagatacatgaaagaaaagaaagtgccacatgtggtatgccacctttatagagatttaatcttatataaaaagctctaagaattcctgttttaaagaaccttagacatttacttcaaacataaagctactaagattatttttgattgaatcatttttagatgtatttatcaacattctactgaagaaatgttccactgagcaaactattaaatggtaatgttagaatgcatgaaaaattaacgtaaaatcataggtcaaacagaaatgtaacactatagatctagtttggaaacaattaacagctaaagcccaggatatgactaaagagaaaggatctctgcttagattacagaatggaagaaaataaattctgataactaggtaattaagtttggcagctagggatgaaaaagacaactgaaaataaaatatggaagaagtaagaatgaaacacagcaagtactcttttgagaagaaaaagagttaagatttttctgtcccagcactttttgaatctaagtcccgtaatatatataaaatgagggattagactatattgcctctaccaggttattgcaagcacttaaacttgtaattctcatataaaataaaaaaaacaaaaagtatattcttccaatattttccttaaatatttacacattacatgatacattttatttgtgaataactttaatactcttaaattagaatgttataaatgctattaagttatctgttttaatataaggtgtgtgtgcatctagtaataggaagaaaagaaggaaggaagaataaggacgacaaaagaagagagggaaggaaagaaaaaacttgtcaaatatttcatagctgatctaattttgtgctctttttttctgtgccacatttattcccagaagtttctttggtggatcaagagatgtgaagccagtgcctggtatggaggagatgaacatacctgaatctctcaattttaatgacaatttatttttttactagacatatagacatcctaaatatatatattatgaaaatttcatattatattaaaaggaacattgttcctttttgttactttattaaatttaatttttttaggacaggatcttgcacttttgcacaggctggactcaatcatggcttactgaagcctcgaaatcctgggctcaagcaatcctctgtgtctctgggactacaggaacatacatgccaccgagcctggccaatatttttttttcttttttttttagaaatagactttatgtatttaaacataaaaactgtgaaaaagaaatcatcagaattcaggaggtagatgatgagaaggggaagatattgatcaaaaggtacaaaacttgcaggtataaaatgagtaagttctggaaatgtacaacatgatgacgtaacatagttaataatcatatatgcttgaagtgtcctaaaattattttaaaaatgccaacttttattttcaatacagggggtacatgtgcaggttttttacatgggtatattgcacccaggtagtgagtatagtacccaataggtagctttacgatgcatgccccctccttctccctcctccagtagtcttcagtgtctattcccattcttaggtctatgtatgttcaatgttttccttccacttataaatgagaacatgcagtatttagctttctgttcctgcattaatttgctttggaatgatgaaccctagctccatctagtttgccacaaatggcattatttcattcttttatgactgtgtagtattagatgttgtatatgtaccacattttctttatccaatctaccattgataggcgcctaggttgatttcattatctttgctcttgtgatgtttcatgttcagtgctatggcaatgaacatttgggtgcatgtatctttttgtataaggatctgttttcctttgagtatgtgcctagtaatgggaatgctaggtagaatggtggctctattttaagttctttgagaaatctccaaattgctatctacagtgtctgaactaattttcattcccaccaaaagtatgtaagcattcagctttctccacaccctcatcaacatctgttatagtttacttaatagtagccattctgactggtgtgagatggtatctcattgtggttttgattggcatttctctaattcgtgatgataagcattttttcatatgtttgtgggctacttgtatgtcttcttttgaaaagtgttgatgtccttttcccatttttaaatggagttatctgttttttacatgttgacttgagttcttcgttgattccggagatgagacctttgtcagatgcatagtttgcagatatgttctcttgttccgtaggttgtctgtttactctgtttatagtctttttgttgttgttgtttttgttgttttttttaaatgcagaagctctttagtttaactagctcccatttgtcaatttttggttttgttgcaattgcttttgggaacttggccaaaaattctttgtcaaggccaatgttgataaggaaatttcctaggttttcttctagggttttttatagtgtgaggtcttccacttaaatctttaatctacattgagttaatttttgtatatggtaaaatttaagggtccactttcattcttctgcatgcttgtttatctcagccttgttgaagatcagatggttatagggtgtggggctttatttctgtttcttattctgatctattgatctgtttgtttttgtaccaataccatgctatttggttactgtagccttatagtatagtttgacgttaagtaatgtgatgcatctagctttattcttcttgcttgggattgttttggttatttgtgctcttttttggttccatgtgaattttagaatagttttatttttttaattctgtgagaatgaccttggtagtttgataggtataacattgaatatgtacattgctttgggcgctgtggccatttcaatgatattgattcttctaatccatgaacatggaatgtttttccatgtatttttgttatgtctgatttatttcaccagtgttttatagttcttattgtggagatctttcaacatactactggaagtcttagccagagcaatcaggcaagagaaggaaataaagggatctaaatagaaaaagaataagtcaaactatctctcttctctatgattccatagttagaaaaccccaaagactctgccaaaaggctgctggaacttataaacaacttttgaaagttttcagaatataaaataaatgtacaaaaactcactagcatttttatatactaataacatttaggctgagagtcaaatcaagaacgcaatctcatttacaatagctacaaaaaaatgaaatatctatgaatacagttagccagctaattaaataaaaaatttctatatactgggtctccttatgttgttcaggttggtctcaaacccctggcctgaagtgataccttggcttcccaaagtgctaggaatcacaggtatgggcctctgcacctggccaaatttaaaaaaaaattgattgtttaactgtcatacatgccttgatttcagaagatattttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtggttttgatttgcatttccctgatgattaacaatgttaagcatttttttcatatctctgttggctacctgtatgtcttctattgctatttgtgtcttttgcctattttcaaatggaattttaaaaaaaaattgttgaagtgtttgaactccttatattctggatgttagtcccttgtcagatgaataatttccaagtattttctcccattgaagatgttgtctcttcattctgttgattgtttcttttgctttgaagaagctttttagttgaatatgtctcattaaaattttgcctgtgcttttgaggtcttagccataaaatctttgcttagcctgatgtcctgaagagtgtttgtttttttacggtttcttatagtaattttataaatttaggttttattggaagtctttaacccatctttagttgacattgtaagtggtgagaaataggggtccagtctcattcttctgcatgtggttatgcagttttccaagcaccatttattgaagaaggtgttctttttccaatgtttgttcttggtgactttgtcaaagacgagttggcgtaaatatgtgggtttatttctgggttctctattctgtcccatttgtcaaactttataccaatatgttctgttttggttactatagccttgtcttatatttcgcagttaggtagtatgatgtcccagctgtgtcctttttactcagagttgctttggctatttgagccttttgtgttgttctatactaatttttggattgctttcttctttgtttttatgaaaaataacttttgtgttttgacaaggattggattggatctgcagattactttgagtaatgtggtcattttaattattttgatctgtgagcatgggttgtctttccatttctatgtgtcctttttaatttctttcactggtgttttatagttttccttgcagagatctttcacttctttggttaaattcatttctaagtattctttttttttgtagccactctaaatgggattgacttcttgattttttttcatctacttcattattgatggctagaaatattactgagtttgtatgtgattttgtatcctgtaagttaccaaatgtatcagttctaagtcttcagattttccccatataagatcatgtcatctacaaagagggataatttgactccctcttttccagtttggacaccaattattgtgttttcttttttctttttttctttcctgattgcactggctaagatttccagtaccaagtttaataatagtgttgaaaatagacatccttgtcttgttcaaggtatttgaggaaaggctttcaacttttccccattcagtattatgttagctgtgggtttctcatatatagtctttattattttgagatgtggtccttctatgccgagtttgttgaacattttatcttgcagagtagtagttctatttttatttttttgaggaacttccatactattttttataattgctgtactaactggtttgcctagcaagagtatacaagggtttccttatctgtacatcctcacactgactagcttttgtattttttattttttgataatggaaatttgtaacaaggtatgaggtgatatcttattatggctttaatttgtaattctctgatgataataaacatctctttttgatgtcattaccagatagtgtttgaaattgctgaaaagctgctatccattgttctccatatactttttgcaagtgtaaaggtctaactcacaaagttaacaacaatgctgagaacagtacattctagcaagttccttacctagccaccatgaaagaaaaattaaaaaaaaaaacacttttctaatcatttcacacagtaacaggccatgaaaagtttgtgaaattggtctgtataatggcacatggttaacaattacagaaatgtttcaaaatgtactaaaactttaaaatcatcacaatctaatcatagaaagtagttctaataccacatatgactctaaacctacaattgctctgtcaccctctatggaaggcaatttcctgtgagctctcccatgcaatgaaaattaataaatctcatgctgaatccctgagaaatgtgctgcttcttgagagaatattaacatgaggaattaacttgtgttttaaagaacattttttagcaattagagtaattttataagatgtgacgtaattaaggtaggaaaacagaccaaagttggtatatacaaatttttagaaaggtaaacattatgtcaaaatatgttctgaagcaaaggaatatagaggatgctaaaacagaagtgcccatattgcatttatttttttttctataaaccattggtttgtcagcttacagtatggaatttccaatcataaaataaatgtcaggaaattagctgcagtatcttaatacttttactgttgctttcaaatagtacaataagaaaaggctttcttttaattaagatatatattttggggaagaaagagtgattattcaggggcatttgaaaagttggtggtgaaagaaggctccagggcatcacttactacttttatcaatataccatcacataatctgtgtgaatcatttacttggattcttattgtacttatttgtgacttcatagtgtctgaactgtcactttactttctttattatttgtcagcctctacacttatatttattcttgttgtttcttaaattcaagctgaatttgatggtatgttttcctaattaatatttttcattatttttctgttacaccaaatatgcgtatactcgtgctatgaaattattcaagcagatagcgtcctagatcattttaatgttttacaaatatgtatttttggttcacatggaaccagcttaaattataccactggatatttatttatttttatttttaaaagtaaaacatttagaattaagcgtgtgtcatttcgatgccagagttaactttatcagtatctgaaagaggaaaaacaaaaagcaaaaaacaaaattaaaaaaacactaataaatgctctatttgttttcctcagtttagttatgcaggattagtttattttaattttgtttttattttttattgaaaaaatccttagacatttccctttcataatacagcctttgataatggagtttcccttgtcattcagaacattgtccttctattcagaatataattagttgaaatctgtatctcaatatctgtgcatgctgtggcaaattgaaataacatgtagatgtgtatctttgttcagacatgtgaaatacagtggtaggagaaagaagacacaatttctgtaaattttatctcccaatgactatggactttgctaatatattgtgattgtttatgatatcattgagttattagggtaattatttactgttctccacttttttacatgaaatggagcttcagcccttataagtaagaaatattaaaacaattaaatatactttactatggtaaaaaatgttgtcaaatatatttataaggcatatcatgaccttatgggaatataataaatgatccattcaaagtagatttactcattatttcaaacagtttagatacggtactccttattccagttacactggtagctgaatagtgatgaattattctaatttctctattaaatacttctattaaaatatttcatctcattaaaatgtgaatccacagtatatataacttcagaaagaaatgttcagagaaagtgagtgtgtctactgagcaaacagtgaagcaagaaaaaaggattgcacagggaattagattagccacgctggtaaaggcatagctgaagccccattaggtctggcccagacagcatttgtgtttggaagagctaagcaaatcacattaattaatgcttacaattttctttggtgaaaggtcctgatgtcagagagaagacagacattttcttttttatctgtacattatacaagcccacccaggtcactgggccattggaaaggaagcaaaaggaactgaagcaaaaataatcacgattttagcctcaaagcaaaaagaatgcttactcatttacaccattccttttattagaatgcttaattttgaactacaatgaatgtgtttgcatgtatgtgtgtgtgtgtgtatatatatatatatatatatatatacacacacacaatcacattcattgtatgtgtatatgtatcacatttattatatgtgtatatatatatttatgtacacacatacacacatttgcatgtagacatatatgtgtgtatgtgcatttcctttccagaaaattccaccagaaaggactctttgaccaaagagaaaattaaaggagtactgtagtgttattttctacactctagttgtttctacaggactttctgtgccccaatagattacaatgtcatgtagatgcagaaataaagatggttatattataaggaacacagagtgcaaataaaatactaaagttatgtataaaacaaaattatatcttctaaaaataaagtaatatagcatctaaatcatataaagccaaatgagtgttagcaccttcaaagccactatgctaaagtagttttcatttagttattgccatttacatgttttttacaaacaacactttacagtaatgcttagagcctgcatttaaaggagaggaattagagaagggaaagctgggtaaatacacaggaaatccagttgattgcttagacagagcctcatgtagtagcaattacatcactttggtggggaatcaacacaaactgatctctcacttttcagatctcgactttagaatgtttcagatagagcactcaaagataattttatttaagtgcactcacttcaagattgttgcatgaaatgatatataaacaaaaatcataatacagtattcttatgcatttaccataatatttttgttttctaagatgtactcttcctgatcaatactttagaaaacataatgaaaaaatagaaaatattttgggacaaggatgtggggggaaagtaagttatacaaaataatagtccactgagattgaagtgtgaaagaataaatccattcctgtgctacatccaatgctctctggtaccccacattttccagattcattaacactcctggaaaatgctttctgatactgttgaattctcaacctttacatttccatttttgtaagcagcatgtggaaagactagtttttctttagttagtacattctttcctcggataacgtgcaataaaatctgttagatagatgcacatcctttcttataaacaattctaacactgaacgttaacgttcactgtgtacctcttctgttttccgaaattttgtaacagcatattttcatgaaaattattttgttattttttcagatggtagagaatatccacgaaaatatcattcttcccccattcatactgaaaattctaagatgccttaatgtagaaatcatgcatgcaatattcatttttaatggctaatcatgcaagtatatgtggaagaggccagagttgggccaagatttcaaaagtgatgtgttttattcataaagatgtgctaggactcagtaattacccattattataggaagatacaaagaataagaacagatttttcaagctgctatccctaatgtatttgtcttttattacttatgagtcttttagctgggtcagattataaaaggctggttccagtttacaaactgtccaaaacgatgactaagagaaggttcaagtttgctcttgcttggatttacataaacaggacaaaaagtgcaaagaaatgatacatgagtaaatgaacacagcttttccatgtttccttagttccttaccaagcgattagcaaaattcggtagtgtattacttagaagagtcttacgttttatacttctagaacagagaaggaaccatatgcacaatcaagagtttaccagctactttaaaaggtaattccttacttgctcatagacacctactccttcattccatttttttcttcaactttatatcacctcatacttatatataaatacattcatttcccttgcatatacccaataaaacctctttgccttcctatgaaaactgtgatttcttctattgaactagatttaaattaaaatatatgttgcataaaacaagggatgatttcattgtagcatttgtgccaagaaaaataatttgaatattttgttcattaagataaacctatgccttcaagttagtcattttatgattagaaataatagctattatcggaccattttggctaacctttttggaggctactaattattttcatttataacttctgagataaaaatatttctatttccactattgtaggactttgtcaagtggataaatctttaaaataaccgtgggcagagtgtatcattatcagctaacatgacagtatggaggcgttattcgcattgctaacaacacaagcagaaagggagaatggagaatttttttaaaaccattcttttaattttcttcatgatgaagttagaacatttaaaaactaataaagaggtgttctaagaaaattctgaaatgtgacaaaagttatatctaattataattatgacaaataacattaaaaagtcaccctgtttaaaagtatcaaaaaatctaacatctaatgtaagatttcattttcctaaatttaaaaatccttacatttatgagggcctaaatattttgtggccaatacattaaaaaatatctttaaatgaaacagctttaccataagttttagtgtggaatgattcctattaatgtcattcttggttgggtttcggggtgagaatgagctatgtgcctcatttcttaatgaacatttattgatgcaaatgaaaattatataaatattctgaaatgggaaaaggaatatttgttaaattcccaaatatatatttgctccttcaatttacaaatcatacctgattgattacccaactttggaatattttaaatttaatatcagccatttaaattttattgttattgataactagataatttttctgttgtcttaatgatgatgtatatgtttaatttctcaactgaaataatgtgggaaattacacaataaattgtgtcaattaaaaagagggaaatactggtaagtgtaagcattttaaatagagttatctttggctaatgtccaagggtaaatgcatatttctaattctttatagctttagtcaatgagcttaattttgaataactaaaaatgctagttactatggcatcatatttctttatatagtatctattttcatacaaagaaaagaaaaaagtttcaggttactttaagctgaggatgcccacagtttatgtcttagttgataatggatatgaattttcatattttattctgccacgtaaatctcaatgaagccctaagcccttctcatcctcacacaggtttcctttctgtgtatgaaaaagtaaatcattattaagtaatgcaatagatagccaaatcagacaggaactattacaaccaattttgttgttacatattttcaaaggaaacttctacaaggggtaaaaattgaatcttatacattgctattaacgggcctctaagtagaaggaagcatatatttactgcgtcataattttattatggtggcgctccaaaaatgaccaaaaggattcttaggataattgtagctatcaaatactgagctatgttatcttgtaacttgaggctgaagacaataagaaaaattcaggaaatgtatttttaacatatacatgcataaaattgttcaataaaaatggatatatgatgaatcatatccaagcaaaaaagttactttgaatcattgtctctactatatagtattcctaacttctccagacactactttgcaaaccagggataaagaataaaaaaaaaaggtaaactttgaagtgaattattgggatattattgtgaatcgtttttgctgcaggcagcatggcatgaaacagagcatacaaactgggaaaagtagaggagagatgaatttatggattatctggaacatatattccaaatcaattgttttctaagttatttcctgacatggttttgtaaatgcatttaaatcaatgaacaatattggagttttctggagtccttatatcaggtttctgattataaaagaatgtatactatattatttaataaaaagtatgtaattcatcaatatatttaaatacagaaattttaaactgtcctctaattgtgaagtcaaaactaagaagttacttgctattttaagtttgctagagaatgatactgtgcttttgagctcattaaaaataattaatatatatttatcagtcaaacacactgagattgattatcatcatgcaattcatatgctagaggctggagcctgtgtcttcaggccactacacatataaaaagccaaactgctcagccttgatacaagtgaagtgacttgatactctaaaaagaaacaccagcctcttgatggacaaaaatatgaaatgacaagagtaatttcaagtagctccaagtaaattaaccataatatttactaatagtatcatctttgctaataaggattagggcattaataaacactggaaaaataaaatgggcttcaaagttcacttgtgtaaattgatgaaggtcacaagaaatcaaaaaaggttagagataatattgttttaaaagcttaatatactagtcaggaagtaactgggaaattcattgaacatcttttggtttttagggtcattctttctgtaggaatatgcatatactataagtgaattatcacaattactaaaattagttgtctagtatacagacaaagttgttgcctaatattgtgtcattttttggaagcatcaatttcacaaacatatcttttttgtttgcttattttgtggtttacctttttttccaattcttattttggtaagtacaaatggtataaaatttgccatcttatctatttttaagtgtacagttcagtggtcttaaacacattaatgttgtgcatccatcaccaccatctgtctgcagaactcttttcatcttggaaaactgaaactctatcccattaaactaaatctctatcctcctgtccctgcagcacctggcaactggcattctcctttctgacattataattttggctacgctgagtacctcatataagtggaatcatgcatgatttgtcctgttgtgatctgtgtatttcacttcacttaatgtcatcaagattcgtccatgttgtagcatatgtcagaatatttcctctatttaagatggaatcgtatcctccattttacttatctttgctctaacgtttattatttccttccttcttctacctctgggttttgtctgtttgtcttgttacaggtccataagttgtatggagagactatcgatttgagatctttttttcttttaaattctaagtaaatgaaaatgaaatttcatttcagttattatacttcccagctccagattttccttttgattattttaaaatgtatctcaaaattttcttcttagcactgttttgctgcatcccataggttttggtttgttgcatttttgttttcttttgattctattttctagtttcccttatttctctttcgatcaattggttgtgtaagactatgtttttaaatttccattaatttgttcactttctagcttttcttctattatcgatttctaaattcatcctgttgtggttggagaagattttcttttatgacttccatttaaaaatatatatatattgggacttaggtctcatgtgcagttaagaagaatgggtattctattgttgttgggtatcatgttctttatatgtctgttagacctagttagcttattgtgtttcttctctttccttacttatcttctgtctggttgttctcttcattattaagaatgagatatcagtctctaactacttttatagaactgtctatcccttaaatactgttaatttttgcttcatgtatttgatgtctgttattaggtacatgaatgtttacatatcttcatgcagtgttgattctgttattaatacataatgtccttctttgtcacttgtaacctttttaaatttaatgtccatattttctgattttagtatagttactcctgatctcttttggttactatttgtatggaatatcttttttaaatctgtcattttcaacctatttctgtctttggatccaaagtgaatctttagtaaacagcatattgttggttgattttaaaagtccactctgccattcttttttttttttttaatttcagagcttaatctacttatgtttaaagtaattactgataaggaaaatcttctgtcattttgccatttttttctgcaagcattataaattttttgtcctgattttttgcattactgtcttctgtgtttaattgatttcttttgtagaaaaatatttgaattcccttcatatttccttttctgtgtatcctagagcttttttgtgtggttaccatggtaattacatttaacatcctcaagtcataacactctagtttgaatttaagccattttaacttcaataacaaaaaaaaaaaaaacctctgctccttggcagcttagtttccaccctgttcagtagttcagctgttgatgtaacaaaaacacattttatgtattatgtgtccaaaaatgtaaagtaataatttttcctaaagcattagtaccttaaattatgtggaaacaatatgtatagttataaaccaaagttacaataatgctaacattaaatttttcatgtatttatttttactgcagtctttattttttcatatacctttgagctaccatctagcatccttcattttaaactgcaagagtgttttttagcatttctttcagggccaatctagtggttataaactcagcttttgcttattttagaatttttttatttttctctaacttttgaaagataattttaccacatataggattcttggttgacatgttttttttttctagtagttatttaaatataatagtccattgccttctagactgcagtttctgatgagaaatctactgatagtctcattgaggttgcatattataaattacttttctatttatgatttccagattatttatttgcctttggcttcccacagtttgattaaaatgtgtctcagtgtgtgtatctttgagttcacaatatcgaattcattaaagttcttgaatgtttatattcctgtctttcctcaaattttggaaattttcagaaactatttaaatattttctctgcctctttcattttcttctccttcggagactactataatgtgtatattggtcttcatgattgtgttttatacctttagttttcactttcttcagtcattttttatttccatccctcagattcaataaattccattgtcctatatccaaatgcactgattctttttctgcctattcaaaactacctttcaaacagtataatgcatttttcatttcagttattatacttccctgttccagaccttccttttagttatttttaaaatactctatttatattttcattttgttcatacatatatatttcttacttcccctgtgccttccttcagttctttgagcatcttgaagacagttgttttaaagtcattttctagtagatctactatcaggactttctcaaggacaatttctgttggtttattaccttccactgaatggaacatactttactgtttcttcgtatgccttgtgatttttgtgttgaaaactgtatattttaatccaataatatggcaaatttggaactcatatttcactccttcacctggatatgctgcttttattttgatttggtttgttttgtttggaatgctgtaggctatctctatgccaaggattaggctgatgtgtaaacttaagggttgttttttttttttttttttttcagatcttttctgagcctgcatttctccctgggcattcctgaaaactttctaattttcccgtattttcaggtgctgtgaatgttttagtctttaatctctggttcacaaaaatgagaaaaagaaaaaattaagattaaaaaaaacctcacttgagctttatatactctggaagtcacttcagccaaagaaaatgctacttggaacaataagggggagatgtagcaagagtgggtgcctgcctttgtgtttgtccctccttgatcaaatacagcaattaatgatcagaacacacagccccaatgttagagaacagtgtccttactgcccaccctgcctcccatgagttgtatgaaaactgctctagtaacatgtgtacaactacctgccatagagtttgttagtgtgaaaggtggctgctgtcgagttaagaagtgatactaaccaaaatcttcttcagtttaccactaaagccttcccctagaagatacaagcctttatagcattctaaataagttacatgggaaagatttttgcttgtgtaattattgtctgagtgagaaaacttattattggtgcttcctactccactgtcttcccagaattctcttattttgagtttttaataatatttgaatttcaaagacttcctaataattccaaaggatataacactgggtaaaagtagaagtgggtcagcagactttttattgtaattatactttcatgagtcccataatataaaatttagacggtttaatccctcctctgaaatatatgtttcacttattattagaagatacacattatttttaatttaaagataatgactacatttactattttctgttcatttacaatccaagaacaaataaatatccatagcaacatagactctagaaaggtcctccatatgcgctactcaatgcatacttcttacttatttttgcctagactatatatattcataaagttttgttagctggacagtcacccaaacatatgagaattcatttaagacaaatctagaaaattaaaaaaaataccccctagagtgaaaaattgtatacagtgttggaataaaaatttttaattccttattaaagtaaatctcattctcttgcttggattgacatttgatcaattgatgttcaaattaaataagttgtttgcgtttctaaaacagacaacaagatatagttaaaatatatttagttccagttcctgcacttcaagaattaatgtagccctcttcaaagattatgaccttttctaaatgtactccttgtatcaccagaaattgagagctttcagcatgtggtactaccggtatcatcaaactgaaaaagcagaaatgctgtccttatcctttcctgatcattaaatgtcatcagtgataaagcttaagtgaagcagtttgttaagatggaggctgttggtactgctctgtagaatacaggaggtcagattccacagtgtcaaggaaaatcaagctaatggagcaatttaattaaaattaattgagtataattctgtctcttaagaatgagattgatgtagggttatttccagcttttttggcttaaggtgaaatgaatgtccatactttttaatgttatcttcctcaatcttttcctataatcatagttttaacaaataataatggtttatagaagttagaaatgtaaaagacctatgaggttatttaagctactatacactgtgattggatttttttattctctttatgtacctctcatacccatactgagtttagttcataatatagactctaagctgagaagtaatatatattgaggcatctattaatgcttcatttaaaacccatacccttaccttaaattttagtggaatcctgctgacaaacttgtgtgagccaactaggtagattttagttgagcaatctagattcctgcttctatcacaaaacagtttatacaagtcagcagaattggcatatatctgattaaatgtagtagagacagatgtagtacacctttagcatgacttacccatctgtcattgggatatgctgttctcttcataaaatcacttttactactccagaaagttaaatagctcacatttttgcttcctccactctgcttacttatgcataaatattatagtccccttgccaagtagtcagtatttataattaacatatttactagattgacaacattaagtataaacagatagacatggtggtgaccaaaagaggaatatattgggccttgttacttgggaaaagattttagcatggtagtatagcttgatagtatttggtcatcattaagagattaaaaatttctttcatgactttgtttcttcactcttgcgatgtcatttattgcatatattgatacggttttaaaaaattaaaatttacctctcctaaacattttctgcctttgaaaaagtcattgaaaaaatgttttgaatatatacaagaatgaaattaaagggcaaaaaaataagagttaaagttctattcatttttatattattagtctaggagagtggtacatttaattaaacatagaaacttaaagacattgaatacgacttctctgttgctactctatgccttataatactcactgccagacagggtaggtatgtaactactaacaaccctaaaatataacaaatacatcaactggaaagctttgtatattataaaattctgtcagcgtggtagggtacctgagcagcgatcctatggagagctgaaacagagtaactgcaggcagaagatatctttttaaaggaacttgctgataaaaagcttcaacagcatgacatatctctgacttgctgggaaacagcagctgacagagcaaaccaacatgtaacagttggtttcaggggtgaatatataggaccataaagcaaatgaaacttgtgaacagccgccagagttgcaaatcaaaagccattatacacctattccatgtggggccaactgttgaaactaatagcgccctttcctttagattttcttgaataaaggcagctatcaactagtgatcagaccataaggaatataattttacttatgatagagaaattatataccatttggaaattttatttaatctattatccctttcaattttgtattcaaaatcttatcgtaagccaagccaccttccaataacaattattaaatatctgagcttcaattgactatcatgatttcttgcattctaatcaactaaagagaacttccagatatattctgtactgtaggtaattgagctattcctcattatgccggccttgatttgcaaaggtgatgaaatatcttcacagttgatgaggaggctggttgcaccaaaacttgcaaaagtgttttcttcattctcgctactgtaaaataatgtgaataacataaaggactttactaggctgtatactgaaagaacaataaatcattagcaccacaggagagagttgtagtagcctttgattaatctataatctaccactattgcaatattctttgttaatggaattttcaattagaatattatttgaaacacaattcattttacatttattaaacgttccgcatactattatgttgtcattaggtagcatttagcaaactgatcattaaagcagcaaatttggaccacagatttgttatcatttttgggagcttgcagtggctttgggaacttttttttaaactgatttaatgataagattccatcatcttctttcacagttatttcatctcattattcctatttgtggatgaacacttggtaaggtatttactattttgagttcatttttatgcttatgaacattaggtaaacattggcttcatgatactacttactttataaggttttatgtaaattattaatacatatagagtaagatttcaattaacctcagctattttattattgctaacaataaatgtaaaatttcagtaaatgttaaaactactaatttaatatgtaacatatgtagagctacaaggtggcaggaaaagttctaaatgctttgcatatcttaattgtttgacttgcataatataagcattctttgaagtaggtagtattgttatttctacattacaaatgagaaaaccggggcttagagaggataagtagttggtccaaggtcagcttgaggtttggacctgagactgttcaacttcaaaatctgtcctgtcaattactgtactttaaaactctctgccagcagtattgaacaaaataggatattataaaatactcatttgtgacactgatgtttggaacccaaaatgtatatatcaaatataaaaaatgcatactaactgtattagtctgttctcacattgctataaagaactacctgaggctgcataatttatgaagaaaagagatttaattgactcatagttccacagactgtacaggaagcatggcttggaggcctcaggaaacttaaaatcatggtcgaaggtgaaagggaagcaaacatgtcttaccatggcagacaggagagaaagagctaagggggaagtgctatccacttaaacaatcagatctcatgaaaacttactcactatcatgagaacaacaagggggaaatcccatgatccaaacacctcccaccaagccccaccgccaacacttgggatcacaattcaacatgagattttggtggggacagagagccaaaccatatctctagccaatacccactctagattcaagccttgttagattcatattgtatcaaacatcatattatatgggaaactacattcaggcttccattttcagccttcattttttaaatcatgttactgaactggcagttgaaatagtgaccatctccaaatcctaccaagttccaaacagacagtttttcctcctttggcctttgacagaggattcaggagtcaagtataagaaataaggaatagatttttgtcagctgtggacccagaggagttaattgttggaagtgttgcgtaaaagtagtctagggaggcaaatgtacaatgtactggatagtgagaagcaaggagggttttgagagagaaaaagtgtccaaataggaagataatatattctttttccctttacctttgatctttataatgtagctctcctcccatgagtcatatcagttctcagatatttgaaaaataacttttgctaacaactgtaatatctttccagaacctttccttgaatgtatcaaatgctgtcagaccatatggtttcaggatactcttacatactgattgcttgaaactggttgttaaattgaggcttagaattagattaactattaaaaaatagcttaaccaacagtttgaaatacagtgagatttttattatttaaactttttaatattatatcataaaagattgaattcagttttttattgattttgtttttatcataggaaatttcaaacatattcaaatgagagagaatcgtatagtatatttccatgtgtccatcacccaccttcaaaaattatcattacatgtctgatcttgtttcacctatatccttattcatttctcacctgttcctttcttctgctcaagattattttgaagtaaactccagacatcttgttttcaacaaatatttaacatgtgtctctgacagtcatgaactttaaattttcagctctaataccattactacatctgaatttacaatcattccttaatatgaatacccaatgttaaaatacatgtaatagtctagtaatattttatgattaatatttttacagctttctccagtcttttactttcaacttatttgtacttctacatttaaagtgaatttctggtgtatagctaataatggggtcttgtcttttactcagtccaacagtttctaacttaataagagtgtttgctcagtccatttatatttaatgtacttattggcatggatgtatttagtctaacatattgccatttgttttccattttcccatctattcttcattacattttttcttcatttatttattcatacataatacatgtaaatatttagggggcacatgtttataatatgatacattgatataatcaagtcagggtaattaggatatctatcaccttaaatatttattgtttctttgtggcaggaatatttaattgttctctttgaactattttgaaatgtacaatgaaataatattaactatagtcatcctaccaatctatcaagcaccagttctcagttcttctactaagtgtgtatttaagcccattaaccacactttatcccccaattccccttactcttccaagtttctggaaccaccagtttactctcttatcttcgtaagatttacattttagctcccacaaataagtgagaacgtgcaatatgtgtctttgtgggattggcttatttaaattaatcaagtcttcttttttatttcttactgttttactatttgatttttaatgacatctagatagatgtgtgtatctttattttatatatatatatttgatggttactctagtgtttacaaaatttatctttcacttactatattcaatcttttggataaatataccacatcatctatgctataagactactgtagcagtgtattcccatttatgtctgtatgcactgttgtgcaattgtggacatccacttcatttctacatacgctattttttaaatacattgtgtgttttaaatattgagttgttgtttagataaatgaggaaacaacacttttaaaatttaataaaatatttaacatatcaaccatgctccttcatgaagatctgtgtttcttttaagttatttccctctacgcttaaggagtttttaaaatatttcttgtactgcatgtccgctaaggaaatattctgtttttttaggtgaaaccacttttattttcactgatttttttaaagatattttccctgcatatgaaattctaagacagatttactttatttctgtgttctttcagcatcttaaaattttgatctattgaattctggctggcattgttcctgataagaagacagttgacttttctgtccttgtgaaagtttgggaattgaacaatgagaacacttggacacagggtggggaacatcacacaccagggcctgtcatggggtggggaggaaggggggagggatagcattaggagatatacctaatgtgaatgacgagttaacgggtgcagcacaccaacatggcacatgtatacatttgtaacaaacctgcacattgtgcacatgtaccctagaacttaaagtataataaaaataaaaaataaataaaaaaagaaggcagttgacattccttttatttttcttctgtatataatacactgtttattacaagctactttatatttgatttttagtaatcttattgtgttgaattgagtgctttttcattggatttatcctgtttaaaatgaattgagtttcttaggccttcagttgatatttttcatcaaattaagtaaaaacaaaaatttagcattaactcttcaaatgtttttgaaccttattttctctctccttcctctaggacttcattacgagcatgtatgactgctttattgttccatggatctcaaagtctctgtttatttatgtatttatttttttcctttctatacttcagttcaatagattggtctgtcttcaagttcactcattctttattctctagtattcaatagctgttaagtccaccctatagctttcttaatttcagataatttatttttacagtttcaacttatatggtttttattttatctgatgaaattttcatctctttacccatttgtttatttattattactattttttattttagatggagtcttgctctgttgcccaggctggagtacagtggcacgatctcagctcactgcaacctccgcctcccaggttcaagcaattctctgcctcagcctcccaagtagctgggattacaggcacctaccaccatgcccagctaattttttgtatttttagtagagatggggtttcaccatcttggccaggctggtcttgaactcttgacctcgtgatccacccgcttcggcctcccaaagtccaaaagtgctaggattacaggcatgagccactgctcccggcctgtgtttattttttattgtaaattctcaaacatacatgtaatagctgttttattgatttttttcctattactttcaaaacctctggtcccctctgtatctgtttgtattgactattttctttttcttatggtcatatttttgcttcttcatatgtctagtatattttctttataatttatatcacacattgttggggccatgttggtgagcagccagacttatttcctccttttaaaatggttggattttgttctgacaagtagttaacttactggtccaacaacttgatcttttgaggcttggcttttactttgttagagcactattactatataactctgcttctaagtgtggcacttctagggtctgaatgcctggggtattcatcaaagattcctgactcaggttaatcagaactccactgttcctcagcactttggcttttggaatagctgtttggctcacagcctccagtagctcttgtctgtcatgcctatggtttctgactgaaattggccaacaattcaaaattcaaaaataatcactatccaaaaatttctcttcagaattttggagctttttctgtgactggttccctcctctctaatactctgtacattaaatttcagctgccacaggccacagggactccaaactccaatcactattcttcactattctctttgcccactaagaaacaccagtctctgtttgggctacaatttttttttttttttttgagacagagtcctgctctgtcacccaggctggagtgcagaggcacgatcttggctcactgcaagctccgcctcccagggtcatgcaattctcctgcttcagcctcccaagtagctgggactacaggggtccgccacgacgcctggctaattttgtttttgtatttttagtaaagacagggtttcaccatgttagctaggatggtttcgatctcctgaactcgtgatccacccgcctcagcctcccaaagtgctgggattacaggcgtgagctaccacgcctggcctgagctaccatttttttagtggtggtttggaagcgtccccaggtagaaagccaagctgaagtggaggtcacctaatatgtttaccttattgaaaaagaaaatacagccctacgctatatgttatttaatgcctgagaagagttttattttattgattatccattttcctaattattcatggaagaggggcgagttcgatactcaatattttgtcataaatataactagcactttttaaaatagttttttgtttgaatcagtatttaaatcagttcatatgttatgatgcattgtcgtgtcaagccccccccccccccttttttttttgtggttgtttttgttgttgagacagagtctcgctctgtcgcccaggctggagtgcagtggcgctatctcggctcactgcaagtccgcctcccgggttcatgcccttctcctgcctcagcctcccgagtagctgggactacaggtgcccaccacaacgcccggctaatttgttgtattttttagtaaagacggggtttcactgtgttagccaggatggtctcgatcttctgacctcatgatctgcctgcctcagcctcccaaagtgctgggattacaggcatgagccaccacgcccggctgagcctcttttaacctgtaaattctgtacgtttcttggcttttttatttgttggttttatttgtttctttgtatgtccttgaagttcactgttgattcatatggagcatggacttaatttaagctccaagacattgccatgtcctctgtaagataagatccccatattccctacatatttttcacaaaattttcattatacatttatgtataatgagatgttacattttcttaatagtaaagcaattcctcaaaaaaaaagtaccatgtgattcagcaatttcacttctggctatacagccaaaataagtgaaatcatggcctcaaatagatgcttatacacctgtgttcagagcagcactattctcaataaccaaaaggtggaagcaaccccagtgtcaatcagcagatgactggacaagcaaaatgtgctatatgcatataatgcaatattatccagcttaaaaagtgaggaaattctgacacatgctaaaatacgaattaatcttgaagacattatgctaaataaaaaaaaatcacagaaagacaaatattatatgtttctacttatatgaggtacctaaagtgtacaaattcatagagacaaaacagattggtggctgccaggggttgggaagagaggaggttggggaaataatgtttaatgtgtacagtttcagtaggggaagatggaacagttctgaagatggatggtggtgatgattacacacagtgtgaatgtacttaattccacaatgttgcacacttagaaatggattaaagagcaaattttaagttatatgtattttaccacataaaaaagagattaaaaaataatatagttcagtaggttcttggctagtaagttagacaaaagatcagaggaataagacaacttggcaggaaccttatgaaaaggattctgctactgaaatggttaaatttaataactcttaggtggtaagaaaatgaccctgtgtctatgtattaattcttattactggtatatccactggcctctttctcatttctccttgcatgtgaaaaaagtttttctaattcatgccccaaattgaactcttgatctcctttataaaacaccacaaaaagctgctcttgctgcattacattccgtctcagtgggtgacaactccatcattctgattgatcatgccaaaatgttggaggcattttccctttctctctcatgatatatccagtcgtacaagaaaatttacaggttctattttctattatccaggattagatcacttctaccctgttccaaagtgacttcctttctaggtggcaagcttttgtttgtttgtttaatagctttctacctgatttcattattttcttccttggtgaaaggctattttccctacatcatccagggaagttatgttacgtaaatcagatcatgctccttcactactgaaaattcatttgattccctttctacttttaatgaaatccagtcattccttagtcactccacccatgccacattgacctcattttattcaaataaaccaagtaccttaccaccttaggggctttgcactcattatgtcctgtcctataactgtttgccctcaaatatgagtttcatgactaatttgcttactttctactctctttagatctttattcaaattttacctttttaattaggtcttcactgaatattttttattgcgatttcctccccctgcgtatctatcagccttctctgctgtacttttcttagtaatatttatcagcatctcacatactatgttacttctgtgttttatttattggtattcccatattcaattataaattcgataagggcaggattttttctctgtttgatgtctaaaacaattcatagcatgtagtaaaccacccaacattttttaagttaaatgaataataacatacctttactttatgactaaggagtatgttaaaggcctaatgggtaaaattactatcgtagaagcaagaaatctcactcaaagtctgaagtaattcaatacgttagtcactggtgtctgctacttgggtatggaaagaagattagtgtgggtcatgtagcaccgtctattgcatttggaattagctctgcaagatcccatgtagttggtgttactttttttaaaataaattgatgagcaccttaaaaaaaaaaaccttagattcagggactaatactgataatgtatgctttgatgacagtattaaaaataaatgagttatcagagagtgtaagcatttatgaaacgtttgctatgtatcggatactctcctgggccctttagatatcattttcacatgctattttattcagttctaatcaatgcactacaaagtgtgtatttctattggcatattttcaaaagtgaaacttgaggattatagaataagaatcatttgtcaaatcccataaaatgagtaacttgtagagttggcataccttgtgacatctctccgactgcaaatagcttttttttttttttttaatcctcccagtatcttatagtagagaacatgtgtcccttggaaattaattaaatattagcagaaataaatgtgatcagttttaaatgtagcttcaattcctaaacatctattttcagaactcttctctgttaaaccatggaaggatctatttccttcttttcataagtctttggtcaagccttgaaaattaaaatcgttgtactgattcaaccagtatggtctttttaagttttattggatttttgtttgtctttagttcttttattttttgcagttttaatctgtgcacagagaacatctttctagcttgtaaatacacatcagacacaccctgctgtttcctagaagtctattccttgttgctgttaatagcagagcagcatttttttcttagtcaccatttcttcctgcatacagaaccattaccctctgtctacttctatcaccctgaaatcttccatcttacttttcagatgtttttcactatacctatttcaagaaatcaggtactaaaaataaataattattctctgatattcaacctatttttaacacctcaactatttatttttaatacctgatttcttgaaaaagcatattgttaaggaagtaaggtatcttcattaatatacatctttcacaactgaacaggttcatttttataaactagcacttgtttttcattttatactcaaatttatttagatctgttaattgcgtctgaatagtatgtgaaaactgtcatcattcagcttgggaaaaatattctcataatgaagttatttacagctatgtctgtcattagtgtcattagtaccactaatagaaaataagaaaattggaatggcaaaatttagacatataattgatttctttcttctgatacgtaattgcaagtgctaaaacttcctagatgttaaattgactgaaaaaaaaaaacatatcaaagaagcagatgtatgttgcagggatggagggttcactgtatttgatatttatatagctctgtgagtgactcaattcaactttcctggcttaggggaaaagggttaatgtttggcctgaccggtgagtcccaatgataagaggtcaggaagaactctttactggagttttagaaggtaatagaataatgaaggatgcagctatgagtctagcaaattgtgaatgtaaacagagggcattttagggaaatcatttagtgtaagtttttttaccatggtggatgcgatatgaaagaatagacacaagacaaattcgaatccaaaatttaccttaaatatatagctataacttacattaaagaacctaacaacttaattttaccattcacacatttaataagtgtacattcagaaatgtactcttcagtgaactgtaggaatacaaatgtgaatcaaattagtcaaggattaggccctgaaaattaaattgtgatcacatgttaagtgtgcacaaatatttaaacacaaagtagaaaatgatatatttttaaaagaggtctcccccaaaaacaagcagtaaaagaaagggggtaattttcatcagctgcggaagctttagggagaagtagcaactaaactgaatcttgaacagtttgataaaggcaactaagtagatgaacagcataaagaataatgaaaacaacagattcgttgttattttagaacaataatcacagggtcagagctgtagtcatggaagaatacatgacaagggagaacccttaggtaaagtcactaatgaaaatgcacagtttaatcccagacatgaggaatggcaagtgtacaaggcatatgcatttgcagcacaaagagaatcacaaaagaaaaatgagatttctgtcccagagatacttaggtggcaatttctgtgccagaattacttaggtgattggaaatgtaaagcatgaactcaaatctgaaggtaactgtccaagggtcaagagttactgattttgctaagaaaacaatatagaaagaaaaagaagattaaagtaattttcttaagaaatacctatatttaaagaataaaagaaatttgagaatgaagagaaattggaaacaatccaggagagaatagcaccacagaaacctttaaaaagaatttcaaataaaaggattattgatactgtacattaagattggttgcagcttacaaaagctacatattctatatatggatttatatgaggctatagaaaagataaaactacagggacagggaacacatcagtgattgccagcgactgtgggtgagggtaattgttgaagacaaagggaaagcataaggtgatttttgaattgatgaaactgttctttatcaatattgtgggtgtggatcatgaacctatgcactgttcaaaacccatagaactcattgttcaattcccacctatgagtgagaacatgtggtgtttggttttttgtccttgcgatagtttgctgagaatgatggtttctagcttcttccacgtccctacaaagggcatgaactcatcattttttatggctgcacaggaaggggaacattacacactggggcctattgtggggtggggagaagggggagggatagcattaagagatatacctaatgttaaatgatgagttaatgggtgcagcacaccaacatggcacatgtatacatatgtaacaaacctgcacattgtgcacatgtaccctagaacttaaagtataatttaaaaaaacccacggaattgtacacaagaaagagtgattttaccaattgtaaatttttctaaaaattaagtaacagaaaaagagaaaaacaatagagtcattggtttgttgatttaaaaatgtatattcagaatgtggaagatgaagggtatatggtaaagaaatggaagccatatgcattctgttttcaaaacgtttcccagttaagaagaaaaaaaaagaaggtagcttcaggacatacctcagttgattaaagaaaggttatttaaagagaggaaacttggagatgtcttttatagaggttaaaaaagaacatacatattcaaaggagagtaaataattaataaagaaaatctttgaggccattggaggtaacggaaagagagaaagagtctttttttttttaatatacttaaaagagggcaaaaggaatagagaatgaatatagatagaatcattttaagggatcatcacttcaacatgaatcttgttaaaagattgttcactggaatttgagatggaactatagcaaaatcttgtttagccaggtctaagacacctttcttattaatagagtccaaatattcaggtttcttaacctcccaaatgccctgccctcttatgagtcccaaagtgcaagtgttgattggtctaaaccaatggctctctgtatggtccgtagaccagcaacagcaccatcacctgggaatttggtaagcccagagatctgtgtttttaaaaagcctttgatgcgattttgatctacagtaagctttgagaactactggtctaagcctgaaagtatacttccatttcatatctttgtgattacacatgagtataccattcaaacccagccaaggaaaaaaactgggaagattgctgtttgttattggtgaacgatttctttctgagaagagacacccaggggcaatcagccttttctgcttttggattggtcatatgtggatgagatattaaaatcgcagggcacacacacacacacacacacacacacacacactcttcaccttggggaggaaacataaacataatagccgatatgttgcatatggtggaatgaaaacttggaaggcacctgggttattgaggacatccttatgtcactaaaatttagtaaacttaaaactgtctgtatctggtaaattactagtaagttaataaatgatctcattgattaggccactattaattgtggcatcttatgcttgtagccacaggcatcaaaactgatatgaaaaataacaaattggttctgttacattctccagcatcttccttcctttaaaaatattctagttaataggctaggtgcggtggctcacacctgtaatcccagcactttgggaggccaaggcgggcggatcacaaggtcaggggatcaagaccatcctggctaacacggtgaaaccttgcctctactaaaaataccaaaacttagctgggcgtggtggcgggcgcctgtagtcccagctactcgggaggctgaggcaggagaatctcgtgaatccagaaggcggagcttgcagtgagtggagatcgcgcccctgcactccagcctgggtgaaagagtgagactccatatcagaaaaaaaaaattgtagttaatagtataaattttgtatgcctttatcaataaatgttttaatcaacaaatatgagcatatcagcatcatctttgcctagacagaagtgcacaatctgaaaccagatatcaagatatttaccaagtcattattatcaagagaagtggtgtttttggcaaacttgagcagcctaattccacaaataccttaccattaggatttaatttgcctggaataaaaaagcaatataaaaagaaggaaaatgaggatgatgaagaaaatatacttacatttttataatccttgaataatgatgaatatgaatttcattatatagttatctttagtttttgtatatttaaattattttatattaaaaaaatacatcaaagcaaaacaaaaaagattaaaaataaaaggatagaaaaatacaaatgcatgaaaacaaatttagctattttattataagacaaatgtcatttaaagcaaaaataaattcagttacataataaaataatctttcttaatttttaaatatgtatacatatagaagcaatagttaaaacatatagaacaaatgttgatatgattataaggagaaatcaagaaatttgcatcactggaagatttttaacatatctctctttaaaaaatgatcaaaaacacaattaggctgtgattaacttagccaaaaatattacctcaaataaatagatttgtagagtataatgcaatcaatggataaaataaattcttttaaaataaatataaaaggtttagaaaatttgatgtactagcaagtaaataaagtagaataccattatgtaaattttaaaaatatgaaaaacaatcatatgtaatttatactatcatatataaaagtacaatattttgtgtgggaatgaaattttaatatctaatttcagaggtgggttatgtttgaagtgcttaaagtgcagagtgattatccttggttacacagggggccagtgggaaaaatagaggtaaaactcacatttgatttcttggatttttttttactattagttaaacataattttactataatggaaataaggttgtacagtgtaattttattacttcaatatacctacaattatttacagtaagtataaatttctgtaaatgagaatgtgacattctctttctcctctgcccctcatttcttgttctgtctttcctaacaagaacatcatgttaggattattttaaatttaatgggtctgtatttgtgaattacaatgatcaaattgtattacaaacaggcagatagtaattccaattatttgtatttagagaaaactttttcatgaacagagttaaaattatgagccaggatttaactactaatgtctgtgaacaagacatgtatattgccacacattacctgaaggtatttgtaaagcagttttatctactctaaagcaggtgacgtatataatgaagccaaggaaataaggataacataatgtttgtggttgtcagatgatttttagacttatgaaatatcccgaatcaagcattttatatttttaatacatatcagaagaaagttcttggatttatcttctgtgctaatttatattaagtcttgcagtattttatttagaatgatagtgtctgacatgaatgtcttcagctttctaattactactaatactctcaaagtgaatgtagttaaacccaattatatatctagttactgaaatatcaataataaaccatataatgcttacttatttcctttgttaactcgtaaatttattttactaaatcttactcgaggcagctattaaatagattaatgaataattgttaaaatttaatttttcaaatctaaatattttatcattatagaaatgttctacttacttttgtcatgtgtctactctgtgaaaacattgttctgaactgtatagtagctagagaggagagggattgagaaatcagttgtaaagatgcataagatagtcttgatgctcttaggaatttcccgtgcccaggtaagggagacaggtaaatacaagtgaaagatgctacaataaaaaatatagtagagaaatggggtttacttcctggaagaatcagggaaggatgaagtgacatttgtgctggaatcctgacagatgagtgagaactcatcaggaaaaagggaagtggcatattacagataagttaaaaaatagacaaaagttttagaaaacttaatctcatatgagttaacatgcctagaaatttaaatggatataatactttcatagtaatgaatttttaactatctgcacatattttcatagagttcactgattttattaaatgacagtacactcatatgatgtggataaatacaaatatatgaccatataattttaatatccaagatgttgccaaccctaaagaatgatgggagtgaggatgcagaattccctcagcttagaatctctcatctttatattctctacctgttctatcatcctgatttaggcagtccttggaactatagtctctattcaacacatttttgaaaatgctaatctattttcaaaacagtccaaccccttcagtaaagtgagtatgattttgtacaatatgccacaaaattttaagaaaatttgaatcacattttctttactctcagtttaacgttactttcagtgcttcttgctgcatcattggtatcttataattagaactaaataggtatgaaaaaaatcaatttacattctggagaaaaaagaagctgaatgactctctctgtaaagttttcctttcatcttgatgaagtcccttcattcattgcttaaagattaacagtaagattaacattgtaacccatttagttagctggagggaatttcattcctgcttaaattcaagcatttaaagcctcaaactacttaaaattaaattggccccatagagaaagcacatcaccatgagtattacttaaagatggtatcaaccttcaggaatatatcttaattggtaatgacaaaaaataaataataataaaattttaaatgctatttctgttatgtgggaattttctagttttttggatgttacaattaaatatccttgcttagtagacatttttatatatctccaatgttatcaaatgtcaggtctatcatgtatcaaaagcaatctcttgggttgtgttgccttgacaacaaatcttggtttcgttgttcttgttaagttgaattcttggattctgagaatttaataaaacgcttgctggattcaaatcagtgacctttctcagagctgtaaaaacaactgatcattcactaaaccattcatcaagttaagataaatatacctgttaatatttgtgttcctactcagtttggatacaagtcaaaataatttgataatattatttttattctttaaaattattttataagaattagtaatttatttaaaaaattagcaatgttatttctaagggatactaattgtgatatgaaagacaagtcctcttgtcaaagcattttgtattcagaaatgagtaaactactttaaattaaaaagtagatcacaggtttaatatctagagtttttcaaaaaatatgtgtttcagcaattttataaagtttgaacctgttaagctaggttttaaattatttgaatgttttttgaaatttccttctctgtcttgtcattataagttagattttgttccacttttatttatttcatgtaaggctgatatctcacaaacttcaaataagtcataaattaactacagcatcatttgcaaatcttccattttctggagttaccatgccttttgagatttaagcaaaattgaaccaaacattcattgatttttcacaagatacggatttttttgattttttttttttttcaggaaagaggcccgtgtacttgcaattgctcttctagtcatttcttgtgcaaacctgctctttttgaagcacaccaactcaatgaagatactgttgactataattcttaccagaaatatatatacacagataacctgtatatatatgtagatatatagattggaaatattgaagatttgattccataccaccacaataaagtaactattgcaataaagcaattcacacactgtttttagcttccaagtgaaaataacacttatgtttatgtgatactgtagtctattaagtgtgcactagcattgtgtccaaataaaatgtagatatattatttaaaaataccttattggggccgggcatggtggctcaagcctgtaatcccagcacttggggaggccgaggtgggcggatcatgaggtgaggagatcgagaccatcctggctaacacggtgaaaccccatctctactaaaaatacaaaaaattagctgggcgttgtggcccgcgcctataatcgcagctactcaggaggctgaggcagaagaatcacttgaacccaggaggcggagcttgcagtgagccaagattgcaccactgcactccagcctgggcgacaaagcaagactccctctcaaaaaaataaaacctttttgctaaaaaaaggctaatgatcatgtgaactttcagtaagtcagaatctttttgctgatggagggtcatgcctcgatgttgatggctgctgactgatcacagtggtggttgctgaaggttggggatgctgtggccatttttaaaaatgagatagccatgatgtttgccacattggttgacccttcttcttctttttttttttttttttttttttttttttgggatggagtttcgctctcgttgcccaggctggagcacagtggtgccatgttggctcactgcaacctccacctcctgggttcaagcgcttctcctgcctcagcctcctgagtagctgagatgacaggtgcctgccaccacgcccagctaattttgatttttttagtagtaacagggtttcactattttggccaggctggtctcgaactcccgacctcaggtgatctgccctcctcaacctcccaaagtgctgggattacaggtgtgagccaccacgcccggccaactcttctttcacaaaagatttctctgtagcgtataatgctgtctgatggaactttacccacagtaaacctttcaaaattacagtccttaaactctgcagctgctgtatcaactacatttatggaatattctaaattctttgttgtcatttaaacagtattcccaacatctttaccaaaaatagattccacatcaagaaaccattgtttcctttttttgtcactgaatgtagtggcaaaaatcacaattctgcaccaacctactcagtcacatctttagggttcacttctaattttacttctcttgctgtttccaccacatctgcagttacttcctacactgaagtcttaagcctcccaaagtcatccatgtggattggaataaacttcctccaaacttcttttaatgttgatattttgacctcttcccatgaactgttaacgttcttaatggtatctagaatggtgaaatctttctagaaggtttccagtgtattttgccaaggtctatcaaagaaatcaccatttatggcagttatagccttacaaagtgtatttattacataataagacttgaaagttgaaattactcttttgattcatgggctgcagaatgggtgttgtgttaaaaagtacacaaacaaggagatttacaaatcttgtacgtctctataagagttctagggtgatcaagaccagtatcaatgagcactaatattttgttgtatgagcactacatctcaacagtgggcctaaaatatttaataaaccattggtgaaaatagatgtgctgtcatccaggctttgttccatttataggcaaaatagatttagcataattcttaagagctaggattttcaaaatggtaaatgagctttgacaccaacttaaatttatgtttccccctaaaaaggaagtgagcctgtcctttgaagccaggcactgacttctcctctctagctatggaagtcctagatggcgtcttcttccaatataaggctgttttatctacatttagaatctgttatttaatgtagccaccttcatctatgatcttagctagctcttctaaatcaggggtccccaaccacggggccagttaggaactcgaccacacagcagaaggtgacttgcgagcaagcattaccatctgagcccagcctcctgtcacatcagcagcgtcattagattctcataaaagtttgaatcctgttgtgtgaactgcacatgcaaaggagctaggttaagcactccttatgagaatccaactaattcatgatgatcagaggtaaaacagtttcatttcgaaaccacccccacccccatctttagaaacattgtcttccaggaaaccagtccctggtgccaaaaatattgggggtggttgttctatacagataacttgctgcagcttctacaggagcatgtgctgtttcaccttgtaccttcattttatggagatagcttctttggctaaacttcatgaaccaacctctgttagcttccaacttttcttctgtagcttccttacctcactcagccttcacgtaattgaagagagttagggccttactctggattaggctttggcttaagggactgttgtaactggtttgatcttcagtgatgttccagatcactgaaactttctctacatcagccataaggcccttttactttcttactattcatatgtttactggagtcacccttaaaaaaatttttttaagcttttcctttgcattcacagcatgcttaatgggcacctgaggcctagttttggcctctctctgatttcaacatgacttcctttctaagctcaatcatttctagctttcaactgaaagtttaaaaaaaaaaaagaaaaaaagtatatgactcttcagttgaacacttagaggccgttgtaggcttatcaattggcctagtttccatactgttgtgtcctaagtgatagagaagtctgaggagagggagagagacatgggaacagttggtaagtggagctgtcaggacacaaacaacatttattgtctaagtttgctgtcttatatgagtgtcgtccaagttgccctaaaacaattacagtagtaacatcaagatcactgaacacagatcaccataacagatataaagcagtaaaaatttggaaatatctcaagagttaccaaaatgtgacacagtcatgaagtgatcacacactgttggaaaaatggtgccaatagatttgcttgacgcagggttgccaccacatttagtttgcaaaaaacaatatccgtggcatgcaataaagcaaagtgcaatcaaacaaattatacctgtatataaaaattcagtgatctatatcctgaaaactgaggcactttactgtattaagctatacaccccatgagaaattcaataaaaatgaatttatatttcttagtaccctcattttaacatgttcttaactggctttattcaattaaaaaaaaaaccaaccaaaaaccttagtttgttgatttagtcatattcttccaaatcatggagctaatacatagcttatttttatttttattgtgttttcagccttgtctggaaacaaaaatagttggaaggagagttagtttagaatgatgaaaagagagcaaaatacattccaaaaattttcaaataatttccaaatcattggactctaaattatcacctggccttattctcttctgcctgaaggaactagtcttcattatttcttcccattagggtggagataattagtgtcagcaaagtgaactatcaaccatatcccctccttattcttctaaggtctgattaattggtactgagaagaaatgatattttacttaaagtttttacaggatatttttattttatattttatatcgtatccaaaaattatggtactttgctgaaccttttcatacatttctttatatgtaactttgcaggcttttgctactttattatgaagagactccagaggaaacaaataacacaagcagataatcaatgagaattgaatgaagggactgtttacacattagtgggcaaggggaaccttagggccagcacagtgggagacttgactgtccctaaacttaaggagcaaaagccatgggatggaatctgaagggagcgatggcattggtcagatgtatgcaagcagagctaagtggttttgctcattgtgcggtatccagtaatcactgatactctctttgccctgtatcaatatatttcaaagaggatacactgacatattaaagtaaatgtaatatttcaaaatctctgggctggggcccaaaatcttactttaataatccacataaatgtgttttgcagaacaagaccatgtttggaaaacggcagtcatcctgggaaactttttattctaagctgtttttggttcccatcatcacacataccaatgccagagtcattattgctataaaagtatcactttccaaggttcctgagtttaccaccctcatgtacttatagggtttttataaccattatattttgaggcaaatagtatttgttcctcaacaaacacatttattatatagaattttatggaaatactgattctctgttttaatagtttaaaatcttttgtgagatgggaaaagaactgttgcttcattttattataatgaaaataacttagagacaaaaagccacccaaaatttcttttaacttgtaaatactggttactattccaattttaatatattagagccccctaccaacatttttgaagcaaaattaagctattgaaattaagattcctgtttctcccagtgaagttaaaaactaacaacatgtaagaaacaaattagacaaatgagtttcaaggatttgagtgtaaggaatgacttctgtttaagttctattttgttgggctttggaatatttctgctacaagtactacactgtagcaccttgtcattttaatatatgtcttactttgttatcaaaaaattaggcattataaaatatattttatcttttatatagtccatttcacagaatagccataatgttctttcaagtaaggattatgggaaattaaatgctcttatgtttaaaatagatatttatatcctctgtatcatttattaacttatcagaatcactttgcactttaagatccatctaagtatacttaataatatagctttttccatgcttttttaaagccttagtcaaaatatagtaacttagattttttaatatgttactacagttttaaaccagtattgggaatgctttgatattgtaatgtttacagtatatttggggtaaagtggtgagagaaattggaagatggaattttggtattttagaactagactgtgtggccaagcatatagaaatgcagaatgttgccagacacagtggctcacacctgtaatcccagcactttgggaggcagaggtgggtgaatcacttgaggtcaggagttccagaccagcctggccaacatggcgaaaccccatctctactaaaaatacaaaaattagccaggcatggtggtgcatgcctgtaatcctagctactcgggaggctggggcaagagaatatcttgagtcctgggggcagaggtggcagtgagctgagatcatgccattgtattccagcctgggcgatagagcgaaactgtctcaaaaaaaaaaaaagaaaagaaaagaaagaaatgcagaatgtggtgtagaaatatatacaatatattatatttaaaaatctatagtaatgcagttccttctttttctaaatttaaatctttccccctttatgcttatataatttttaatagacttcaaaatggaaacaacgttctagtaatctcaaatgtgaatgtagagaatttcatccagtgacctttcctgatttatatttctgtcgttcttgattttataaatcaacttgaaaataaaatttataaaatttcttaactgttaccccgaatcttagaactgtagtgatttctaaattaaaaatcctgtagacataaatattctcatgcactctatatatacatttcatttgtgcagttttgcatctgtttttccagttttccactttgttgggaaatggtttacatactaaaaataatgtttgaacaaaaatattttctcacgtaataacttgttactgctttgcagtttgtcacaaattttaccattcactcatttaatctttaacacagtactgtgagatgaacaggaaatgactatattcccatcttaagttagagaatactgagactcacagacatttagggactgaagttacaaattgagtggaattacatctaaaactcaggatttatagccgggccctgctggaccctaacagactcacaagaagagagaaaatggtgcttaacatatttttcaaatcaatttcatggaacttaaattatagttattaaatgcttactatgttaaaatactctgttaagtaaagcagttatataggatagattaaaatgtatgagaagataagaaaatatatgatattacacgttataaggacattgctaacctgtgtgaaaatatttttttaacagagagttgtgataataaccagaatttaggggttaagaaataagggagaggtaaggcctttgaagcagcagatgtggactatccttttgacagattgaggatttgtgtggggaggagatagtgaaggggatgaaagaatacaagcatacaaaacagcaacatacaaatgtgctatcttaaaactcgaaaagtgtaaaatgctaagctggacaaagctagactgaagaagaaaggccactttgcatttattatcggattgggaaaggagcaggaagcacctggttggaatccttgtgcttgtgaaaatggccttgttagaaaagggacatgacaagaggaaattaggaaagaaggtaaaggaacactgcagctcttccagggagctaattgaggtctcctgagcctgctccctaccaagctccaaaaggaagatgggagaaagccacctagagccacatccaccagaactatctggaagactaaagttttgtccttccatctgtgttcagcgctacagggctaaacaattagcagaactgagactggaccctggtgggctgcctctccagtctgtgtcctcaaccctataattttcatttctgttgagatcacatatattcagattataagtggagtattacttttgtaaattttttgaagggtggtttgataattagtttcattattttcaattttgctctgtgtatgtcttattaatctgactttttctcataaatgtaaacataagcacaagttgacatcttgctttggaactggtacagtcctgttcataaattcaaatagttaccaaaatatgtgaaacttgtgcatatcttattttaattggctactttcttaattcagaagtgaggttcctcagatgtatttcagtgatgctggaatttccagcaaagtctctcacgtctgtcaaacattcagtaaatcacctaatgtttataatttaccaaataatcagacctaatgcttaatatagctgactaaatgctttgatactctgcattctagtcattttatcagatttcattttgttttgttttttgggatggagtctcactctgtcacccaggctggagtgcagtggtgcaatctcggctcactgcaacccctacttcccggactcaagtgatcctcccaccttagccttcctagtagctgggaatacaggtgcacactaccacacctagctaatttttatatttttgtagagacagggtttcactatattgccccgtctggtctcgaactcctgggcttaagcgacacacctgcctcagcctcccaaagtgcttggattacaggtgtaagccaccgtgcctggccagatattttaaattttaaaatttaaaaataagatttagagaactcatttaattttagttttttttatatctcctctttttattcttcttattctttcttattgcagtaaaatagaaacacaacaaaaggaatacaatgataccgtaaaccgtaagaaaactattcattccttaccagaatgaaaatgaaagaaattcatattttatctgaataatttttacaatgcttgcaaatttaccagaacaactgtaaagagttccaaaatttaacttaactcaatgaactagttatgggagatttagtgtgtgataatgtgaaaaaaaaataaaagataaagtagcatctgaggaacaaatgctaatatcttagatttggatagcatactgccattgtctatactgtatctattactttttgttttgtaatctcctcttttcctatgttcattggaaatgaccagtgccactagcttacttttctttcacgtaaaatattacattaggggaactggcttgctattatcctgccatttacccagaaggacagatgtctcaaatagttcgtgaattaaaaaaatacgaatcaaaaaaatctgaaatcataccctgtaagtttgataagccttacttttcagatgatttagtgtacgatatattaaacaatttattttttatttgaaatctatatcttgcacagataaaaattcagacatgatggggcaggtcctagcctaaatgaaatacatatgcttcactaaataatactgtttttgttattagttctaagacttgttagttaatttatagtatatgttcaggaaaaagtacataaaatttaacatagattttaaagtggatttctttccgtcttttaaagaaatcaattttccttttcttctcttgatataaaccccattacagtctaagataaggacaccagatactgccctagtttcaacttatttcagagccttggagcataatatggggaataataagacacagagcattatttgtgctttctaatctgttcagactattttaaataagcataaatcagatattcacatgttaatatgttgaagggtaaaacgcgaatatatatcattgcttaaataggcttaatgctgtatacataaattttcatcaaatcttgctcccaaatatttctattttaattttgacaggagttaattttccttttatttgttaactcccagataatttactgtaattacatataattgacttagtaaatatatagttgcctgagtttttgaagaaagacaaaaatcttttatcccaaccaaactatattcatgctaaagtcacccaaatttgagccagaatcgtatatccatattgctgtgaacaaccgcagaacactaattacaataaatctaatctacccatttgcaatgacactttagattagaaaggctgtagagaggggtatgatttaagagtgaaaaaatatttccaaaattaagtaagagtttagacctgtaattgaaagagacattaatgtgtgtgtcataatagatgataggatattctactactgtgaagctgagcctcttgttaccttgcagcagggtacaacaataaaaaatctttgattttatttgacattcttctaatagactccacacttctaaacatgaacaaggaatttcatatagctgattcagcagcacatggaatattcattttctctaaagccttgtacctttctctcaatgacccttgtgaaatgaattttagtgtttgtgtgcacttcctacatttgaacgcttacagtggcatgagccttaaatgagcaagcttttaaatatttgtttataacacatatatcctccttgccagtttattttcagctttgtcttccactgaactttacttttcctgtttctgatcctggctgcttatatcttggctaagagtaaatgtcttgttgtcttaatgaccatggaaggctttttggagtaggtggagtttgcaaaaccccttacataacagaggaaatgaagcggaggctgttcctgatgataccttcatacaagcaaaagtccaatgtacaaaagtacaaggggttaacactaaacacctaacacatttattcaagctaagggtttgagtagaaaattgagtagggttataacaagaattggttttgattcttaattgcaaaagactctgcacagcaaactatgtagtttgaattttaccctttaggggccagggaaaattaagaagagataactggcatgaccaaagcaacagggtccaaatactaactgggagtcttttgtagtaatatcagcctatgttgtggtagtgcccgtgagataaagggatatatgtgagcttttttgacagaaaagtcaatacaaatagccataggtaaggatagtcttacaatttggaaaggcaaaaaaatagaaaaaaagactaagtaaaataatgcgaattgtgagtataggtatctgggaaacagcacactcttaattgatatagagaagtcagagacaggttgggttgaaggatgatgaggtcaggttgcaccatttgaaacaaaaccatcaatggagtgtatcaggaagaaattaaaatataaactgagatagcatgagagaagtctaaggtgaaaaaatattggaaaaattaaaacagaggtaggtagttgagtctttttttgttgtttgccattttaatttttgataaggagttgtacaacatcaattaaatacatcaactcattctgaaaaaagttactgtgtaaagaaatgcatagtaacaaacctcagcttcctgaagttggagctattgtgcacgacagagataacaactgtgtgactttgcttagtttggttgtctttctgtctaaatgctgcctaagatccttggcttggcatatgtgacaagcagagtaacgagtgccataataaatgaaattaatgttctgatttcagcaatggtttaggttctgttcataatcacatattatcattttcacagaaatggtaaagaagtaaagtccactaaagcagctctcttgatctgaatggaaaacttatttgttgtaaaagtgtttataatctctctctctttctgtctgccctacctaaaatgggggtaatgatgttacctgtttcagtcactgacatgtcactattaataacccactagaaaataagaaaaaaattaataaaaatagtaaataaactactggattataatatagctggagggtcatattatgacttaactgtatataatatatgctctttatggatttctaatctaatttttatacttttagaaatgtccatcttattttagtatttctgatatagaagctgatcttgcctttaaaaaaaaaagaatggaaaagtagaaatacaaagaagcttctttgaaataattcataaatatattattttaaaaataagacaattgcctattttaaaatgtctctgaagtggcaagtgaaaatgtagaaattgctaaaatatgattaaaaagagaagtgtttcttatattcatcataagccatgtgtatctattaaaagacaaaaagtgaatattgtcccgacgcaaaattgcattaacaaaaactacgtacagaatatagaaaaacttaatatcataaaattgctcattcagtactgacaacacatattttgtggttcattcggaccctgatatttttttcttctcaaccagttgttttcttattttgcacaactgaaattcactatttttcttttctattactgttttattatagcctcaaagcactttataaataagaaaaaaaacagtaatttcatggttattagacattccaaaatgttctatctaaaaaatagttatcagctacattaatactgccaaactgttgaaaccaatttctgtgtattctttgctctaagttatttagcttgaaggatgttgggtgagttgctggatcagactggccagttggattcatttctcactgggaaaggaaataaactgataatgctataatgatattaattttaaatattccagtacatttccctagtgagtgcaaaagggcagttaaaagctcaattttgaggacagataggcctattagtcttgcatctgccatttaaatagctgaatgatgtttggcatgcctgttgtaacctctctaagtctctactgctcagatgtgattaaatgaggtacatttgaaaaataggacagagtaatgatcattaaatggcagatatttctcaaagggaggctttatcactgaccacaattttttactatagagttagatgctttcattagtaaacttctcttgttttgaaaataattttcgttgctgttgtatagctgaataacatgagcacaaaatcaagcacaatttttatctattttatctgtagaagcatgcatggctaagaaacctctactcatctttatatatgttttataagacaatgacttctgtcttcagtgttctctttcttctgtaagtcctggaagaccctcattattatattgccatattatcttctcagatttataaaattctgttatttttggattaataaaagcccttttagatctgatttacaaaaatctgtgttatatgaatacacacatgattttgttaagtatacttgtaaatataatcaaacacaatgtaaatgtatctattaaaatatagatgtctttaatgtgtactttaagataaagcaaaattacttaatttttcaacaagttttctgttggtaataagccaggacctgaggtttttggtgactatcaggtcttttagtgtaaaaaataatacatggaaaaaaatacttgaagcatccacaaatcgaaactcagctgggttaggagttttcctctcaacagacaagtcttgggaaagtggtctgtctcaggaaatattctggtctgttattttctcacaatttttatacactctcctttgataacgatatattgaagcaacccaatgtatgcattcataggtctctccttgtcatttggctaggtcataggttgagaaacattggtatcattgattgctcacaattctcatctttaaccatgctgaaacttctactaccagacacctaaaatatctcatatattctaagactatcctaggggtacaatggacacaagagatttgtcttgagaagattgcctaaatcatagggggaaatgtgcatagtaggcattttaaaacctaattctcctttcccttagtttttccgttaatttatttccacttgttcacttattcattaatttactcaaaatgagtaagcacctactaggtacaaatatggaagtctagaccagggaagacacgggtttaaggaatattttatggatgcggatgaggcatcatttgaatttcatagtatagttaacaaaaacatacatttcaggctgggcgcggtggctcacgcctgtaatcccagcactttgggagaccgaggtgggtgaatcacgaggtcaggagatggagaccatccttgttaacacagtgaaaccccgtctctgctacaaatacaaaaaattagccgggcgaggtggcaggcgcctgtagtcccagctacgcgggaggctgagaggcaggagaatggcgtgaacccgggaggtggagcttgcagtgagcagagactgtgccactgcactccagcctgggcgacagagcgagactccatctcaaaaaaaaaaaaaaaaagacacatacattacagatagaagggttgaacaaaataaaatcagtagtgagcaaccttactgtgtgtaaatgctttaacatttaccagatttaaccttggggaggtgaattaaccttccttatcgtagactttctcatctatgaaatgaagataatctcatagggttgttgtgagaattaaatgagataattcgtagtactttttagctttgtgtctaatgcataataaaaacctaatattttttagcccttaaatcgttcctagaactctactaacccttggtatgattatccaagcactttcactccaaagttttcaattttaatcactgcaaatatgttaacttgtattgtgtatacaagtgacatgtttaagcaaaatgatgctaatataataaaaattttaaaatgagacaaagtactcatagtgttaagctctccaatattgtgtttgtattggcaatggttagaaatgaattatagaccacaggaaaatctaggtaactcaaagcagttgaataattcaaatgtttagccacgatgataaggaagaacttttatttgttttaaaagtgttctatctacgatgtgtgatgttaacatttccaccgacaaatgaaacaagtttgtcaataaatatattaggaaataccatataaagaataaaaaaagccctctttaataaagccaggacatattttcttgcctcaattatatagcactatcaaatcaaaaattagacttttggcatatgatttctgacaattccatgtttcctcctaggtaacactgcaatattgttaatctacatggaaaccctgcattaaaatttttggttagggcgacctcggggcataatctaacctctgagcaacctatgctaagactaaaccagtttaagcaaattattatacatatactgacccaataatttgatcaacagaataagttaccctaggataacagcgcaatcctattctagagtccatattgacaatagggtttacaacctcgatgttggatcaggacatcctaatggtgtagctgctatcaagggtttgtttgttcaatgattaaagtcctacatgatctgagttcagaccggagcaatccaggtcagtttctatctattttatttttctcccagtatgaaaggacgagagaaacagggcccacttcataaagcgccctcgccctatagatgatattatcttaagctaacaaatcacctcatatcttacccaaaagtagggtttgttaaggtggcagaagcccggtaattgcataaaatgtaaaactttataatcagaggttcaatgaatcttcttaacaacatgcctataatcaacctcctactacttatatctactctggctgccgtaacattccctacactcattgaatgaaaaattctaggctacatacaactatgcaaaggatccaatattttaggcccctatggactatttcaaccatttgctgatgcaataaaacttttcactaaagagaccctaaaaccctcatcatctactgttaccctttacactattgctccaaccctagccctttctattgcccttttcttatgaaccccactgcctaaaccaaatcccttaattttaatttcagcctcctatttattcatagtatactatactattatatagtttagcattattatatattaatattattgtataatggtatacaataatattcacagtatactgtgaatttatttttttaatgtatcaccataatacctttttgggtattataggtaggtcactagcttgtaattcccaagtacttttttatgtgccttctacaaattggtaagaaggagtcttttctagtcatctaaaattcaagtactctcccataagtgcttatctataaaatagtaatggctgtgaaagttcatctcccagttctttagcactctcaggtggatggtttttcaactgacctacaaccattaagcttgcttaagtagtccccaactatttggtctctgtttgaattgccatggctgtgcattcaccagtttgaaaaaattaccatatatgaatagaattaagcttagcaaggaagactgccttgtagaacaatcaaggtggaaataactattttatatatgaaagttcaatgacaaatgatacatagaagaaaaacatggtaataaataaatgtaatctgaatacgagaaagacatatatctattttgtgcttaacagtgcctgtgacaatgacatggagcctgcccctgcaaatcaaggcccagatttaggaccactgttgaaagcaaggttttggaaattggaaagagttcaaagggaaagaacataaaatagttattatttaaaaatactgactttaaagaaacctaagatatatgaactattagggctttagagaaggttcagtttatgatgaaggaactgcctttaaagaacttttttaatgtccttgtgacctcctagaagagaatgggctttggagacagtgaacctctttaaaatagcacttctgcatttattagctgtgtgatcctgtgtatatttccaagtctctaagactcttcattaataaaatgaggaaaaacattatatatatatatatatatatatatataaaatcatgagactcctgtaaaattaatgtatgtaaattactttgtatattgcctagcacatgatgcattccattaattgatagctattggtattaaataacaataattgagagctatttctacagaatatattaactggttacattcttctaattgcatcaaacaaataatttactcaaactgggcttctagcacttttacttttgtatatatctattggtagagaaatggaaacaaaaataaaagacaatgatactctgaccattcaccattcaatgcctgaaaattgagagcccaactctcattaaatacttcgtagatgtttgcagaattaaaaataagagaattggccgggcgcagttgctcacgcctgtgaatcccagcacttttggaggccaaggcggatagatcacgaggtcaggagatcgacaccatcctggctaacacggtaaaaccccgtctctacttaaaaaatacaaaaaattagctgggcgtcgcggcgggcgcctgtagtcccagctactcaggaggttgaggcaggagaatggcatgaatccgggaggcggagcttgcagtgagccgagatcgcgccactgcactccagcctgggcgacagagcaagactccatctcaaaatgataataatagaattatatgacttgtatgatctgagatagatgaatttaaggaagaatttggtattgagagatttaattcattacttccctagttgttatgggttgttttgagttattaccccacattaatcatttgtcattttgttttgttaaaatgagaacacattttctgtacatgttgcatgaaaaaaggcaagggaaccacatatctccattgactgcatactcaagtctatccattattttacataacagatagatgaaaggaaacattttttaaatatttgtctttaaaattatcatagaatggataacagtgattgtatagatgatggagacctttctttacgtgtagaattgcttgggcacagcacagtccacactggaagatttcttttctccccaatcaatcaatcaatctctctctctctctctctctttctctctctctctctctctctccctccctctctccctctctgcccctccctccctccctccctctctggggccctccccttccctcttttctccctgccttctttctccccacctcttcaactgcattggtaacgtgataagagcagaaatgacaagtggctattagattcacttgtatataaattctaagtgtcacctatttctatatcttaattattctataaaatgctatccagtttttgtaagcatttcaaggtaataagtgcaaagtaccttggacataggggatagtctttaatatttcctcttttttctttactttggatgaatgttaccagacagtaataacattttaagttcttcaggaaaacagcaaggcctatgcagttatatgaaagataagagaatatacctgtaataagagtattttctaataacattaactttttatatttaatattgctctgaatttattattctaaaccaaaagaaaaaaatccatcaaataatcttgaaaagaagcagctaatataatctatttctgacacttattctattcatttttatcaatacttgcatatcaccagacttacaataaagaacattcatgtaattattctttcgacatttatttattgagaacatactacacgccaggcattgttgaaagtgcttaagaaatatgagtggacaaaggagacctgcactgaagaaacatattcaggcagaaaaagttaccttttgacactctggggcatactcccttaactagtgtttgttggcttccttttgaagtttaaagtatcagaattgtactctgtagaagcttgttgaatgttagaaataaaaagaaaaccggactggactaggaaaagtcaatgccacttttattgtcctacctacactctggttgctcaggggaatttaatttgcctatttcataatgcctctttcttgcaactgccttcagctattacattttcaatcagcttatttctacccagcagaagcagtctggaagaggttgcctcaaagttggtttttctattgtatgtattagaatgctgtcagtaacttattatagtatcttattggatggtctttgtcctgctgtatcaccttcccagcagaggtacagataatgaaaatctatatggctaggaccttggatttgggcagttcaattagttgttcaggaagtctatcaaaaatgtgactccaggtccctgaactccagcattctcattattagagtgaaacgttagtgacaaatgaggtatgatggtctagacacctcatcagcctgctggcttgcagcctgaagtaaaggcgcagttttaaaaacatcaaggtcttgatgggttctgaacatgtgattccagaccaaaacctaagaaaaacgggggagcatcatacgttttaagacaataataaactcataggcctctgaaattctacagtcaagagtcaaagctacgtatgcacttgaagatgtggaaagatgttacagttcaagatgagatttcttattggctatagttgtaaatatcagggttattctaaaaaaagattgtcaacggtttaatgatactagaaaagctcacctatttttaaagttttttatttaagcagtgattaataaatactgatgtttgttattttaataaatgtcatgtgtatggagaggtatcatcaagtaaagtttgtactaatctatatgaaatccatatggatatccatatccaaatgtatgagtcacacatatattatctacagatgtggataaccactcaaatagtggttatccatgggaatgatgctgtcctctaggggtgttttggttatatgtggggtaaattttggttatcacaatgtggagggtgctattagtgtttagtgggcagagatagtagaatacatgcaaaataaagaattgttctgcctccaggaaaaattcctgtttcagagctcaataggaaaacctgtttgattatcagaacctagacccaaattctatcttacatgtaaatataaacccagcatacatttggtgtggtttaaatacagattaaattcagattaaattctctataattacaactactgtctaaagtgaaataaaatgatgctttattttgtctgaaagtttgccaacagtgttgtaccattttaaagaactatattactaattccagtcatcatttttagtcaccaattcgacatactatatcatttttatagccatcacattcatggtgattatacatttacaaacataggaccacttaattttacacagaattaaaaatctaaatacttacgctagaattactttcctcttaattcttctgtaaatgttagatagggagttatattgattttttaaaaaatcagctaagttacatgtctataagctgaatctcaaatagtaaaaggaaaataaaaagtacattataaaaagaatctgagtcttctgaaatttgaaattattgatttacatatatgggaggtctggctttttgactatagagccaagcacaaatgctgtatccaaacggtgggcacatttctttggtagaaatatatagattctgaaaacactcttgacacattcagacctataaatggatagcaaaattttgacataaagatctgaaaataaattctaaagttggcataatagattctcttcaagcagttcaaatacaaatatattaaatgcctcattatgcaagacaccttgataaatgcttggatgacaaagacaaatatgaaataattcactcctctagagagttgatattctagtgggagagacagaaaaatatctaaagaatgctaatgcaatgttaacgtggaaagatttattttatacagttctataaaagaatgaaagaggcatttgagaggaagcctggtatgagatgtagcttttgagctatgctatggcgtatgttgtagagtgcctaaaatattgtgcgaaaataacattgcaaggaaagagacaaaaataaaataccattttaaacaagaaaataacagcaagaaaacttttctcagatggttctgtgtttgaaggaagttcgactgtgttgtaacagaaaacatttgatggtccctgatgggtttcttggaagaatagagtgatgaattctgtgagagaaagaaaaatcagaattattctgcagaattaaaaaaccaacgaacaaacttaatttggagttccaagggaattcctagagagaatgaatgagggaatgagaaccaatggaggaaggtaggtagatgtgatcttggttttggcaatggtgagagacagagaaggctatggaagtaaaacagaggaaagttaagagataatggaattgggaagaaaggtgcccatgaaaatgtagtattctaggagtccacatagtccagggaagcactggacttcccacagtttaagcgaagggaatgaaggcagttttacttaaattttaaaggaaagaataattccaaaggtggagaattaaaaatatccagcaagtcagaatagttattaccttgcaaactccaaaccaattcaagtttctcccatcaatcagtcacagactaatgctttctaaaaataaaaaatcatgtacctcagtgtcacagcaatgcaactgcttcaatttctgtcgttatttcctgggggatggtaatactgtatttacagaccagtactggttcatgagttaaggttttggtagcaccgctctggaattgggcagcatgggtttgtatcttagctcccacacattattgtggacctgggaaaaacacttaacctctctgtcacttatttatctcatctgcaataaaaattgtgtctaatttttttggaaatgtgacagattatcaccatattggtattggttcttcatttttatttagtaataaaatttctgattttcagttgaatacttggaataatccctacttttctcagacatgtttgtagcgaatgtcttttaagaggaccagccagactaacatggtgaaatcccgtttctactaaacgcaaaaaattagccaggcatggtggtgcatgcctgtaatcgcagctacttggtaggctgacacaggagtatccaggcggcggaggttgcagtgagctgagatcacaccattgcagtctagcctcggcaacaagagtgaaactccgtctctaaataaataaataaagggggaaatattttgtgtatctgaattgtgccctccaggatagaatgtgatgtttggtgcttcttgggccaggaaatagaactcacaggctgagagttggtggatcagcaaaatagaaggagcctgagtcctgtacatcatgggccattataccagccctggagtgtccacttttacgtttcttataagctagagaaaaaacaaattatcttattaacattcttttgaattttctctcacatacagattaagcaatgcccaacttatcaatgaataagttagaaaatatgtgtaaaccaatacttgactcatagaagacattcactaaaatttaatagtaattattaaataagtaggttgaaaaagtcatctatttgttaagtaaatatttaataacaacattctgcctgccactgtgctttatactggtgatacgaagatgattaagataaatcagctgcatataaaaagttcttgtctcaaaattacagtgtaatgatacgctattcgcagtttgttgcaatttttcaaatgatctacaaagtggagagttaagagaaaaactaggaacgtttgtgtctggcaagtaatgtccttactgaaatttgccattgtgaggttcctcaaaatagtgtagagaaaaaaaaaaaaaaaaaatatatatatatatatatatgtaatttgatcattctccatatatttgcttctgaattagaggggaagtggcaaaatataagagttaaattttatggaaattgtattaagtcttttccttaagacataagcttagcaagatgccattttgtctgactgtagagtgataacgaatcaggttagagtgaacctgatctaacgttacaaaggtcaaatatatttcctttctcagattcagagttggatcaagactacagatgtatctattagatttcttgatgcctattctcaaacatctgagcaaaatttaaggtctccaaaaagtactattattctaatagaattttcagtatatgtaacaggttgtctttttccaactgcagtttggaaaaatacaaatttgattatctaaaatttgaaagtaaattaattttaatttaaattgctctaatatttttatatgtttgacatacagtttatattacttgttttattagttttaaatgaacatcattacttttattaaaatttgcctttgataggaaaaaaaactgttcttttcttgatgccataccaattatcaagtgtttattgttttgatagatttccagccacttcaatgtgcaactgatatggacaaaactttttgtgtatgttatttaatattttatttgtaattgctaaaagagaagaaaatagtaagtactaaataaacaatttttagataaatgaaataattaaaaacttgaatcttattttgattatttatagtttgtgggtgcatttaaagataaccaaagtcttataattcatttagcagcttgagttataagcagtggctccatcaggtatattttccaatgtgctatgtatgtaatttttcttctatcagataaactaaaagcaaacgtaagaggaatgctctcaacttttgccaggccctctcttagcttttgtgccatgtcctggtgacgactacacttgaaatccctgggctactgtacttctgtgctatccttattgagagaatggctttcgtatgtttgaagccaatgttttattactctttatttccttgatacacccttgatatcttttgttcttctagactcacattccaaggttacctctaggttttcaatatgatattcatttgagaagacagaaagcatacagactgtaagtaaataagagtaaccttattatggacataatatttactctcacacccaaacacaataatttgtaaacttccataataaacttatattactattaataataaattgcttgcaacttaaataaccatgatgaaaaaactagcattcagattcagtgttttttttttaattattaatctaaagtattaaggataaagaataaaccttataggaccggttatttattatttataaatcttatctataaattttaattttccctggaggttaaaaaatcagaatactatttagtggtaatcccactattaaagtatttatttctaagttaatgtaacttatactttgtactatttttttaaaaaatgctatttggggttgattgcataggtacaaattattccaaaagtaaaattttaaaatgaagtatgtattcagaccctttagagacatgctaatggcaattcattccttactgcttattaaagtaagcctgctaagcagacctacttattagttgaatgtgttttaactgggtcctctccccagagtttcataggctgaaatcaacatctcatctcactgcagtccgacctgggggcttgactaagaaaatatttactttaggatattagcagaatccatttctttgtgaaagtagaactgaagtccccagtttttgttggttgtcaaccaagagctactgtctgcttctaaaggccactctcaggctttgccttgtggtcccatccatttctgcaatagagtaactgtttcctcaaatccttctcacacttcaaacatctgtattctgctaccagctggagaaaactatgcttttaaagagttcatgtaggcctgatggggtgactcacgcctgtaatccaagcactttgggaagtcaagacaggaggatcacttgagcccaggagtttgagaacagcctgggcaacatagtaaaactctgtctttacaaaaaatacaaaaattagccaggcctggtggcagacacctgtagtctcagctactcaggaagcttaggcaggaggatcacttgaacccagaaggttgaggctgcagtgagctatgatcctgccactgcattccagtttgggtaacagagagaaaccctgtctttgaaaaaataaaaatgaaataaagagttcatgtggttttgttaagtcaatccagatgatgtctttatcttaagttcaactgattcatagtccatctgcaaatactcttttcttataaggtaacatagttatagaagtaacattgagaggagagtgatcatgacggccgtattagaatttagtctaccatactaatctgatcaacacgaaaaattaattcataaagtatataagagtttctctgagtaaattgtattttacaaaattcctttcttttaaatatgctaaaaaaatgagttattcatattgctaattggtatatgtattttgtatttacaatcggttattttttatgttaatctttgaaggtatttcatttagctatgttctacattattatttttaatattaaggtatttatactttagtgaacaattttttaaaaaattagttttatttttccaataaattaaactgggatgctgtgttggtattattatttctaagagtttgcacttgtatcacattagcacttttaccagttgatgccatagcaacactccaagttgctatttattatgctgtatattaacaattatggtttctaattatagcgaaattccagtagatcagcattcccctacttccatatatagtatatagaatattaaatcttgaaatatacttatggctatattaggaagaatgggtgttttttatttaccaatacatctttcaaataatacattacagaatttgctaatattgctatagtttgcaggattctcttatttaatatgttaatatgttaaatgaaatatgcaaatgtcataatggattgaatttaggtaatcattaatatttctgtgttacacatttctttaggtaaatgtatacaaatagattatttagcttcacatgaattaccatcaataattcccttgaatattaaaaataaatgttaatatttgagatctagctactgtatgtaactcaggggtaactcagggatagaggaatgttgaaagttcaaacccagagtcaaattattgatgatattttggatttgcatttgacttgactttttcttttttcttttttttttttattatactttaagttttagggtacatgtgcacaacgtgcagattagttacatatgtatacatgtgccatgttggtgtgctgcacccactaactcatcatttaacattaggtatatctccaaatgctatccctccccgctccccccaccccacaacaggccccggtatgtgatgttcataggtgggaattgaacaatgacttgactttttctaacaagatttggtagtgttttcacatctttcttttgtgtactttttaacacataaaatgacaaaataagagctaaaatattctaacttaccggaatatagtaaacttatgttagtaataggaaaaaataagagaatggccaatatttcagtacttttttagacttgttctctctctgagtgggttatataaccaagaataaaatttaaaaaaattagttaacatagacagtttacatatatttacatatacatatacatatatatatatatatatatatatatatatatatatatatattaccaaaattaggtcttggatagtgttttcatgctggattagtctgttttcatgctgctgataaagacatacttgacactgggcaatttgcaaaagaaagaggtttaatggacctacagctccatgtggctggggaggcctcacaattatggcagaaggtgaaaggcacatttcatgtgatggcagacaagtgaagaaagtttgtgctaaaaattccccttttataaaaccatcagatctcatgagacttattcactatcatgaaattagcacaggaaagacctgcccccatgatacaattacctcccaccaggtccctcccataacacttaggaattatgggagttacaattcaagatgagatttgggtggggacacagccaaaccatatcattctaccccttgcccctcccaaatctcatgtcttcacatttcaaaaccaatcatgccttcccaacagtcccccaaagtcttaacacattataatattaactcaaaagtccacagtccaacatctcatctgagacaaagcaagtcccttccacctatcagcctgtaatatcaaaagtaaattagttacttcctagatacaatggaggtacaggcattgggtaaatagagccatttgaaatgggagaaatgggccaaaacaaaggggctagaggccccatgtacgtccaaaatccagtgaggcagtcaacttttaaagctccaaaattatctcctttgactccatgtctcacatccaggtcacgctgatgcaagaagtgggttcccacagtcttgggggctgccacctctgtgtcttcacatggtacagcctccctctcaggtgttttcacaggctggcgtttagtgactgcagcttttccaggcacattatgcaagctgtcagtggtctaccattctggggtctggagaatggtagccctcttctcacagctccactaggcagtgccccagtggggactctgtgtgggggcttcaaccccacatttcccttccccactgccctagtagaggttctctatgagagccttatgcctgccacaaacttctgcctagacatctaggcatttccatacatcctctgaaatctaggcaaaggttcccaaacctcagttcttgacttctatgcacccacaggctcaatgccacatggaggctgccaaggcttggggcttgcaccctctaaagccacaagccacagcttgagctggaccttggtcccttttaatcacagctggagtggctaggacacagggcaccaagtccctagagcacacagcagagggatcctgggcccagcccgtgaaaccatttttttctcctagctctccctgcctgtgatgggaggagctgctgcaaaggtctctgacatgccctggaggcattttccccattgtcttggcgattaacatttggctcctagttacttatgcacacttctgcagccaacttgaatttctcctcagaaaatgggattttcttttctatcatattgtcaggttgcgaattttccaaacttttatgctctctttcccttatgacattgaatgcctttaatagcacccaagtcgcctcttttgctgtgctgcttagaaatttcttccaccagataccctaaatcatctctctcaaagttccacacatttctaggacaggggcaaaatgccatcagtctgtctgcttaaaacataacaagagccaccttttctccattttccaacaagttcttcatgtctgtctgagaccaccttagcctggatttcattgtccatatcattatcagcattttggtcaaagccattcaacacgactttagggaattccaaacactcccacattttcctgccttcttctgagccctccaaacggttctaacttctgcctgtcacccagttccaaagtcgcttccacattttcaggtgtcttttcagcagcaccccacccctgctatcaatttactgtattattcctttttacactgctgataaagacatacccaagactgggcaatttacaaaaaaaaagaggtttaatggacttacagttccacatggctgaggaggccttacaatcatggtggaagaagatgaaaggtacatctcacgtggtggcagacgagtgaagagagcgagtgcagggaaactacccttttataaaaccatcagatctgagatttattcactatcacaagaatagcatggaaaaaaactggcccagtgattcacatacgtatcactaggtccctcccacaacacgtggaaattgtaggagtaagatgagatttgtatggggacacagccaaaccatatcagatagcctactaaaatatcagtaagttgaattttaactataatcaaacaattgacttttactgatatggagtggatattgagaaagaaatgcatttatgaagaaactgctatagaatgaaaaaatttaatggttttctacttgagatgttttctgtcattagacatctgagcagaatcaaatgactcctttataaaaatcttcatttattccctattaatgtggcaaacacatgtaaatgacatagtcattagcaaggatgagtaggtcataaatctgcattttcacattagtgggttgagtcacatttgaattcactaaatgaatacaacacattttctttcacgagtcaaaattccaataatagattttaagattgtttcatgaaagttagatccttccattgctttcttctatcttgccctttgactttctgcaaagactttcattttttagccaatttcctcagtgaaaagaacaaaacagaggaagttttgagctttgacatgctcatgatatcattagcaggaatactgtgcattaatgcaaagctgtctggccctgtagtggtcatgtcccctgccttaaaaggctttgagatgttgtaattatgaattaaggcatagaacagtaaatttggatagtacgttgtaaaggaaaactgaaggctttggtgatataagaccctcacttcccctaatctcttgttattcaatgaagaatgatcattttgatggtcttttattactacaatctaatataaatgaaggcttgttcagctgtctgtgttttatgtactgcttcccacagcactgggacccttccatattatttgacattacagcatcacatagggagttgccttagtggtttgctctcctgaggaaatcctattatacgctttgagtcagttcatccatgattgcctgggagaaaatcatttgtgttgttgaaatgtattcacttaaatgtttaaaatctgggagtcctggagatttttcattgaggaaaaataattttacatcttgtgttatattttgattttcgattctgacctgatatcagcaaagcaatctaaatatctccagagcaaaagtggaagtgaggagatgacaagaatcataaatattctactatttttgtggtaaatagctccatgacttagttcctaaattcaaaactcctcaaaggatgctgccccattgcagcattggtacccagcacaatgtctggagtgcaatgaccacttaatacgcagttgttgaatgcatggcaatgtgaatgaggggagggtaaagagaggcagaggcagaacaacaacctatctccattcttctttatggacacttgaaaatgccctgagaaaatcttacgtacttttctgacctgagactatcataaggcaatacttccaaggtatatgtaaagctagaaggaaaacagcctcttcatgctcccaagggccacttgtatttcaaaggcaagaataaaccttaatagccagaaattcttggcaacagtgccaaagaaatgttaagcaataatgacagaaaattagttatcttacattctacaggtaggtttgtagagtacaacaggctgacaggtgcctgtcaagaaaatgatgtttgacgagctataaagcatatttaatatgctaacccatttagttaaagcaccatatggaccttgatgatttgtttaactttgttcagttaatatatgttaaagtaaacacagtatgtctatacttaaatgaagcacacattttttgagtaatgtaataaatgtattttggatcaaatgtgttcacttaaagtcacagatgtaactgcattaaaaagaatatgcagttgtcattaaaacaaaatgtattttcttgttcaatgaattgaactacaagaaaatagtgttttattgaataaccactaatcaagcaaattgacttctaatatggcacaattcattcattcacatacttccagagtgttgctgccatgctccagaattacacttgttttccaaaaagcaaaatatcccaatgtttctatgtgacaaatgacatagataatttacaaaatattaaatacaatgaatgattgttttaacattaaatttttatagagaaatataaggatcccatttttcatacaaaattatagtatatttactaaatttatgtttgtctaaaaatatatattactcatttgtagaaaacctgtgagaaaatttgttacagtatgcatggcagtataaattgaaaagattttaatcacatgtgtaatcaaccttaaatgtgcccacaaatacaatctcataaggaaaaatttgagactattttgcaagaaaatattccccaaatcaggaaaaaattatatagtttagataactctataatagcaaatgtgaagaaacataggaaaaagctgagaaatgacctaaatatccaaaaatattggaaaatttgaagaaattatgaactgtgtacttgtttacatggtgttttgccagtaaaagggtaattatggaaatacagaaaactccttttgcttcagctgtaaattttaaaagatacaaaattttaaatatagtttatttatagatgcacacatttattatataaaagtatatatttttaaaaatttcaggccaggaatggtggctaatgcctataatcccaatttgggaggctgaggcaggacgattatttgaggccaggagctcaagaccagcttaggcaacatagagagaccccgtctctgcaatttttttttaaacagctagacatgatgttgcatgcctgtagccatagatgatcaggaggctcaggcaggaagattgcttgaacccaggtgattgaggctgcaatgagccatgatagcaccactgcccttcagcctaggcaacagagtaagaccctgtccaaaaaaaaaaaaaaaaaaaaaagccagaatactcttaagtgataagatagtggaaacaggaataatcttttactctctttattatttattatcttctgaacttaaagaatttttattaaagattaaaatctacaaaacaaacaatttattgcaatcttacttttttaaatctctttcacttaggataaattttgtgacccagtttcttgatgaaaatatcaaaagacagatttttttttttttaagatggagtctcgctctgtcacccaggttgcagtacagaggcacaatctcagctcacttcaacctctgccttcggggttcaaactattctcctgtctcagccacccaagtatctgggattgcaggtgcccaccaccatgcctagctaattttttgtattttagtagagacaggatttcatcatgttgggtaagttggtctcgaactcctgaactgagatgatccactcgcctcagtctcccaaagtgctgggattacaggcatgagtcactgtgcctggccaaaagacaggttcttaacaggactacttatgaagttataaaacacttttaacaaatgctataaccatatgtttatagaaagcatatttgtccatttatctctaatggttccttgtacggtgattttcttgtaaatattaaatgctacaatggtttaattaatgatcgttactctttcatcctcatctttatttgaaggtacattatgtttagaccaaaacattaaaaaacaacattgcttaatagcaactatttcaaaatttcaaaagaacagaaagttgacaaatgctactaaaaggtagagaaatgctactaaaaggtagaaaaatgtggttggatctatgaacttgcatgagccagaggagtaatgcagataaggtttctaaacaaagaggacgtcaaagatgttgatctagagaaatggtacaaatgagaactacaggggggagaatagggggaagaaaagatgacgaagtaaaataggacatgtaattcaagaagtgaaggctcttaatgtatgtttgtagagaactttcagtcttttgatcagagaatgagccaattcttgaagtagcatattttcctctaaggatgttctaagtcaaggatactagcaatagataggtgttctgcttcttctcctagtaagataatacggttttattatttaaggattttccaccttagaataattttcttagctataaaaaatggcaagtattatgatgaattaagtgataacataaatacatatattaagaattgattcttcagctttcaaattcatattactaaggttttgcatgtactgtctccagaacatttcataggatgttcatatttctttttaagtcaaattatattttactgtacattaattttcagcattttttttaagaacaaaagatgttctggacatctttccaagcatcctaataggataaaagaaaattacacaggtaaaattgagaaaaattatttgaattttcacttcactatgtgtgcaatttatccttagtctaaattgatgaggtggtctacagttttcttttaaaatatgtgattgttacagtaattctttaaaatacgtttggtagactatttaaaacattaagaaattcatactcagatgagttaaatggattcagaaattcagccaaatactacctttgggaataaagctcagggatttcagaatcctggtattgtacactaattaaaaaaagctctttgcgagactccatctcaaataaataaataaataaataataaaactcttgtcctataagcaaatatattgatttgtctataccatgtgattattaacaaagttgtgtatctttaaatatgcagaaacattacaatttaggatcaatataaaaggaactgaaaaaatatctctttataataacctaatatatatggaaaatatatgatatgtactacttttttcagaaccatcttctgagtacaagccatcactattcaaaaattgatgatggcaactaccctctgggtatatacccataaacattggcagcagggacttgaacagatatttgtacacttgtgttcatagcagcattatttacaatagacaaaacatgtaaatagcccaaatgttaattgacacaaaaatgaacaaacaaaatgtggtataaatataatggaatattcttgagccttaagaaggaagaccattctgacacatcatactgcagtataaatgaatcttacagttattatgctaagtgaaataagtcagtgacaaaaggacaaatattgtatgattctactatatgagacacctagactagtcaaatttatagagacacgaggtaaaatggtagttgccaagggttcagggtgggacaaatgggaagttagtgttcaatggacagagaatttcagtttggaaagatgaaggaataagctctggagaaagaggctgttataaaatgtgaatatgcttaatgtcactaagctgtacacctaaaagtggttaaaatgggaaattttatgtatattttattttaccacaataaaaagttggtgaaaacatcaatgtgattagtacatgaatccaaataaatcattggtggtattaactacatgaaatttcagttttctgaatttattctctaaatttgttgtaatttataaataaagcatagtgaaacaatagggaaaataatatattattctaaataagaaataactgaatgaaatttagcaaatactatctagaaagtatcataagatagcaagagaaaagtactaaaaagacagtacttttcaaaccatctaaatcaactatataaggagtagacagaattatagcattaaaaaatgccaataaaaggatcttatccaattgaaaattatagcatgtcctctgtaagaatacctttttctgtaaatattttgtggctgcctcttctttcctaaaataaactcttagaaattttcagaaggaacatctttgtggaagtagaaaagttaagctttaacatcaagagcagaaggctaaagaactggatgacatttatgccctaaactatatggtgaacacatttaatgccacaagtcatctttgttcctaaaatgaaataaacatatcattgaccagcaggatagagtcaagaatttgaaggtctaatacaaactgggttgaatccttgtatctctatcacctgcaggtcagaacctaagaaaattatttaaacctgagaggactcccagaatgaaaggtggtagcctgagtgatcaaaagattcatagagatactcagcaaccaaaatggtttctggacagtggactggcaatggctaaatcagatgcagtgtagtccgtgagagacatcagagggggactggtggatgagtagaagctggtagtgaatgaagaaggcatctctggatttgggaagaatgccactgaaagcatggatactgatggccagccatcatggagtgcatgctacaaacactttagaagagtatgaggcaaggagaaaagctcatactggaacgtgaggcagcaccaatcatttcagcagagcccagagaaaagcagagtgggagccttacctcatgttctttctctgaaccaagaaaaaaaataaaatgccctagaatttatcttactcctgagaatgaggaaaaggggaacgggtggggtggcaatccagaatataactgaacatttaaccaaaagaaactattgtgtactggaggtaattaaagaaacatgacaaggggaaagagaaaaagaagatattaactaagtgtggcccagttaacaagaaataaggaaagtttcaatttagtataccagagacttatgactgtttacatattaaatctgctatacccatctgggaaccactcctttagatgacgccaagtgactctattaatttggaaaaataacaccctagaatttagtgtctgctggggttagagaagtgggatgatttgctcaaagaaacataagattatttagagaaaagtccctagcttccagatccaataccctttcccaattgtaacataatgacctgttgatgattatgattagttcttattgaacatttataataataatagaaaaggatctcaaactttaggctgtatattcaaatcctaaatcttttgtgaattgttaaagtaactattaaaaacaatcattaaagacaaagatgtttgttgccccagtgagaaagactttcagaaataagtcaaacaacttgtagctctgcatgtgtacttttttttttgaggttgattttataatatgaataatggataaggccttagtgattgacccccaaatatcttcatttattaaaacatgaaacaaaaggaaagcttagtggacaaccacattgttgtaattattttagaaacatggcctttgaacaatcagagtatgacatgagtattgattaaattggaatttaagatgttgtcttaaagtagtgctgatttgaagtgcttttactttcagaaaaatttcaataaattactttgtatagcttgcaccagccacactttaagacgttggtaatgaacagttaaaatttgtccatctgtcaaactgtgtttgatgacagtatatgttgtaagagttgtgtaatgtatcagcatttgaacaagaataatgaacaaaaaaaggtagttttctttgaatcattacttaaatatctatcttgcctacagctcagaaacttgacagaaatatgtcttttttcatgaaacttaaaatcacctttcctgtctttaatatctaatcaatctgtactttgaggcattaggtagttacttctttattttaaaaagaagcattagcctttcagaattgctgtttcttgcagaattacagtctattatgataaaattgttcatataatgaagaatggccaggatgtagccactttccctggttctgctaatataagaaataggagagatggctcaaagccttctacagactttgatttaggactaatcccttaaaaatcattatggcctcatgcctctcacattacaacaaagtcggctacttctcttcctattacctcttgtttgtaaatatgattaaatgagcatattcaaaatagctattaaaatcataattattcaaaatgatttttttcgtattaaatgttcatagggactttttcttttttccactgtgaattagatatattattaattccaaactaagctcactgcattttagtcagatagcaaaaatctgtatcaatatacaggagggtttatcaattaaaattaatttgacaccctaatggtacatggtactataagacattctttttaaagtagtcttacaaatcatgagaagatggcctcaatgatattcaaaaaggcggtaccttctgctgccaacataagataaattcatgcagtcatacagtgtctatgtgttaagagcagcctggtctgagaataaaatatttccatgccacaaatctctttcaccaccactttcccatccttcagcgtccactccccactcaccaccatagttagaagcatcactgttacaactctgcagatcctgaatacgcctaggttagcatactgcagctctatcatgttcatctcactcttattctaggactgagtaacattttaaaactatttttaaaaaaagttgcacttggagtctgaaatcaaaatctatgctccttaaatgcacatggggactagatttatagcatccaccacgtgaactaaccaaatgtaaaattgtatgactattgtactttttctgtgcaggtatttctttgactatagtcatgtaatagacaaaagcacaaatgtggtgtctacttctaccactattaactgtaacaccttgaacaagttacttaacctcatgtgcctcaattttcttatttctaaaataagggtaataatgatacctgaaatcaaggaatgctgtgaagaatacataaactaatatgcacgaagtatttagagtaattaaaacaataagtaccatggaaatactagctctcattaagaattcatgattctagaatgaaattttaaaataagttatagaatttgaagaacaaagttttaaattccaatttgctttgttaaaattgcacataactctatatatcctaggtagacatgattgacagtagccaagagtgaaccacaactattaccaccgtttattaagaataaggagttagggggctgggcgcggtggttcatgtctgtaatcccagcattttaggaggccgagaggggtggatcacttgaggctgggagttcgagacaactctgggcaacatggcgaaaccccgtctctaccaaaaatatgaaaattagcccagtgtgttggcacatgcctgtaatcctagctacttgggaggctgagacacaagaatcacttgaactgggaggtggagggaggttgcagtgagctgagattgcgccactatactccagccttggtgacagagcaacactgtctcagaataagggaataaggagttagaagtctaagtaagttggataaattggagagtctaacatccttattatttcagttttcacaaaggggctatggagaatagttgcacataattctaaatttacaatggaacaagttggattaaactgtaaatattaactactatatctaggtatctacttgaagtctcattcagttaaaagcagaacatctgataatttttaccttactgaaaactctgcttttcagaaagttgagtaagggcttcattttagatcttattttgtcaaggaagcgtcagtttgtaaaatggaagtgacaggaatcttgggagatgttcgtatcgtctaaggtgccataaagccaaggaaataaatgctttgtagagtctaatatattccctagattttaagaaaatcttctgaacaaagtgagttcatgacaaagatagctgtgctcaaatgctgaaagctttaaaaaatgaaagttttattatagcctcacagatttcctaatgagaaagcaaacatacatctaataaattaatgcagttatatagagataaagctttctgttgggcttagcttttatagcagaacatataaaaagcggaagtaagcacaaaatgaagaataaattgtaagaaaactgagagaaactctaaaacatggaaaaaggcataggtgaaaatattgagtacaacataaattgtgctttatattatgcatgttctagaaaaacaaggcaaagttaagtttattgcttgaatcatagatgagagagaaaagagatctactcatcttgtattttacttccattttgcctgtttaccaggaactaagaaatggaataaatatggataagagttgaaattaaaatttaagataggagagggacaaatgggatttaaattaaacaacctttagtttcttctctcaaatatattctcttctacagattataaaatcctatgtgcaggcattaagtttattacaccagccttaccacaaacacataagtaatgcattgtactgtagtgttgccgcagctgcaacgtcactcagactataggaatttttcagcttcattataatcttttgggacttctgtcatatatatagtcttttgttaactgaaactttgttatgtggtgcaccactatacatgaaagtagctgcttttttaattggtataaaagaaatgcaaccttaaaaattcttttgttatgcattgtaatatacagaaagtagtgatgaaatatttgaaaattatcttaccataaaatatttcttattttgaagctgtagtgaaaaaatatatatgctggtttcagttaaacaaaattaatttttataatcacaaagcagtttgtgaaaacaagcagattgagtcagatagcccatcttttgataaagttactaaagcagttaatccatatcgattaagctgaaaggactcaggttaaaaatcaattctatgtaccagaacattggttcggctccagcgaaataatttggtgctcctgtctagaatcactgagtattgattcttcagaatcagactatgaagttgcaactttgattccccagagattttacaggaaaaaaaatggtcatcataaattagacttgagagttgttctgatgcattgagggaaaaaatgaaagaaattagcatcacctttggtaactaagggtttctttcctttctgtaggaaaacataggcttcaaatctcaaataacattctcagttatctagttatctaataacatatcttagttatcaaatatttatctgaatttctctccaattaaagcttattccctatgtatttgtatatacagacattcagtcaactaatgtttatcatgtacttactaaatgtgaagtcatagcccttttaaacaaaagtaaaaaaagttcgtatacaataaaaagacttaatttacaaaatggtgttttaaagtgtttctgggtttctttgctaacagaataaatctcaatataaatttataaatttatgcaaaaacattttctgttaagaaaacaaatcaaaccaaaagaattctctaggaatagaaaggctactactttatgcaagttgtaacactcacttcaagtcaaccaaattttgaccctcaaatcataagtatattactattttggttaagggcctgccaggattttcttcatcccagtttgctgatatcctttgggttggttatcctctagtaagtatgtgttatatacttatatgcacatcaataatgtatataccatatatttgtgttgtatatgttacagtagtgacacattaatgatattgtgatgtgtgtacttggcaattataacaatttatacaaattgctatgtgaacatagatgaaaacacaatatagattacaacttggactggagcaggtaattgatggaggagagaagagaagctatcatttataaaatgcaccaagcacagttctttgcattcattctcctgttgatttgacaaagcaatttatgattactagtatctccattttatggatgaaaaaaactgatactcactgatccatatgaacccagagctatatggttctaagtccccttccaatatacggctttgcaaatttggggtttagcgtttaaatttaattaagcttatgagcaaagcatgcagaagtagggaaatttagaacatgttcaagaaatagaattttcttggtttaatttgtgattaagagacaggggagggaatggagtggtgagaccaggaagacaagttggaacagatcatgtaaatccttagatggaaaactgagaaaggaatgtattttactggtagtgagagtcattgaatattttgcttgagggtataatgtgattgaacctcttataattttctacttccctacataactcatttccttctcttttactcttctgttgctagtaacaaattaccccaaatgttacagctgaaaacaacaaatatttattatatcacaattgctgtgggtcagaaacccagaaacaacttatctgggtaagtctgattcaaagtcttttaagaaggtgcagtcaagtggtttcatctgaaggtttcacagggcatgtgggaaattggagatctacttgtaagctcgctcaagtgattgttgacaatcctcagtccttcaccacgtgggtcttccatggggctgtctcagacccaggtagctgacttagtataaggaatataaaagagaatgagaccaagtcaaagagcacatgaagacaaaatccacagtctttcagtaaactactcttggaagtaacactccatctctttgctgtattctgtttgtaagaagtgaatcaataagtccagcccaaactcaagtggaaggcactgcacagacttgtgaacacccatagctgtatgattccaagtccaagaaaacaaagcaagcagagaaatagcctcttactctttggagcttatcataatgttgaaacagaaatatgaggaatgataatatgggttatcatttatgccacgtgaagatgagcatacaaagatatttgttagctctactgttgctaaactcaccttaagtcctttgagacaaaaaagaattacatagaactctagtttatatttcctattaaaggtttttatttttatttttgtttttattccatagtgcttaggataatatacacctcaactaggtattcattctataatgcaacaggcagtgattgttggggggttttcttaggggctgcctaccatgctacctctggccttgcttatattattcacctagagttattcaaattcagtaaaaatatttcagtgactacctttctcaatgatctatctctgacatgttaaactatatttttttgacctccagaaataaaagcaaaaagaaaaacaataaaccattggcttcaccatgcacttggacacatcattttgtttctttggtaagatctaggacatctactccacttgtgtcctcagaacactgagcaaagtgctaaatataatatatacccaatataactatattggcaatagaaaattaattgaaatcatttttggagtattacctgtgtatgttcaccacccttacttttagtttttatttttgattttgattgataattttttgaatactgcttgagtggctcaaataacatttcaaagtcacttctatgggataagaagcatgttttgctttgttttggcatttcctgaagcatttcttgtactgtttaatgcgctaaagcgtaaggattttagaagttcagaattttcagaaattctatgcaattttttgcatttttaaaactcatttgaccagcagaccctttgggaaaatgttagctgacttcatacatcatggggaaaaaatgtaagctagtttacctgctaatcagtatgagaccaaaacagtgattcaccttcaaatgtgatctgagttttttgtagccagagagtccttgaagtattgcaaaaatttaacaaaacagtaaaaaaaaatcctctttatagtagaatttcatgccattgttttgggtttcccatgtactaaaacctcaaaattggtaacaacaacaacaagaaaacaaagcaagcaaagagaaagcctcttactcttaagagcttatattgctgaaatgtagaaatataatgaggaattataatatgtgttatcatttatgccacatgaagatgaacataaaaagatatttcttagctcttgtattagttgctaaactctctttgagtcctttaagacaaaataattatatcacatagaactccagtttatatttcttattaaagatttttctttttatttatttttcctttctttccatagcacttgggataatatactcctcaacaatgtttgcattctataataccccatattgtctattgattataagcataaaccactacatagaaaaggtagaaagcaaaactgtcacagcaatggtgatctcagctatttttaaaggaagcttcgtttttttctctccacaggaaaagttgttttgacacccacccactgaacagtaaaataaagctgcattgattttgttttccccaccaggaatggcatgttactggattcatcttccacttagattaggcacacaaaaattaatgaattttaacagagctaaattcagcttcattttgtagccattttctttatgtatttacaatatgatctcaaacttgtataaatcatttgctttgaaatatatttaaagccatttttactcagtccatgctaagtgagtaaaggtttgcatctagaagagatgtcaggatattttagtgattagactaaaacaagcccaaagtaataataacatggcatctttcaccagaacagaagaaaatgttccccgattctttattgatgtttgtataatactgaggtgccaatagagataagccttggttttggctggtgcaagcgaataagcaatcagttaaatcagagcacaaagctgttaattcaaatctttgcagaagatagtaaattattcagaaatctaactcatctatctatcaaaaattgcactgagtaaaaaggtgggtttgaatactaatatattatacaaaaatagaattacagcatttaaatcattgaatgcagtgaaaattggatgagatgtggcatgcaagtaaataaaatactaatttccaactttaggaattataatttatgtggtggtttaagctttcaggtgatgtgtaattggatgtcttagctttactctgagaaaaagttccaattaaaaggaaaaccatctattgtttacatttaatacaactttgagggtttaaaagctcttcatcattatagaatttagagactaaataatgtacttagactctagctaattttagacaataagtgatttttttttttctttctttctttcttttcttttcaaaagcaagaccagcaactttgggaaaacctactgtcgggtaattgccatatggcaaaaaccatgattacttttgtaccaaggcaacctaataccaatacctaataccaattaccaattacttttgcaacaacctagtaaagtagcaggattctgactactctgaaccttggcaatctaagaaaattctgaaatacagtgtattcagaagaagcttataaatttgataaaaaagatgaacaatacctttattttaaagtatatttctacacaatgtatatttgcacttatcttcaaactgattttgtaatttgttatagtattgtttggtgttagcctaagtagtaatctatgatattttatctattaaatgtgaataattaaagagggtgaatttgggtaaactgatttactaatatttattaattaaattgagtaactttaggaaaactacattttcttatcacatttgttctcttgtaaaaagcatgtcaatacctaggagacaatagatgagtgctttcattcccaataaggcaatcattttcagaatgagctttataaagaaactaatagtcatatttcaacttgattatttgaccatcacaattttataaattgaaaggagtgtttgaaatcatagggcatgggtagtagtggaattgcattttttaaattacctataatttttttaaatgtcactgccttagaaattcttagggtatgtagtcttatcactgttaataagaaaagaaaaattatttaaaaatggggaagataaaagaagttgaaatgcttttttggaaggaccaacagaatccactttacagtgacatacatgaaatgagcaatgtttagtatattgtagtcaacaccccatcccattcatttaaattttgcaaataatttcatcaggagtaaatgtgaaaatggacctagagaattgtgagtataatttttttagtgttctgtcattgtgtgtatgtttgtatatatttaattttaaagaataattttaattgcatatatgaacagactttaaattgtatggttactgattcagtatcatctaaaatatatgtattcattaatttctctacaaatcttttactgagtgtatactatatgtgaacatagtatgtgctagagttaaaatgataatatatgacaagcacctgcattcaaagaactcccaggtaaatcagcacttgtcatgaaaacaaagtttcattacagagtgataaatgttaatagagtagggctctattgtcttagcttggacatgattagactccacttattgtggtaagtgactctagttcccttgtttattccagccattattacagagttacatatgactgctcagtctgcagccttttaaccaagatttcaaatggttgttatcattccttcttagaattaacatagacatagtgatactcctttcatctatctgtctatctttctatctatctacctatctaacagaaacaggagaacatacagctttttcatatatgtatgcttgtctttcccaaaattataagtttatagattaagcctttattttggagttgacgttgttttgtgtgcttttgcatttgtcgttgtacatttttctcccaattttgtggctgtaaggcctagtacagtgactgacatatatcaagagctaatttttaatgtgaaacactaagaaactttatgattaattatatgtatgagattggttttaaaacagaaacagatacccacaaagagacttgaaagatttgcttttaaatcaggaaacccacactctgctccctcttcatgtcttcctctctctctctctctccagtgtgtttattttagtaagataagtaagattcctgataggtgtaaagagacaagagaaaacattgctactgtatcacagcacattcattttaaattcaattaagttttctgatttctatccaaatggaaaaccctgcaaaccttcccattctgctaatctttgggccatactaactttctgattctaacctgtaactgattaactggacctttaaagctttttctgttacctttatacttggccttggtctagaagagtctcacagactctgtctctgcccaagctaattccaggaaatgctgtctattctattcagtgacctctcccgaggagtcagagctagttggtgttgatgacagggttggggaggtagtcaggggacaggactgaaaagaagtgtggagttaaataagtagatagccattttaggaagcctctgttttcctctggtttgcatggggattcatgcaaattagtgtaaactagacatctcactggcaaggctgcagggactcagctagaatctgtttggcatctgttcctcttgctcaacaatttctaagagaccaagaacaattccatagcacttatcaatcaaggggttgaaaatgacattgctatcactgagttaaatcaagtgtaagatcctgggggctgtgatcctggctctgtccctttaaaactggtgtgattactggtgtagctaccaccaagcctgagaatgccaaatctgaacgttgatggaggaacagcaaggatcctccaggcaaacagattgttctactccctcaaaaattcttcagaggagcagggagcccagagggggatcaaaatttctccaactcttcctcacttccaattatgtgtgaaagggaagatctatccaccacatccaaggagaagctccatcctaaacttgcagctcttatttctgagccagtcttgttgcagtgttgttttgatttttttcaaaggaacatgaaataaacagttgctttgtaatttatttttacatgtttctatcagcccttagaagttcaaagtattcaaaattttaaattatgttaattttacacttaaaaataaatgaactgaatttaaattacttaactttcttaagataatatttataaatttaaatgtgcatcactctatttttttctttttattttctttgctttactttactttttttttaagatagggtcttgctctatcacccaggctgaatgaagtgcagtgttgctcactgtggcctcaaactcctggattcaagtgatccttccacctcagcctcctgagaatctgagactacaggtgcatgccaccacacctcactattttattttccttttttataaagataggttcttgctatgttgcccaagttggtcttgaactcttggcctcaagtgaccctccagccacaggcttccaaagttctgggattacaggcatgaaccacctcgcccagccttacttttttttacttggtgaaatttctaaagaggaaacttgacattcatgaatactggaattaagaatatgagtaatatatgtgtgattaaatttagaacattttttctcttcatcttcatcttttacaatatatgtattttaactatgaattattgtacattgatggttatatttcttttttttagttttttttttcttttttttttttctggagacatgtcttgttctgtcactcagcctggagtgctgtgatgcaatcatggctcagtgcagccttgtcctcccaagggtcatgtgaccctctcaactcagcctccaagtagctgggagtacaggcatgtacgatcacatccaattaatttttgtattttttgtagaaaaggagttttgccatgttgcccaggctggtcttggactcttgggctcaagcaatccaccttccttggcctcccaaaatgctgggattacaggcatgactcattgcacctaacctgatggttatatttcatttacctatttagaatgttagtattgaacattttaacatataattatccaatttaatattaatcctttttgatattaatctcatattaatgttccatggaataatacagtggtcctttccttatatgccagaaatatgttctgagacctctagtggatgcctgaagctatggatgctaccgaatcctacatacattatatttttcttatacatagaagcctaagataaagtttaatttataaattaaacacagtaaaagataaccatacaactaataagatacaacaattataacaatatactgtaataaaaggtatgtgaatgtggtttctcaaagtatcttattgtcctgtaaccatctattttggaaccatggttgacagcaggtgactgaaactgtgaaaaacaaaactgcagatgggatggggactactgtgtttattgtcttacaaaaggaaataaaagtataatcttctttacgtaaagatttaagttttatttaggaactttaattaactacactctttgaacttaaaatttatattgtttccagctgatgtaagtgctactcagactctcttgaacttctttttcaattgtatgaatgtttcctagaaaattttatttgcatgaaactcactagcttcttttttttattttatatcataagatctctttcaggtggattgaatgtctgttccttaggtcacttgatagtacttgttctcaactaataatcaatgaagccatataagtttggatcttgaggtcacatgaaaacataacagtatttataaatttaaaaattagaaagaaatatttcttaaagaaaaagttctagcttaagaccagttccaaatgactgaagaaaggttcacgtggtagacagaaaaagcccccccaaagatacccactttctaatctctggaacctgcaaatatgttaacttacatgacaaaaggatttagcaaatataatcaaattaaggatatcaaaatggagagattgccccagattgtctgagagggctcattgtaatcacagggatctttataaggaaaatagaaaggtaagagcatcagaatcatagaaggaggtataacactgagaacagattttggagtgatttgattgttgatgttggaggtggaggaggcctgtggatgacagaagaagcatttaaaagttggaaaagacaagaaacaaatttgatctagaacctccagaagaaatacagccctaaagacatttgattttagccacatgaaatgaatttggaattctgatttgagatatagcataataaatttttatcgttttaagatgctaactttataaaatttgttatagcacagtagcagtaggaaaatcgtacagttctaaaaaagataaagagcagcaattcccaaaaggatatactcatgaattcttacctatttattcctttaacctatcgaatgtcctaaccaaatacaaaaatatgccattaccaaatacaacaacatgcctcattagcaacaaacacgtacttaggcttttgtccatttaggagttctaaatatttactcttctctccatcttagacaacaaatcctggggaatgtaattataatttactattaacctaaacactgccccagtttatgggccctaaacatttcaacgtttttcttctaacagtcccaagtgggccacctcttacaaagagagtaaagtgacaagtgttgaattatatatggtaaagtttatagaaggaagagatcactgtggacaggaatactcagaaagaattctaaaatacatcagccttagcaaaacaaggtatgtgctgagagatggttgcttggagagggacagagaggatgtggggagagaacattccagacagacatagaacaatatgtttggttgagatactcatatactcatatttttaattaaaaacatttttgtactaagaattatgcattttagttggcagaaagcaaacattcaggacatctagctcttcaataatgataaatgcagcttccacgtgactattggcatgtacagtttgccctatagaatcataaagctaaaagtaattttttgatacaaatcctcattgtaaaagggtctcaagattaaaataattcaatgtcttaggtaaaagctactttttaagtatgatcaggaatactgaagtgaatactaacatttttaaagtacatctcaatacaatcatagaagaaaggaatcttatgattatgtgtatgcgattttgtcagatagaagagtctgcccatttcaatttttttaagcggttcctaagctcagatcttaataccaaaacaagctactaagaatactcatttatagagtgaacaacaactaacaatttatttaagtacaattctgtgactttagctatatgtgtcatttagttctccttcataagtccttattcagctatggctaagctacgtctaataggaatactatggtttatatcaccttctatttaccaaccttcctctgttgcatattcaattagtcattgcaataacaggtaactattagagtaaaatgacaaatgttgaattatatatgccaaaatttatagaataaacagatacctcttacagatctataagatcttcaacaaaatagggtattctcaatattttgtttatgtaaaattcagagaaatgagtatttttcttcatttaatgcatttcaatatttttggggcttttgtttctaaactaatactatagaaatctattcagagctggaatgtaggaagtttcttctctttcagtgtattgcctccaaaataccagctacaactgttaatttcccggtaattgtttcctctctaatctctacaatgtttctctcattgtttcatttttactctgatgacatgatttgaggaaaggtttttgcacatttttggccaagttttttgcacatattgcacatttttcacattttaaaagttaattaaaagtttcctgactttttaatgatcgcccttctaactggtgtgagatggtatctcattgtggttttgatttgcatttttctgatggccagtgatggtgagaattttttcatgtcttttggctgcataaatgtcttcttttgagaaaagttaacttgtatatcataagctctctttcagatggattgaatgtctgttccttaggtcacttgatagtacttgttctatggagatgatagtacttgtttctgaggtgaataagctaacttttagcttattcgccccagaaaaagtcttagatattcagaaatcacaaaaatttaggctgtttccttggttgttgcagtccttccatttgttttaatatctcatctattatgtgttggctaggtaacgaatacatatttaatctaaaaatggatgtagtctgaatgtattttctaagttacattttaattttggaaaacaataaaaaattaatgtttttaaattttgatttcagtttacttgaacagactttttgcttataaaaagtagaacttgttgacattaccctctgattttccctttttattttttatttttagagacaggatctcactctgttgctcatgctggagtacagtatcatgatcatagctcactgcagcactgaactcctaggcttaagtgattctcctacctcagcctcctcagtagctaagactaatggcatgcaccaccatgtcagctaatttcttaaaaattaatttttaatatccctattattaattgttaacatctctatgttgcccaggttggtctagaaccctggctctaagcagttctcccatgttggcctcccaaagtgctgggattacaggcaggcgccgtaacacacagtatgattttctttaataattcaacatcatccattgctgaacagaagatgatattttgaagaaaaacaggaaaacagatattcgaagaacaaaagagtagcaaatactcactcctatctagctgtctctctccagactatttatagtcagtatcattttgttatctctgtcatagtacatttccaaattttttatctccactggccttgagaagtcaagttaccctagaacatgacaactttagatcattacagagtgtaatgggaatattagctcttttgtgtcatttaaataatttaacttaattaacaaacttaaattattctaaggattcttcaaattatgtcagacttttaaaaagttttccatgtttagccttttgacaaataaaattatacacaatgtgagttttatatcagcggcagtgatgtctttaaacacactttaaacatatgagtaacattttttttttctagtttgggcattttacagaccccttctttaaatctggctgtctttgaaaacttttaccattcattaacacctatattggaaagtggacaaaataaataaatgggtgtttgattctcaaaccagtccgtcctgtgatttcagtgaagtgttttggtggaagagcagttatacgagattcttataaaatctatgaatttcagtttaccatgatttccttttaccccactctaggtcaggaaaaggaagaaatagtttaatggtatgtgtaataacattgaaaataagataatcacaaaggagaaaagaagttataggagaagaggaagaaaggaaaaagtgtttctgattcttcctctcatgtaacatttcgacataattaagtcttattcattggtactgtatttataaatatttcaaacttaataagtatgctgaaactgatattaccagtataagaataatcaatccaattaagtataaaattaccttccataatattttttctgatcttgaaagggaatccataatctcattatagaaggatattactatccttatattcttttaaaagttgaaggaaatttcaatatagaataatatatcaaatccatcttctttcaactcagtttcaatagcattttcctaaaaggccttttcttcctttgagattttcttttctctgctttggatcgtgttttagtcaatgcccatttaaaggcaaaggagagatacctagtaaggccagctcaagtaaaaagaggtttctagaaaagacactggtcaactgtgtgtaactcaaggaaagcaaattgtcctgtgtgtcacaaggactgaagatgaaaaatagaaatgtgttaattacacagccatgcctttctgcatttttctttatgggtcaacatgagtgctaatctctgtttcttcatgcatgtcagtgttcatctctgtatcttcaagcacatcctacatttcaattccagggctgtcacatcactgaaatgtctgaatctctaaatcaaagcttcaaaacagagagggattatgccacttgagtaactgagtacaactcaatccatgtaagaatgaaattccttatccctccaatcactgtaaactggcttttactccagagtttccaatctcaagttgacaattttataattaatctcagatttctctttattttctactaaattttctcactcataatggtagcacatcatgtttattctgcatagatagatagatagatgatagatagatagatagatagatagatagatagatagatagatagatagatggatagatagatagacagatagatagatagagtttcactctgtcaccctggctagagtgcagtggagcgatcccggctcactgcaacctccgcctcctgggttcaagccattctcatgcctcagctttctgactacctgggactacaggtgcctgccaccatgcctgacttattcttgtagttttattagttttattagaaggggtttcaccatgttgggcaggctggtcttgaacttctgacctcaggtgatccacctcccaaaatactgggattataggcatgagtcaccatgcccagcctataattcttttcatatgtgatctgcaaattttcagtcttatacaggagttaaagatgaagattctggttaggacacctaagttcaaattacgtctcttactttggatatagtaaatatcctaagtcccatgaatttccggtgcctcagttcctttcactgtaaaatggggaaagtgattattcctatctcatagatggttgtgtggatttaatgaactagtatttataaggcacaagaaacactgtcagtcacattgcaccatataagattcagataatcgtaataatttccattctaactacaattgccataaatgtagtccccctaaactactgtaatcaattccttataggtccctattttagatcagttttcctaaatcactggtaggtcatataattttcacactatgaaattcttacttgtatatgaaatcctacatgccatccaaactaaacccatgtttgctccatcattgaaagtcttcctcaatctactctaatttatgttcccagattcatacttttatttcatccctttaaaatcactctgcttctcatgtgggatttcacctactttcatgtctgcaagcctttgctcagctgtctatgtcccccaactctagccttaaaagcacttcaactcttgtctgtccgttcaaatgttttcaaacaaaaacttttgaaatcttttttcccctcagaatagaaggtgttgagttacttggcttatttttgtttaaagattcattataagcaaagaacaggaacatttaattcagaattggtgtcttaagtaacttatttttctgccattttatccactaccagcccttacacttttataagcggttttacctattaaatgagaaaaatgctattttacaaataaaaaccaataacaactctggctcgaaatgtttgtgtgtacagataatatttcactgatgttactgtagggtgtttcataatttttatgaaagtaattcaagaaatgtcattcttttttaaataaataatgaattatactctgatataatataggaaaattgtctaaaatatttggtttaaaaatatcttttcaaaacattgaaaagctggcagtatttatttatagtgacttctttcttaatgtcagcagatagtacaatttctgtaagtgagaattttaaaattaattgaaaactctcctgttagtaaattaaagcatttataatatttcattattatcattcagtctgttgaaacccattaaaacattatattctacataatgctcatttctctggactatagttaacttattttttctttttcccccttttcccttctgtcctgcctctcctgtcatctgcacccctccagcctaccccaggatttttcttcttcatttctgtgttatatttttggaaatttcccttacccccttgacacattctcttaatctctatgcatttttctttaatctttcagaggtttcttggggcagagaaatgctgttctttaagttcaaggatgagcattttggtcctgcatacatctctgtctgtgtacagcagaaagtccattatgtttgatttttggtcttcactgaactgtgaataacctttgacttctttacaagaccaacacttcaaacagaaaaagggctcatctttgtttttggatataactgaatactcagccacctgaggaactttcatcctcacagcaacctttctttttcattaagaaaatattatgcaacagtactacaagcatcaggaacctctctctaggaaataaaataaaaagaagaaaataaaaggagaattaagaccctagttgtgtcacagagcaaagggctatgtgtagtgagatcttgttttatcttttattccactagttctttactgataattattccattacagactagtcttatatgtatttaataatctaaaaaataagggccaggagcagtggctcatgcctgtaattccaacagtttgggaggttgaggcaggaagatcacttgagtccaggagtttgagaccagcttggacaacatggtgaaaccctattcctacaaaacatacaaaaattaccctggtatgatagtgttttcatgtagtcccagctgttagggaatttcaggtaggaggatcgcttcagcccaggaggtcaaggctgcattgagctgtgatcctgccactgcactgcagcctgggcaacagaatgagaccctgtctcaacaaatcgtcatcatcatcatcatctaaaaaatagaatgatcatttctctgttgttataggccattatatttttgtgcttttttctttcatttctgttgtatatgagcagtcatatagatttctgatttgtagaaactctcactttgaataatgataactagaaaatagattctattaaatttagaaagacagagttgacagccaatgctatgtaagtacatgaggaagaggacaagaaatagcttttcttcactacatatttttatttatatttatttttattgttttgacttcattttatgtaaaattttgggggcatgttatagctgaatactaaagaaactgctcatcaaattattggatcttcctctctcaaagaaatggactggaataaatcagtgtccatgttgtacaaatggagggctgcattttacataaggttgtatgggcctctttgataattatatctgtttgatgattcaggggctacttgtatctcatctgctattctcctgctagttcactttgttactggaaattaaaccttctctttaaaaaagtctcaacgaaattgagtgtagacagaagatctgtaaatagaagttgaatttttatgtttgacatatatgttgtaaaacagaggaattcaggtttcttaagtctatttgaccgcttgatatgatgctccttagttctctattcaaattgtccttcacttattttttttctttgttttccttatctcatgcttgtttttatttttcctactcaacctaatatcacatttgttatgttataaaagagggaaatgtgattatcaatggtattttaaatgcatgtttaccctgtgtatttccagtctgcatgagaaagcagaacaaggagaaaagaaaatgaaaaggagataataaatgcttttaagatattcagaggggccaggcacggtggctgacatctgtaatccactttgggaggccaaggtgggcagatcatgaggtcaagagttcaagaccagcctggccaacatggtgaaaccccgtctctactaaaagtacaaaaattagccgggtgtggtggcacacgcctgtaatcctagctactcgggagactgaggcaggagaattccttgaacccgggaggcggaggttgcagtgagctgagatcacgctactgcactccagtctgggcgacagagcaatcctccatctcaaaaaaaaaaaaaaaaaaattttttttcagaggtttggtacatgaaaatgtgtgactccatcataaaccttactccaactcttttcaacctcctccactactttttacccacattatgtctttcccaatgaatctggtacacccactgccctagaaagtgccttgcacttttctagtgtttctcatcctttagtttttttccttaatttgaaaatctattacctgaggctcaaggcaaatgctccagttccatgaaaccttttctgaatacaaagcaaatatttacctactcattatgttctactgtataatgttttgtaaatcgttatttatctcttatgtaattatgctccatttccctaactggattatgaattctttaagatttctggcgttctgtctgggtacagtgctttgtagcaaagggaagggctaatttagcactgttgagaaatccatctttgggggtgaaatttatgtcaaaatcacagtttgaggtctgtaggatcaacagaaatttataaagtaaatgagaagattctagcactcagtcctcttgttcctttctctgaagtgtcacatgagagattaatctaaactccacagaggagaataaaacagaaacataacatgagtggaaacttgtagtgtccaaatgtcctagtctgacagcacagatatattaaattacttatgatcattgttttggtaaacatttccaagatcagaaatgacaaagttaagtgatacttcttatttctgcttttaaggtatgtctttaaaaaattacttacattgagaatatttaaaaaacataatatgctcatttgatttagagtatttccctttgttgaattgatcataaattataaagctatttagtgtctaatgtactatttttcattttcattctctcttctttgcctaggcatattgtatagacacacacacatacctataggtccatgtttatactgtttaacatgctacttactaaatattagggagcaggacagttgttctactcctgacagctttgataatgtctaaatatttaagaagagatattttaatactagatgagaattttaaatgtgaggtcattgtattcttgttatgaaacaactagatatttaaatttagtttaatttttttcagtagtggtacttgctattgagttctccaatatatttgagcatattctaagttgaatgagagcaataatttggtgtgtggtggtggtgaggtctcacttttgttctttggtttcagtttagatatattgggcttggaagtttataatatatttaaatacaaaaagaccatgtagcaaattcaatgctataaagtaaaaagaaaagcaaaaataagtgatataaaagaaaaagaagcatgatcagcatataaatttgtgaagtcataggatttggctgaaaatcatcgggtttctttctttctcacatgttttcatgatttgactgctgaacaaagcttcccaaagcgctgcattttctcagtttttccttacataaacatgagagaataaaatgcagtacgtctgcatccagccactttttaactcctgtagatctagtgtttaggtagtaacctacaatgatttcactttacttcaaaatatttgtgctgtctctgtatatcttcctaaaatatcatcaccttgcacatattttgcgctatggtacctgattaaatagtctgttgtatgctgtgaataaactcatgattgaataaactcaagggtaacttcaagtatctgaattgaaatttagggaatttatgtcacactacacatagcatataacttttaaaatatatttattgtgacagtttttatttttaaaatgcaaagatttagaaagaaaatttatatgtagttttatcctatgattagtggccaagaacaatattaaagccagaccatctagaggttcctttatagagatgtttagtggctattgtgtaggctttataggagtatgtattaaactgctgtcaatttaccagttattagatgtgtttacctgaaagcaacatgaccattttgttttgctctggaatgctaaattagtggagttatgggatagtttatctctgtttatcagctacaactcattttacttcatgtcatctctttacgtacttacagaatgtttcactggtatgcatgctgggattctgaagagtctttttttcttaccttctgtatttctagtctgtcactaacttgctgtgtcactttgagcaaattatttttttccactgagtcctaaatctttatactcccttaagatatacttttcttgaacactaagggcctgaaattacatgtcactctctctatagaaaggtaactttttcctttaacccatcgggcctatgcacacacttcttcccagaaatcttcaccaattaggtaagttatttgtagagcagatgcattatttctaacacgtcaatgttggaaagtgtactgccttttcattaagaatttactaaacatatagagaattgatggaataaaaatcccccaatccttgaaagtttatcatataggagttggataaatattaatttagtttattatgaaaagcttaagttatctaactatagataaatccaaacatagaattagaggtaaaataccctaaaatgatatctattgccgttttataatggcaaaacaataagacaggttacttttattgtaattatttataaaaaaagatatataaatttgagtaagttctgatctttaaaaaattctcatatctaattttttatatatgcttgaatgctttgtaagaatgaattgtggttcttttagaaattgtttttattcagggaatgttgaatatactagaaaaaataaattcccctaaaagctaaaagcttaaggcatttgccttaaatttcagaagtaaaagtaaaagatgcattattcagcgtatgtttcttaggactctcctacgctcaaggcagggtaaagtttctgttctgtaatgagtatgttatcagggagggagggggaaatgatatcctgctacaactcttatccatagctattgccattatcttctttctcatccaactatctttactttttcaattacactttctaaatatggtattcttttatattatacaagaaaagagactattacaagcttcctgacctttcctttttcctcaagaaatgccagcttaatcctaccctgatcctattaagaatcaaaagcatttactaataaacattcaataatatttattattaagccatacttccaggtaagaccttgatgttaagtcttcagatgcagctactttaacccttaactgttgtaatttccctctcctctgatcatacatggactcctgagacatagctgttttccaaacttcactgatgcaatttcttcttaatgaagtccctatactagaagtttctgacttaagaattactaggactgcattatttcctttctcagtaatgggtagtcttgtttctctgtttctttctaggactaagacaatgttatgtttttgcctgactcctttacttgctttcatcttttctggtcctgctcagcctgaggaatgggaccctgataccagtagtcaaatcttgatgacaactactagcctgcttagatttctgaatacattttttctatgtttcccatctcaatatttaaggcatgtattagaaaaatataacagctaaggtaatttgtttgggaagtgccaaaaaactcaacttaaactgactaacacaaataaatgaaaaaacaagcaaggaatgtgttgacttcaaaaaagaaaattcagattcaggtttgacatggaggaccagcgacaccaccatctctggtttctctagtttcccgctactttcccagggtgttgacttcatcctgaaaaactacatgatgatctccatcccaccagcaactctaccctcttcctatgtggtagtaaatgttttgcagccaaggagcattctagccctcatactttcacagtatattgtccaagagtagagaaaatctcctttggtaggctctgcacaagtcttgaggttcacctcctctctggtctcaatcgatttgtaccatttaattaaattgtattattattattattattattattattattattattattattatttgagatggagtttcactctgttgcccaggctggagtgcagtggtgtgatctcacctcactgtaacctccacctcctgggttcaaacgattctcctgcctcagcctcctgagtagctgggattacaggcacacaccaccaagccctgctaatttttttgtatttttactaaagaaggggttttgccatgttggccaggcaggtctcgaactcctgagctcaggtgatctgcctaccgcagcctcccacagtgagattacaggcatgaaccaccagccacctcacccagcagattctgatttgtaccatttctatttatttatttatttatttttggaggcggagtcttgctctgtcaccaggctggagtgcagtggcgcgatcttggctcactgcaacctccacctcccaggtgcaagcgattctcctgcctaagccgcctgagtagctgggactataggcgcgcaccaccatgcaccatcaggcctagctgatttttgtatttttagtagagacggggcttcaccatgttggccaggatggtctcgatctcttgacctcgtgatctgcccgcctcccaaagtactgggattacagcaggcatgagacgccgcgcccggccttgatttgtagcttttttttttttttttttttttgagacggagtctcgctctgtcgcccaggctggagtgcagtggcgcgatctcagctcactgcaacctccgcctcccgggctcaagcaattcttctgcctcagcctctcaagtagctgagactacaggcgccagccaccacacctggctaatttttatatttttagtagagaccgggtttcactatgttggccaagatggtctccatctcttgacctcgtgatccgcccgcctcggcctcccaagatttgtaccatttttaaatgattttttgtttccaagacagtagatgcgctggtattttaagccaattgaagttctctgctgaagctgagggtaagattagttccacataatggcaaggtttccttttaaggaaaaccagaggagagaagatggataatgctgaagaggggttgtttaatgggtacaaacatacaggtagatggaaggaatatattctttaggatcaacagtggagcagtgtgtattccttacagacatctccaggcacctcacattttattgattgattgattgattgattgattgagacaatttcgctcttgttgcccaggctggagtgcaatggtgagatctcggctgactgcaacctctgcctccctagttccagcaattctcctgcctcagcctcccgagtagctgggattacaggcatacgccaccaagcccagctaatttggtatttttagtagagacagggtttctccatattgctcagaccggtcttgaactcccgaccttagctgatctgcccacctcggcctaccaaagtgctgggattacagatatgagccaccgcacctggcccgggcgcctcacattctaacactttgcaccaaccaactatagaatgtgatgaagtcaccacttccccttgggaactctagcttatccgctgaacccagtatctgttactatctcattcagctagaaatacttcctccaaacaggtcctgccatagagggaaaatctttaccagctttttaccctcttttgcctcctgcctattctactttcgctaagcccttaggatcgataattaatatgaaaattcaacatttgtgaatgaaaatattagttcaattcaaaataacaaggttatctagttaaagaacatgtccatattcacatagaccaaagaaagaatttaagagaatgtgtgctagaatggtgctagaaatgatacacttgccctcaacaagtatttgtgattccagaccctggctgttgaggcgacactatggggaatagcacctgaacatttcttatgtcagtagcctccagcctgtataatacattttgaaaagttccatgcttgttctgtaaccttaatatcttctatgttacaaaaagtgtttgaaggagtgtctgccttatcaactattagttgattttgagtctcagtacttcaacagtgttgcagaagagcatgcttcatttttgaatagcagcaataatttacacagatattcaaatatatacttgaaaatatatacatacatatttattggtaacaataattttagagataagtaattttttaatttatcaagctgagcttcatattgtatcaatcaaatataaataatgagatgatttctaatgattgtgtgttcacaaaatattaattataagaaaatcgtatttcactagaaaaattggaatggtatttgttaattcttggcaaacacacctttttataagaatgggcaaagcaaacatagagaccatgggtacattttatttatacagatacccaattaagaaaaaagcgtaaataatcaaatgcagtagaaaatgtattaagataataaaatattgttgacattttatcaggttttaaaataagttaggtggtaacgatttttaaactaactttaagaaaatgcaaaaagatacgtagattaaaaataatatagttttaagcatttaaaatatgaaaatgcagctaagagaaaactagtaaataaataaaaaatagccatctttcaattatttgtcagctataaggcaataatcaaaacacatttaaaatgaaagtatttgtttacctattctaaatatacatcaaaataatttattgacttttaatacagttaaagaaattagtccaaaaaggctgtttgatttacaaaatataaaacttccaagttgagtaactgcaaagagatagttcttagaaatagacaagcttaaatcaatgttctcttttccacagagctttcttttcaatgttgttaaataaagtatatatgtgctataactcagttttgtggcttttttaacacttgttctgaccttcctttgccttcaatgtcagacaggatgggtaggcactaacagtttctagacttttaaatactaacttatactatactgtaatgatttttgacattcatagtcatttcaacattctagtaactaagcaatctaaagctagttggcaaaaaatatgcacaactctttgattagtaactatgttttgatgtttacatcaaggagtctaatctgaaatatccttcataataacctatgtagacaagggcaaagtaagacttcaatagccacctagacagtttggatgatggccagatgagccagtgttctaagggctgtcggtgaccttgtagtgaattttgcaaaagtgcgaatttctctgtctcaggcagttgtatgattaatgaaacacacccacgaagctacagtgcttggtaaacacatgttggctgtaaacaatattcgttctctgaaggattctgagagaagtggtgaatacagagccagatttacagagcagtattctgtacctcaaatgtaagcagtgctggagtggattcatgaaacttcaattcagtagtgagaaagtcaagccttatagctttccaatcctttgaagcaagatgtaattctttcacttttccatagtatttcttgtttcaaacaacattctctcttaatcatatagaaaaaaatacaagagatgaacacagtaaaccaatgaatttgttcatgtattcctctaagaagagcccacatttcttagtctgtgacaagaataacacctttgagtggaatactaaacaaaggtatgaatggattcttagcaaaataagagtgtacaaaagtcaaattatcagatagctatataataatttctgtagtgtttaaaatgttcatgggcgtagagagatatgaagggatattttaggatatctgtgaaaaagtaatacatttaatatattttgatttcagtggattttttatttagttcattttgatattcctctgataaatagtacagatcgtaatatgatacagactagactttttaaactgctagtagctaataggatacttgtgatttgaaaaacttttactgaaacatacaccaaatatatatattgtggcaagtgaatatgtaaatgacttattaatagaggtccagtaggtaaatgtctgtgtctgtaactttgtgtgtgtacatatattgttgcagaaattggaacaagtatgcttaaaaaggagagaaagcaaatttacgactttcaaaggcaacagtgtgtgtttcatttataccaattcttttttgaacaaatacattttaaaattgtattttaatctttatggtaatcaacataggagaaggtacatattaagtgaagagaggacaaatgaatgaatattcatagcactcagatttctatattttactgtttctgattgttatataaaactgatttattacaaatgtaagtaatacacacatttttagacaatgattagttaggtaactgctcaaagaataattgaaaccaataaatatcaccatctgtggacatatcaggtattgtcctttaaagataagtccttggcctggttttattagattatgttatcagaatatttttagtgatctatagaatgataccactttggatgagattgccaagatctggagagagaggtaggatttcttgtgactttgaaacactggaggaatgatgcgtaataaatgacattgtattcaaaggggatgagtgtaatagaaaatagctggctaggcaaaaaccaggttgtctgaaaccagttaatgtgcataagcaatgtgatcttactaaaagcatccttatgcatcctgttttcatagagtggcgtttgttcagttaaaaacaaagcataataacgaacaaaaacttgaatgtcctcagagcaggatggctgcaagtattagaaaacaattctcagtctgagtcagaacaagtgtgcagtttaatttctatacttcaaaactgatgggatgaacatgtgtaagacttggagatggcaactaaaatgagtaatgggctggaaaccaggacctctaaagaagggttcacggagttactgtcagtttgaggaaagaaggcaattcaagtacatgaaagactgtggtaaaaatgactccccaatgaacaaatgtgtgaaaaccaaaatatgtaagattaagtaaaaataagactataagaatttcatgatactatagtttttaaaaggagggtttttccattgttaaataattatcaaattagaattagaaagtctcttaactgtatagataccagtaatagctatatatgacaatatagaaactccttcagtatttgttctccatcatttccaaaacaacaacataaacacaaacacatcgtttacatatttgctaatgcataacctgtcactgataattgtaggaaagttaacgtgcaaaccatttaatgcattaacacagatcccttaattacttgccttaggaagggcatgtaatgggtgtctgaaaagactaatgtaaactacagtgcccagacatttcatagtcctgtgaatactgagggcttaggctgttgttgcactatctgtggaagaacagttcaggagtcagtatgcttatgagttggggaaagattaagatctttacatacaccaaaaagctcgtgaaatctgccccatgagaagcatgataccaagaaacagcatgatggtagtaggagatagacgatcccaggtaataggggctttccaagagagtgtgaggagcctataaactataggatcaaaactatctaggttcaaacccaaatctttcagtaacttacatgctttatgctttaatttcctcatttgtgaaatggcagtgatgatcatgataccgatctcaccgtggtgttgtggggattaaatgaattattataattaaaccccttaaatcagcgcctgacacagtacaaaacactgtatagggttagtattatttagaatgatttatatagctttgatgtgtttaaatacccttcttgaaccagtgtattttgaaatggtatttcaatatccagacttaaaatgaccatttgggaaagggtccaactttccggacaaattcagatgagcaaaattctttgaattggagattcaaaagagaaaagagaattttattggctatgattattttccaattgtcgctctttttactgctatgtatattttatatctcattttcatttacatctattgtaaaccaaataacagatttaatattcctgttagcatcacttctactatttccttttctgtgcgtgtgcatacatgtgtgatattctttacatgacctggtgtgtgcttcatattgcaactgcaattcccctacaaagagggaaacatgatgtgacaggaggctgtgtctaaagacagtccatgagctgcaggcagagctggtaccatttgtgctggccttttcccaggggtctacacgtcaaatatgggcatcagactggctttctggcttttgactgaactccagtagacataatatgaaaatgaatgttaaactttgtttctgccatttttgagatatttaatctatacctattgttattcttctaaaaaaataacttttttggcaggtactgctcttagcactggggatacagtgagaaatcagacagaggtttctgcttgtaagaagctatcattgtatagataagtaaataagcaattcatgaagataatttcctatcttcaagtactattaccaaagaataaaatagataagcagataaagcaatgcagagtaacaggatggagtgtcctattttaagtggagttgtaaggaaacatctctttgaataactgaattaggaacgcaaagtgagttaagcgagggagcccaccatgtaaagacctggatgatgagtgatgaacgttacaggcaatgttaagaaaatgtgcaaaaagcttgagtcaggaaagaatgtaatgtattaatgaaacaaaaaggaggcagtatggataaaacagagttgttaaagggaaaagcctttcaagatactatcatagaagtaagtaccctagagctatttgtataggaatcttgcatttaattttattctgagtgtatatcattgcaagaatttaagcagtgaaatgacattgttatatttacatgtttttattgatacataaaatttgttcatatctgtgggatacattttgttacatgcatgcactgtgtaatgatcaagtcagggtagctaagatggtcatcaccatgagcatttatcttttccgtctgctgagtacatttcaagtccacgcttctagctatttgaaatgtacagtacattgttattaactatagtcaccctactctatgatcaaacattagaacttattccttgttccttccaaactctcttcacacgcgtccccacccctgcatccttcccaggctctggtaactattattctcctctctacctccatgagatcaactttttagctcccatatatgagtgagcacatgggatatttgtctttctgtatctggcttatttcacttaacataataactcctatttccatcaatgttgctgtaaatggcataattttgttctttttttagctaaatagtatttcattgtgtatacataccacattttccttatcttttcatctcttgacggacacttagtttgatttcacatctttgctattgcgtagtgccgcaataaacataggggtgcatgtatgcctttgatacattgattctctgtttgattttaagataaatatgtagtagtgagattattcaatcaaatagtagttctaattttagttttttgagaaatatctatattgttttctataatggcttctactaacttgtattcccaccaacaatgtataacaattcccttttctctgcatctttgccagtattaatgtctttttgataaaagtcattctaagtggggtaagatgatattttattttggttttgatgagattttattttgggtctgattttcatttccctgactcttactgatgttgaacattttttcatatacctgttggtggtttgcatgccttcttttgagtagtgtgtatttagatcttttgcgcactttttaatgtttggggtttttttatgttgagttgtttaagttctttgtatattctgtgtattagtttcttgtcagataaagattttgcaaatacttcattcaacagtttgtctctttattatgttgattgtttccttgctgtgcagaaggtttttggtttaatatagtcccatttgtctgtcttcgttttgtttcctgtgattttgaattcttacccataaaatcttggcctagaccaatattctggagtgtttctcttatgctttcttctagtagttttatagtttcaggtcttatgtttatgtttttaagtcattttagtggattattgtatttgctgagggataagcatctagttttattcttctgtatatggacatccagttttcccaaaaccatttattatgttttcaaaattattaagattttgcatggagaatacattgtggaggccacttgttttcacacagatcaatgaacagaatctatgtactcagtggagattgtatacctagtccatagataattatggggtgaaaacgatgctatctgtgatgaggtaaaaagggattcaaaattttctttggaaatagacaccttgatggactggttgtgaatgttgacaaaaatatttattcacaaacatttattcacaacatctcagatgtcaggggctgcttttctccttgtcttatcaaagggaagttgacaagaaatcatatgtatgtacaaatttggagctcagggagattttatttctgagtatataaaaacagatgtcatccacatacagattatgtttcaagtcatgagaacagataagatcatctatgaaaagagtatgatagagaagaataaagggccataaattcagctcaagagccactaacatacagagttaatttgaggaggaagagtaaggaaatatcactagtgaggaacagccattgaagcagaatgaaaagcagatgttttctataggctaaaaagctgtgtttttggaagcagggagccgtctacataatactgccgagaagttacttaaaacgatgttaaaaaaaaaaaaggtttatacattggatttagtaagatacacgtcagtagtaatcttcctaagaaaggttttaaacagagtagtggggcaaattccaaaaaaggaggagatcaaaaagaacatgggggtgagatggggaggagtcaaatagaattcacaagtagtaacaattcctttggagatgtttttctgtgaaaggaagcagagaagaagtgcatgtggacacttactaatttcaataaggagaacagattaaacatttaaacatggaggtagattggtagatctggtattggaaaaaagagtctgttctcttttgcttgtttgcctttttttctttcaaagtggtatataagtcacaattatcagctgagaataggagaagtggtattggaggtttgaggaccaaaatgtgataaaattgtctcaaggaatgaaaatgaataataatgaattagtgagatgcaaaatttatcagtacattttgtttttctttcactcaggattttgttctatgactatttggaaaccaacaagaaccctttttttgttacgacaactatattttaagtcttgtttaatatatttttatgtgggtcctcatagtctagtgattagaagtatgaacttttgagtcaaataggcctgactacaacaggttaaattccttaattgtataagcctcaactttaagtactcaatggggataatatatttggggtaaacagcttgagtttgaacctgaactccgctgctgattagctgtgaggattcaggcaattcacttatcaggaaaattagaataaaaatacttctaacaataataatgttagcagtaattacaccactcagaatctggtgcttgataaatagcatcttcatggctatgggggtttgtttgtttgttttacattttaattaaagtatttcctcttatttcagtatcagttgagtccatgcaggacagacttaacctattctatatagatgtaaagattggtcctatacttagctaaagtataaagtttaggaaattatttcaaaattatgcatggagagcagcaaaggtttgggaaaattttgtaacttctttctgcaaacaaatatggaatatttaggctaaattactctcctaggagaatcaatttttaaaaagtttaacttttaaaacttagttcatttgaaaaacagtcagtcaagatgtccacaaataaaagtaaacattttgattgtctactctagggacgggattctagaaaaaccatggaatttttgggaaaggtcatttggctatactagtagagagaaggtcacatctcaaaatgtcattccttccatctattcataaacaaacaggtagtgatcttttggtagagatccataatatctccaataaagtctgggtttttaaatgtgcaccaacttctattttgacaatatcaacataaacttttaaaatataacctatatttctgtcaagttggccttgttgcttgggtcctattttatattgactcacatactttctaatttttttttactttatctccccatgttaaaatcccattcatatttaaggcctaattcaaatgaaaaggaacttccccccaatacttttcattcactgatgagcgctccactttgtaaatatcttgtgcttgacttttacctcttacatgtctctaaatatttgttaacttacagagtaatatcaaatatatgttatgtgtgtatatgtgtatcatctatgctctcagctcttttttattcttttcagatggagtttcgcttttgttgcccaggctggagtgcaatggcgtgatcttggctcactgcaacctccacctcccaggtacaaggattctcctgtctcagtttcccaagtagctcggattacagacatgcgccaccatgccgggcttttttttcttcttcttcttcttttttttttttgtatttagtagagacggggtttcaccatgttagtcaggctggtcatgaactcctgacctcaggtgatcacctgcctcagcctcccaaagtgctgggactgcaggtgtgcacgacagtgctcagcctgctctcaagctcttggaggaaggaattggtcatataagttttgaacgccttcgataatggtagtttatacggcacatagctgaggcgggtggatcacgaggtcaggagttcgagaccagcctgtccaatatggtgaaacctcatctctactaaaaacacaaaaattagccaggtgtggtggcatatgcctgtctactcagctactcaggaggtgaggcaggagaaccacttgaacctgggaggcagaggctgcagtgaccaagattgggccactgcactccagcctgggtgacatagcgagactctgtctcaaaaaaaaaaaaaaaaaaaaaaaagaaaagaaatatttgaagaagtcagttagtgtcagagatgctgtgctgttccacccagatctcctttcagtactaaaggattccttcctctggctgctgggaagattgtaagcagaaggctctcgatccttttggggaaatgctttggttgaagataccaacaccctttcactgagcaggtcacagccagtgcttgtgacatgggagtatgaaggcacaatgccctcaccatacccagaactactctccacagccaatccagcttcagggttgcttcagggttgcccaaggtcttactgtgactatatcacagcctaatctatagctctcccaattcctactccttcctctcacacactgccaaattggtgttgaccctgagacagcatgtcctgataaatctcctgcattcacatctctatacagagtctgtttcctgggagacctcaatccatggcattcaggaaaaaatgctgcaaactaaaaagcacatttttatgatatgctatttttcaagctttttgaatcacatctgctattggcaatggcatgttgggctttatttgttctttaaaaatatacagatagctatgaatacacttcatcttgaggctctaaatgatcacattttgttgtgactaatattcattaaaaagacaggttaccacagtaatatgatgtaatagcctttaagtactcaccctgctagtcaattattaactaatatctttattagttaaatccatatatggcaactacataaacctctatttcatgtgtttgatttactgcctattttaactacattgtatcctggatcaattgttttttatccaaactttgatcattgcaaaccttagtaagaaaaaggttttctgggattgactttctgtctgctttgcactagaacatatccatgcttaaaaaaaaaaatcacattattcaaattcctgcttttttctagttctatattatatattacatatatttctctagtttgttttagaagttgtgattaagtccttttgcataggttgttacaacagggaactattgattaaattagtataggaaagtaatgaccagctatttgtactctttcactgtgttaccaaatttcagttctgtgctctggtttctttacagctctatttagtcagatataagaaatagtaattgagattttcaaaagacaggattcatgatgatgttagacaattcatatgtggtttagcccatggcctcatgggttatttgaggtcaaaagtgaccaaatattttgtgtctaagtgccaccaaaatgcagacttcaaagaatctgtcatgctgcatatcctgaccctggttctgtgtcagtggtccttgggctgtgagggacactgcatgtgggcctgtgctctgatgacaactgcagggctcacaaggaaaggcttataaaatatgaatagacaacctccactccatccacctgtccctccctttcctctttctatcaataatgcacagctggtgaggagagatcaaatacaactcaaatcagccacttcctcagccaagggttctaagcaaaggtatgtcagaaatgaagaaaatgccaagttcctgacttcgatttgaaaatataaaatataatatttctatataatatgtgttaagttgttttttatttttgtttgtttgtttgttttgagagagtctcgctctgtctccaggctggagtgcagtggcacaatcttggctcactgcaacctccaactccctgattcaagtgattctcctgcctcagcctcctgagggcatgtaccaccacacccagctattttttgtatttttagtggagacagggtctcaccattttggccaggatggtctccatctcctgaactcatgatccacccccctcagcctcccaaagtgctgagattacaggcgtgagccaccgcgcccagcctatgctaggttttaactgtacttttatgatactgtccaggctgagattaagagcaatttcttactgattaaatatattaaaatatattaaaatcatataatagtgaatgtgtatgaatgtaatgcatttcttccaagtagactaagctttagtgtagagtcaaatgaatactcctttaaatgaaatagactcttttatctgtcactttatcctaattcaatttccttgctaaaattaaaaaaaaaaaacattttattgtatctttttatctgagaaattcagtttatcaaaatttacctcattaatattttacataaacctcttaacctagtcagagtatatatttctataactcagcttcagaaggaatgaaatatgataccataaaccctaggatgtagtgatgccccacttgttcgattttccctcaaaaagttgtatgcagagtctgtggtttttgttcgttgtacccctaatgccttaagctcaagtcatatttgttgagtgaataaagactttccaaaggaatagacaggaagaggatatttaaattgtggtgcatttagatctgcattactttttatcctgtgatgttgtggcatctttcccagccacactgacgtaggggattctttccagtctccaggatgctactcttctctgttttctcctttttctgacctatgctttactctgatgttttccatgtcttcttcagacacagtttcttccccatctaaccagtgttactgagtttactacatagttattgagggggttgtgttatataagtctggggattgggaagtggttaagtagcttttaaaaagagtatcagccgactttgggagtatacacactgccaagacttttttttaccctctcagctaggtaggctacagggaaacatcagcttttacttttgctattgtaacaatctataatgagctagagtgaacttaataaagatcttttatttctgtgttcaacaaatatttataaattaacttctaggctttagtcacttttatcctaagtgctgggtatacattgaaaaactatgcacaaagcccttatcctgatggagcttacaactgaatgataggacaagggaaaaatgcacatatatgtattttcccataaatatacataatatttatacagtctgtcctccatatccccaggttctgcatcccaggattcaaccaaatgtggctcaaacatatttttgaaaaacaataaaaaataatacaacaatttaaaacaatacacatttaaaaatatagtttggcaactattacacaacattaggtattgcaagtaatctaaagatgatttaaagtgaacagccatatgtgcataggttatatgcaaatactatgatattttgtacccatataagtgacttgagcactgctggacagagtaatatgtggagcgtaattttttgtaggatgatcatagaatgcactttatgctttaaatgagtggggatacgaattaagtgacagagttagctatagggttatttgaggttaatagtatttcaagagaacacagtgaaagagggagagagttagtagatgaggctaaatcacaaagggccttgaagggccagaagactttgtattttactctgagtgagactagaaatcatttaggggtctaaacaaagaacagatataatctcatttaaattttgaaagcatcactttggttgctgggtggagaatggaatataactgctaaagaaaaatttatttatgttaaaaaaaacgttaaaggcaggaagtccagcacaggaagagtagactcatcaggaaccagcctacttccatctggttccctctttattctccacctcatggtctaagatggttgtctgtgctctagcgattccatccataatctaaccttttctttgaagactttctggaatgtatgaccgttcagcagcacaccactggcgagaattcagttcagtgaccttgcatggttggagggaggctggcaaacacattctttaacctagccatttgtttgcctggtcaaaaagaaaaaaaaagtcaaagattttgaagcagtcctcttactgaacatttagggaagcatcccaaaatagtacaaggaaggaggcatgtaaattgaggaactctatttaaacaactgaagctcaagcccaaggacttacaattgggtcttttgagagtgagcatgtggacaacccattgctcagagtacccaatcctctcccctgccagctcacagttggctgcccaccctactcacccacacacattgtttttgtaaactttgtagcttcgtgcacttcttcacaggagccctctcaaatcacagattaaattatcccactccgtattaccctgtcattaacatctataccccttttttatagaacttaacacaatttgtaattcatgcatgtataattattttattaatgtttatctctcttctaaggctttaaaagacatgagcaggatccatgtcttcttttcccatcattgcattttcagtgctaacacaatgcctgatgcatagctgttgactggaaatatctattgagtaaataaacatcgaggaattcacttagtattgtatagtagaaagcaagacatggggttgaatgtaaaggtcttagtgctgaactctaggagactagaaatttcctggaaacattaaaataaacacatcaaatctattaaatatttttcataatatatgttgctcatgtatgtataatgaccaccataataactcattccctctttataacacttttaaaaaattcaagagtttggaaagctacaatttaaatatcaaaacatgatattatttttcaggcctaaatgatagtttttattctattgggaaatatatggaatgtcttttgaggaaaaacacctgctcacactttcaattttatactattttttggtattatgtttctcaataaacttagataaaaatggtataaatcattaatataacatttttaattctttagaaatttaaaaatctggatgaagaatgttacagaacacatggaactaatttcagaggaaggtcagaaacataaaagcaaattacttggacaaatctgagaactatttttcattaaaaatcgacgtccaaactcatcattatatgcattgttatacacatattttatgggtaaggataatggaaatgcatttggaagctgtcgttgatctccaggaaggactgttgctgctattcaatgaagcagagagtttgtctggcatgtgagacaagctattttttttttttgagtcctgtggaccatgcagatagttgatagcttctcacagccagactgacactttttaggtagaggtttactgtagcatacaagaaacagtgacctgtgatacagccaaatgactgctaaaatggtatgaaaagagatttcaactccctatggcactgctaatgtacctgaaatttttaaagtgcattttagtagttatgaaagtatccagacagagagcactaaagtctggtggtgccctcactttatccacctcaactcccagcacagagaggcatcccctgattgctggtatcacttgtagtggaaactcaaggcatgtgcaagattactttattctcaatttgctcttggccctctctgtttgacctttgcctctctgctgagatttaaagttagtggaattcaggagagagcttttattttgatatacacttctgtagagactgacctagaaatagactgacttattatatgtaagtgatccgatttgcatactgattctctctcactgaaagcttgagccatatttgactagtgagctctaggagatagatttcatagcctacagtcaatacagataatcttctgattttcaggggtacattcttctggcaaagctactataagttaaaatgacattagtcaaattttctgccagaagaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccaggccatcctggctaacatggtgaaaccccgtctctaccaaaactacaacaattagccaggcatggtggtgggcgcctgtagtcccagctactcgggaggctgaggcaggagaatggcgtgaacccaggaggtggagcttgcggtgagccgagatagtgccactgcactacagcttgggcgacagagcaagactccttctcaaaaaaaaaaaaaaaaaaaaaggacactttcactaaggaatggtaatgtatgaatgaataagttgaatgaatgatatatttgtagaatataagactagactgtctaaaggtcatatacataaaagaataatgcattgctaatcatagaaaaatacatataatgtgattttgaacaaaattgttgcttactgaagatgcagtttcatattttgcaatgcttctgagaagctgctgaccttagagaaataactttatctctgtattcataagtatacatttatcagtggggttaatacctgtttcacagattgattttagatgtagaatatcagctaggagttaaataaggactggatttgtatctcagctctgtgaattagtagaagggaacccaggtgatttactaggactttttaagtctgaatgctaatagtccccaatattcattcccttttactcacttttggtaatcatccaccttcccttggagctatgcaaagtcatatgactaaattttggtcaatgggatatgaaaggaaatgatgtagcacgttctcaatctcacccttttaaagcacctctttaccctccactgctctcagatacttccagtgggcttgaatgtagacatagtcatggaaagctggtttcagccatacccttgaaagcaatatctggaggatgacagaaccaacagacagaaagtatctgggtccctgatgattgctcttgtgaaacaaaggtgccttgctaacttgcctgtaactttcagctgccatgtaatagagaaaattctatcttattgaagccactgtacttgtgtgtctgttatggtaacttggcctgtaaccagaaaaccatcactttgagcaaagcactagaccccagatttttactttgataatccataaacatgatgtataatagtaatgatactacttataatgttatttttaagacaaagcatttcatgggaggccaagacaggcagatcacttgaggtcaggagttcaagaccagcctggctaacatgctgaaacccaggctcaactaaaaatacaaaaactagctgggcatggtggtgggtatctgtaattccagctactccggagactgaggcaggagaatcgcttgaacctgggaggtggaatttgcagtgaaccgagaccacaccactgcactccagtctgggcgacagagactatgtataaaaaagaatttcaagccaggcacagtatgcgtgcctttagttccaactactgggagggttgtggcaggagaatcacttgaggccaggatttcaaggctgtagttggctaagattgtgcctgtgaatagccactgcactccaatctcaccaacatagtgagccatcatctcaaaaaaaaaaaaaaaatttaatagtgcctggtacatgatcagcacataagtgttacttatgcttattttgtattcttctaattattattatatctgttatttgtgtacttaaaaaatcataaaattaaatattttcatcctcaataagacatattgagcaatactaaaagaaagttgtgattgaaaataaaatctttatcaatgtcatgaaattattttcttttttaaccacaaaaccctttcaagaaaattactgaaatgagtttttgactttgatattgatgcagatttatgtttttctattgttatatgtgtgttcctgttacatatgagtgttttgcattgcaaattttcaaagaacatatactgtttataattattttttacctttgaaaaaaaattttttacttttcaaagttgccatccaatccgggctggtactttgatctgatctgtgaccttaatgccacatggttgttcttaaacagggtttggaacacctcatttaaaaaacaagtgtggatggcttcccctttactgaaatatgttgtgcaagttccttaacatagcatctgaaagactttttcaatctagcagcaaattagttatagcagtgggcattatcctggtgtattagtttattttcccattgctaataaagacatatcagagactgggtaatttacaaaataaagaggtttattggacttacagttccacatggctggggaggcctcacaatcatggcagaagttggaaagcaaggaggagcaactcacgtcttacaagaatggtggcaggcaaagagagagcttgtggagataaactcccatttttaaaccatcagatctcatgagattcattcactatcacaagaagagtacaggaaagacccgccccataattcaatcacctcccacttcgttcctcctacaacacatgggaattgtgggagttacaattcaagatgagatttgcgtggggacacatacaaaccatattattctgccctgactgctcccaaatctcatgtcctcacatttcaaaaccaattatgccttctgaacagtctcccaaagtcttatttcatcattaactcagaagtccacagtcaacatctcatctgagacaaggcaagccccttctgcctatgagcctgtgaaattcaaagcaagttagttactttctagatacaatggggggtacagacattgggtaaatgcagccattccaaatgggagaaattggccaaaacaaaggggctacaggccctgtgcagtccgaaacccagtggggcaatcctaaagtgccaaaattatctcttttgactccatgtctcacatccaggtcatgctgatgcaaaaaatggattcccatggtcttaggtagctttgcccctgtagctttgcagggcacagcctccctctcacctgctttcatgggccggcgttgagtgtctgtggcttttccaggcacatggtacaagctgttggtggagctaccattttggggtctggagtatggtagccctcttcttccagctgcactaggtggtgccccagtggggactctgtatgggggctccaacctcacatttcccttcctcactgccctagcagaggttctccatgagagcaccatccctgcagcaaacttttgcctggacatccaggcatttccatacatcctctgaaatctaggtggaggttctcaaacctcaagtcttgacttctgtgcacctgcaggctcaacaccacatggaggctgccaaggcttggggcttgcaccctctaaagccacagcccaaggtgtaccttggccccttttagtcacagctggagtgactgggatacagggcaccaagcccctagactgcacatagcacagggacccagggcccagtccacagaatcatttatttctcttaggccttcaggcctgtgatgggaagggctactgtgaaggcctctgacaggccctggagacattttctccattgtcttggagattaacatttggcttctcattacttatgcaaatttctgcagctggcttgaatttctcctcagaaaatgagatttaatttctattgcattgttaggctgcaaattttccaaacttttatcctctgctaatcttataaaactgaatgcttttaacagcactcaagtcacctcttgaatgcttcgttgcttagaaatttcttccacaagatagcctaaatcatctctctcaagttcaaagctccagaaatctctaaggcaggggcaaaatgccaccagtctctttgctaaaacataaagagaatcacctttgttccagttcccaaaaagttcctcatctctatctgagactacctcagcctggatcttattgttcatatcactatcagcatttttgtcaaagccattcaacaagtctctaggaagttccaaacattcccacattttcctttcttcttctgagccctccaaactgttccaacctctgcctgttacccaattccaaagttgcttccatacttttgggtatcttttcagcagtgtcgcactcccagcacaaatttactctagtcatctgttttcatgttgctgataaagacatacccgagactggacaattcataaaataaagaggtttattggacttaacagttccacgtggctggggaggcctcacaatcatggtggaaggtgaaaggcaaggaggggcaattcatgtcttacatgaatggtggcaggcaaagagagaacttgtgcggggaaactcccatttttaaaaccatcagatctcatgagactcattcactatcacgagaaaagcgcgggaaagacccaccaccataattcaatcacctccaaccgggttcctcccacgacacctcggaattgtgggagttacaactcaagataagatttgagtggggacacagacaaaccatatcccctggtctgatttttctcaatgcgttgcacatacaatcgccatttttttcattttcataagaatctttgttatctatgacacttattttaagaaggtgtttcttagaacagtacttctgacagatggctcatgagaactgaaatatatttataaaaaatcatgatgtattgtggattattctccttttttgccaatacctaaggtgtgttaagtattaaagtctctgagcagtccttgagaaacaaaacataatttgctttaacccagtatttccaaacatgttactgaaacacattctttattaatctcagacaactagttgtttggatcccattttgagaaaccttctccaaaatattgcagtcgttagtatcacaagaaatgccattgcccttctctcatcgtcacagacacaattattatactctccctttgatctgtgctgctgtatcactttaccactttattgtgcttgccttactctgttttgtactcatatttctttttcacatgtgactccctatatggttgtgagttcatttaaaatagtaatctgttttcttctttctgttatcctacattttctaatagagtatacggtggggaggtcggagattattttctgtatttcatccctcttttggttggagtgtgaatgtgtaagttttaaaaaataaagcatgttaagacttaatcaaatgagagttgcctttcaaatggtctaagatgttgtttgtctacataattcttcctttgattataagttttatgcaactttattggaatcttcatctagtttcagaggctagaattcccttaattagtttaaacagaaaaatattttctaagtattaaatcactgggtagggttgatgaaacagattccagattgagctgtcaagaacaagtcccaaaatcatatcactgagttaagtaagctacccaagggaggtaatgccttttctgtgatgaaaagccatcggcttgagaaccagttcatagagccaagatcaggatccattcactgtcaggaatcatgtatgctccaaaaaccacaaggatcaggaaaatacgtctactattgctagattcagaactgtattagacttaattcaatcagccatgtctagcccctactggcctccaaaaacgatgatggaacactggaaacctagctaatgctgcagaaaaaaatagaaaaagtattttcttcatggccaggttttcaaatagaaatgaaaacactgcctctgcctcactttagttttccaaatcatctttaattgtatctgattggttgaatttatcatctaaaaccttggcaccagtgagtttaggaaatgtatccttctttctagcctttactatgctgaaaggcacacagaaggaaagtgaaatggatattggagccagaccaaagtttatcagactaactacatatctcaatcttttattcatatgtaatgttctttttcatttacataccttcttacctttctgtgtccctctctacttgatttcctgtgccctactctctttcttcctgcagtttatggcgtttgagtcaatagtgagacttttaccttcccaccttaatgaattgtatacaataagggaggagcagtggcacattcatgaaaacatatgctctgtgttaatattctaatttattcataacgagcatatctaatttattcttctcaatatttccatattgtagatattatcccattttagtaatgacaaaactgagtcactatgaataattacatatcatagctcatgcatcctataaatttgcgaccccatgttctcttcatattactatgtagtcaaagattgcctgcaatttgaaacacactgaactccattttcccacattttgcctggaaaatgaaggttgagaatttatagcacactgtgcaaaaacccatgttactgtttgtcatgggacctgttgtatggtgaatagcacagttttacttatgcatacacatcaattcttacctcactgaaaggtgatgctatagtctctgaacctcagcatctacttcagcttccaattgctttagtctctgaggcttcatattgctggatattttacatgctctgtcaagtcattctagaaaaatcacctactcattagttcagcacaatggaaatttgtattatctgccataggatttcttcatatttttcacttgtattgtctttacttgttaaatatccattagatatgataaaaatctaattaaatggaaagcctgctaatgcagtctatgatattatgaatccattcctgggttcatagtatactaaacatcaatacaatggatataaaactgtggctatttagctacactttaattccctctgaaatgccactctggcatcagttgaaagaaaaatggaagaaatgtgttttgaagctttacattcattttaacagattaggttctagttccctaaaataccaagatttggaaatcatttaactcagttatgtcttttcacttcattgtattttacttacagattctgtgctcataatagagtaactgtaccagaaaagaagcaacaatgataaacagctctataaacaaacataaacttttagtgagatttacacatttgaagatacttctttgctaattaaatgtaaaatatactatgaaagtctttctaccttcttttaaagtccaagatttatatctaatttaatatatcacaaatattaaaatgtataatgttatcaaatattatataaaaaatagttaataccataaatttaactattcccatacagtttaatgaaaaaggtaaaataccttaataatttaatttttgttttatctatctattttaaagaggccacagtcacactatatcccttagcaatcatttgggaataaaagaaaaacaataaaatgtaaagtataatttagagctttttagtaattttgagacatatataatccacaaatgctgctaaagaaattatcctgtcatatttgcacatttagttgtacaagcatgcattaaaaatatatatatttaaaagcccttctacattccatatgcttttaagtgcaaaagacaaatagattgaccaagaaaactacgtttcattacctttttgaatttatacacaagtgatggggagatataataaaagttataaatataactaaataattttagttgcatagtgctataaagaggaaaaacaagacccatgaaaacatgtaagtgatctggatccagcccagccaaggcagaaggtggaagtaagagtataagacctcactttaagctcagagtgaaggataagcaggagttagacaggaaaagtagggacaggggtgaggcatgggataggccatggagggagagcattccaaggaaacaaaaaatctgatgctccacaaaatgtcaacaacccacggccatgggagaagagactggtagttctaaattatatgaaaccttgtaagatatactgaaacttttgaagaaatgcatcagtgtagcttttcttattctatgattgggcatgcattatttgtagagaactggggtatcattgatacagaatgctactgaggtactttacttataatgtttattgagaatgaaattatcccatacatttagattaaacaggaatgaaggaatgaatcaagatattctaatttcttccagaatttttctttcctttttttttttttttttttttttgagacagtgtctcactctgtcacccaggctgaagtgcagtgcagtggtgcagtggtgcaatcatggctcactattttctccacctcccagtctcaagtgatcctcctgcctcagcctcctaaatagctgggactacaggctcacaccaccatgcaaggctaatttgtgtattttttgtagaaatggggttttgtcatgttgcccaggctggtctcaaacctctgggctcaagcaatcctctcaccatggcctcccaccacatgtgatctcttccaaaatttttctaaatactttagtttgatttgatctattcttattttgttatttgaagttaccaagtaactcatttttctaatctgtccattatttagaggtaagtgataactgatttatgttcatcagagtttgtgtggagactgggcttgggaagatccattttgcctgtaagactataaaggattctctttctaaatccctccaagatctttacaatcccactccatttcacattttagtaaaccctgagttatcattagagttagtgttaccttcattttcttcttccaattactcagaatgcataggattcctagggtagcagttcttaaaatttaatgggaagtttgattcagtaccctgggatagagtttgagaaatctgtgttattaaaattacctttcgctcactgttttgcaagacattcgcagatctgcatgttgactgttgactactgtttccttgaaagtaaaacagctgacaaaaacaaaattatcgatgacagaaaaaccatcaagtgcaagtaacttgagtctcagatcagtcatctctaaataagacagtaaattttatgtatcaaccttccaagaggaagtctatgcctagagcagacttgctgatatagcaaactaaaaatgcaaatttcagagtatgctaaaaatttctatttttgttcctgttaatttttcaaaggaattcaagccttttctgtatacatacgggctcaggatactgccatgcaagtcttatttttgcatcccaacattagctggcatacagcttgcagaaaaatacctagactacctggcaagagtctaattttcactttcttgtaacttgcatctttgttactgttaaagtattgaaccagcaaataggtttagtttaattgtcagagtaattattggccttaacacatggcctcctctatcataactgtcatccttcacactgttcatttcttatgtcaaggcccagaaaatgattaatgctcacaacaaaaatgagattcattttttaaagttactaatgtcattgcacatacagttaatgcatacactatgtttaagaaatgagtaattctgcaggtagattgtcatacggaagataattttaaaaaattgacctctgacacactataggaaggccatatgattctgtaaaaattaacagatatgttttgataatctcagattaaaacttttattccttttattttgcctgagggaaaaataactggtatatgtatgagtgtgtgttaatctttcatcgctataaacttttgaaatatgttcagtgccatgtttgatataaatatactttgtaaaataaataacttttgtgaaatattgggtgcttttacaagataccagtatactgatacaggaaaattagtcacagtatgacacactccagggcaaatcttgggtcccatagatatatagtatatagtgagtcgtatttgctcactgctactcaaagaatcttcagtaattattttcctttgacacaaaaataaaataattagaatgggatatatacccagacacacatgacatccacacatacagctacccacacagaagggtcggtgtgagtgtgctccttgtgtagggggagggtatgtgtgtgagggtgtgtgtgctagaagaggattacattattgagttgcataataaaactgttacggtcaattagattattttttgactgttcgtttttaacttttataattaaagatctaccaagaaagtaaatgtgctggaaggaaacattagcatcttgtgttgaaatgttgcctcattcctctgtaaagattgttctctctacttctataggaatacaataaaatgaaggtctgctattttcattttaaagaagatagttaatatattaactaaaagaagttaatatattaagtgaatattgagtggaactcactctagagtatattaatgaaggtagtatatcagtatgcccctgataagaactaaagaaatgctttttctgatccctggagaatttaattatgaaagagagccagggaaaaaaatgatgtgaagtgatctgaaatatgtgaaataattttatcacataattaagaaaatgattgcaatgcatgaaagtttggctcaaacaataacttaaaaaattgaataaatttctcagtgtggaagtaagtcctccgctcatggaagtgcttatgtaaagactagataattcttcatccgagatactagagaagagattcccactttgcctgggagactggtaaaaattaccttgaaatctttttcagttttagagctctgtggttctaagcatgtataagtaggtttctcagtattgtgctgaattaatttctttaacttacctgtgtaaacagaaattttttaaaaatactatatactatgtaatttttctccccttttatgaccttgctgttatagttcagatagtcattatgttttgctttgtgtggtaataacagccccataccagtcaccgtgcctccacgtttttctcatccagtccaaatccacttaaaaattgtatttctccatatgttgctaagggaaataagaaatccttagcaaagtactcaaggatctgatactactacttttctttttagcctcacctcttgatgcatcgcttcttaaacgagatgatctggactgaattgtgttctccccaaaatttatattttgaagtgctaacctcaacgtgactatatttagagatagggccattaaagaagtaatgaaggttaaataaggtcatcgagccatgccctaattcattatgaccaatgtccttataagaagaggaagagatactaggaatgcatgtgcacagaaaaaaaaaaaaaaaagccatgtgaggacacagtgaaagtggccatctgcaagctgaggggaaaggccttgggagaaaccaaccctgccaacaccttgactttggactttcagattccagaactatatgagaaaatacatttctattgtttgagtcacccagtctgtggtattgggtattttgttatggcagccctaggggactaatacagggagtcctacgtttaacccccatgcaaatgtgtagagtaactaatcagtttccttaatggaagagataactaggcatttagggtgccactaggatcacaggtatagaagcccaggatgctgctgaacatcctacaaagcagaggactgccctacatgcttatttcatccacagtacctgcccctcttctcaacatgctcatcccactgaccttatgttcccatctcaatgagaactttttcaacacctcaaagagaaatacttgatcctcatttataccttctccattgtttttttttaaatcgacaattgctctttatgtaatgaattttgaatgatgtttgccttttaatttcttctactggcctgtaaactttttgaaagttttcatgaaatgttaaaccttacatccctcgtattcttcagagcaatttgtatgattttgcctagtatattcctaatgctcctgatctcaattttattttgccccattgataaaaatagagacaactagtaccctctcgtgtacattctgactgataggttcagggacctagaaatgcatatttttgacaacggttttacgacattgtgacaagctggtgggtttaagaagaattttattcaatcttaatatactaaacggtatatatctttggcatgtgtaacagattacttatataagtaaatgtagcatttcacaaattggcaataataattttatggcattatggaactttagagctataacatttcagctaacaggtatgaacattgagcgcagagttaaagtcttacagaactaagaattatggtcagaaaatatttacaggccatttcccatctagtgcttattagtggtatttatgtgaagttatcttcagtatatcatggaaatttaatgctggttcatgccttaaagataatctattataactctttattatataaaagagcttaatcctcagagaattttggtgaattgacaggttaccaagatcctaagaatgacaccctatcacccttatacttggctcctatttattcctaaaaaatcatttcagttcattcactggaaattttcattctatcatatgtatgaaatgtaaggcaatatcaaaaattaaaattatcacctaccctaaatatgcaattgttagagatgcttgagaagaactatagtagcatttctattgaagcaaacaagaattttttactataatttttaagtagtaagtaaatgtgtgtgtgtgtgtgtgtgtgtatgtgtgtgtgtattttaatctgtgtccttaacggaataaagtcaatgttggggattaggttacttttggatgcccctatcacacaatgcaaaccaagtttctggcagaatatattgctttcattactgttcattttcataaaatctttatgtaaataatattttgaatgaaaattgatgaatcttagattttctcattactttctttctaaactaggaagcattcagatgttaataacagcaatttaactaaaagagcttaaagacagatgagtttattctctcgcacaccaaataaagctagaagtgagcattcctaaatttacaaaagcatcaggaagcaggtttctcatattctgctctgatgtccttagttatggcttccatcctaaagatccaagatgaacctgcatgtccaactatggcatccttgttttgaacagaaaataaggaatgggagaagggcaaaaagaacatgtgcaagatatctccccttttataatgagttttccaataagcgccactaataacatatagttatatttcattagcaactaccatcatctggaataaagtcagggctttgttactatgaagaaaatacacattggattgttagccaacagttttctcaatgtatgctttgttattatttttgcttctctttagatgttttcacctttgtttaggggaatatgttcataaagtctagtttggaataattaagatgttttaatctttggtaactacagcatgtgatactaaaaacatttggcatttgcctcaagaaagttaatagagagaaatgaaaaaatatcaacttaattactgagaaaacaaaactaatagagaaggtgatacatagcagcatctttgtgcacaaatcacaacacataatgcataaacttctgttttcctacaggtaaaatcttagacacgcaatttagaaactaataatagagcaaatagtggataaagtcatcagtgtatgacttgtcctattggtcagattactttatttctggagttaacattaatcattatttttgttgttgttgagttgttttgtttttagcaacttaattcagactgttttaaataagaatgtattttagtaattaattcaacatcctgaaatattactttcaaatggacagtgaataattttgtcacatttaaagccagctaaagaaatcttaagattcattctcaaattatttgttttctcaaagttatcttgtctgatgtttagaagttttaacagtcttcatttttattacataacttttggtactataatgagtataatttaaatattttaaatcatttaaacaataaggaagggggatgaaagaggaagtgtttctaatgaggcaaggatccttttatgccttttgtagcacttagtccttaaggtttcaatccttatgaagaaagggtgaatatggacttccttcagataagtaaccctggcaaggtttctgtccatcctctggcctggtaagccctctcttcaaggtaatgagtattctgtgtgtatttctcttcctgcagttagactgttcatgcatgataataaaaagctaaagggattaaaacttgcttatatgccttctgatcttacattataatgtgtccacccatcaaactatttcattaaacattattattttcctaggacattggcaaatgactagtataattacttgtcagggtttttgatcgttttcttttgttttatttttgcttaaacaacaggtacaaaaaattttgccatgggtaatcccagcactttgggaggccaaggcaggtggactgtgaggtcaggagtttgagaccagcttaaccaaaatggtgaaactcggtctctactaaaaatacaaaaattagccgggcatggtggcacgtgccttttagtcccagctacttgggaggctgaggcagaagaatcgcttgaacctgggaggcagaggtttcagtgagctgagatcacaccactgcactccagcctgggtgacagagcaagactccctctcaaaaaaacaaaaacaaaaacataacaaaacaacaacaaaaaaacaaacattgccatggctattaagcaaaacttacctaggctttaattactatgtaatttttactttttcaaatgtgtggatacaaatcattaattgaagttttcaaacttacctatttggaatcagtaactaagataagtttatacacttatttcccatgcaatataaacttaattattttacatttcaaagagattgaaatcttcaaagtgataaaatacgcattaatcttttcaacacattattattaaaatgatagagatggttggaaattccgtgttatgattttttaaatgccaaattagttttctaccttcataattttttgcagtatataagctaactatgtatatatgttatactatttattactgggattttgtttttcaaacttctacttttatcagtaatagaaaggagctattgagggattctaatattctatatattgatcatagtgctgtttacctatatttttacgcgttacaatttcacatatgctacaaggtcattaatcaaaattaatggagctgtacattcgagatatgtacattttacagtatgtgtgttatagctcaataaaattttaaaatatgtattggacatcaatttacagtttattataaaacaaatgatacactgtattgatattgtctgcttatttttctttttatgaatagggactttattgtttttactttcggtatccttaatgcttagtacagtatctggattttaatggaggcttcataagagttttctgactgaaataatgaaaagtacattgaaacagaaaagtcaagtttttcaataccatcaatttacaaatgtatatacgaaaatgcatcatatttagatatggctgttgtcctcaaagggctgacagtaatactgttatttatataaaacaatttttccttatcagtaaaatttcttcaggaatttggggtttattggtactttgagagctctcctaatttgtgctaaaattgtatcattaatataatacttttgctaatgcttatttattatcttagcgttttcagacttttattattgtcaccataattttaaacctacaaaggctttactttgaaggtccattttacaaaatcaagatgattgaaaacacttacctatccatgtgtttctttatattatatacatatgttttcacttaagctgcctgtaaaattcttatctgagaattaaaaataggcttaaccaagtcctttattcatgctatgtatgttagcattaggggaaaccctaaaaattttactcaaagactatactgttcaatcataatttggaagactttaattactaggctttcaaacctgtgattagagagcatgatcctgaggtagatatggaaatgtattaccagtgatgaaaagacatgattgcaaactagagagaagagtgtgcgtaatacatgatgagtgggaaaagataaagatgagaaagttggtgtcctggagggtcgaaggtgagattgctcagggctagggaagtggtttggaggagatttaggtcttcatcttccaacagaagttggattagtactaaaagaggtgacagagggtgaggctacttaaggaaattttatagggaaacttaacaggagaacagaaaatgatacctgttttccaaccttgttagagataaaataactttttctaaggtactttgaaagcaagtttatataaatatttacttttattactcttagtattatcaatgtgttggtaaaatgtccaattgagttaatacattattattaaaattattcatatatcatgattttatgtataaatagcttgagatatgttatgcttataaaattatattcatagctaattctgatcacttaactgaactttcaaatagttctgaagcaagggctatgaagacacaatttggaatagctatgttgtgggttttcaaatgcttcttttatagaattagggttggcttagaaagtattgttttcacccgcaaaaatggcagttttacatgattcagtattacagttagaagtgtagatttgtcaaagtattccaaaatgctagcaaataaaatcagagaatgttgtattgtttccttactagatattgccttttaaaactctgaacataatgacgtaatagaggtcattaaaatccaattagtaaaagtgtctgaattttttatgtgaattaattcaaatattaagaatatcaaatcattgttttctttagatgttttgctctcattttaagtattcacttacttaattttatgtcattagctctaaaacaaatacacaaaaggccagagttggtggcttatacctctaattccagagttttggaggcccaggcaggaggattgcctgaggccaggagttcaggaccagcctaggcaacaaagtgacacccagtctttacaaaaaacaaacaaaaaattagccgagtgccgtactgtgcccttgtagtcctagctactatggaggctgagaagggagggttgctttagcccaggaattttgaggttacagtgagttatgatcatgctactgcactctagcctgggtgacagagtgaaacactctctctaattaaaaaaaaagtctataacttcaactttgcttcctcctattttaaaacttcttaagacgttttggtaattgggaaaaatttttatttttgcttgccactaaatcaatgtttttcctttcatatgttcttaatattaacaaacttatctgaattttacccttgggaatgatttttatctggtgtgcttttgtttttatgatgatatcaaatttatacattaatatcacctataaacaagctgattttaattatgtagatttggataagagcatgtttcaaagatactgctctttttatcatctttacttctatatcatgtaaatatatagtctcaaaaaatttaaaacatatttccaacctcatatgaaatttcaacgtggcaaaacattttttaatgcatgtccatttttattattttaacaaagactggagcttttgaaacattcccttaacaaaaacttcactgagaatgattgttaaaattatgtcaatgactacctgttcatccacataattttataaattatacaatttgtgaaagttataatttaatatattttatctaatatgcattgtatttcatccagtcaggcaagtgaaattcatgagtatatacttttactcttaaagattctggtaaaattaaatattatataaaattctgaggttaaaaattaaatttttgaagtgatatctgtatcatatttatcagaaaatatgaaatgataaaatgtgaaatgtttgaaatataagaaagtcaatactttagtgtttgctgacagtcttatagtacttagaaaataagtttttatatatttgggcatttttaggttatgtctatatttcttttcaagctatcattgatccaaatacagtgaaaaatagcaaaccaggtgccaaatatgatccatgtgaaagtaattttctcatggagaagtatttttctgtcttcaagcgtggcagtaaagattttgatccagtggtctgagctgtgtcatcttttctttaggtagtttaaagtcatttgctttgttatgggtatgaattatgtggtattaagtactgcagtagcactattaaacattatatcataaatccttttagaatgtggaaaagttagtgtctgaaaggccatttaaaattttccactttaattccaagctaggggcagttttgtgttccttttttttttttttttttaacaactgacataatccactaaaaatgataagtctcttagtaccactcatgcatttccagacaaaatccaaacattatatagattgttttaaaatacagattgagattgttttaaatttgtagacaaacggatgaagctatttctataaaactgaagtagcaatattaattaccatcaacagccacaatattaaaatattctgcaattccttgaatctataagtggcagaaatacttcattatgaagtagtttgtttacattaattcttcagctctctagcttttaattttttaaataaatatatattaaatattgttttctttcattaaaactgcaacttagttttttccaagatacgtttttgagaaatgaggagaaaaaaaatataagaaattaacttttttaagttctaagtcagtattctaaccaaaaatacaattttctactttgagtgctatctttaaaaacaggctatatttaaaggcaaccctggaagaattaatcttgattgttcctgtatttctttgattagttaaagaaactaagtcacaaaagagatattcctagtgttttgtcattttcagtatgtgtgtagttaagctttttaaattcctattttacttttgatataatcctcttagtgaattttttctgggaaaacatgctgtcaaacacacaaagtaaaagaaagacaagaaacagtagttaacaaagatttttgaatacttttgtgtattttagctttaaaaaaaactttttttaaaactataaattgtaaattgacatttcaatacctgatcatggaagcgtttcttgttttgaaaatgacagggttggaacatatgatttaagtttaacattagagatgtcagagctagcaatgcattaacacaatttctaagatctttagctaaacaaaggcacaagtgttcatggaaatgagttaggtacctctagaatctaaaaagttaaaaagaaaacaactgtatgtatgtcacatgaatctgttgtcctgaactttattcctgtgtcttgaattcatgcttttcttttaaccttgcctaaaacttcttgtattttatctaagtatctgttggcttcctgtctctaacatgccttccctctgtaatccagttattaaggaaatgttggacatggaccctagtttaaatataaataaaaataaattttacagttcctttttggggtttgataactttagtcaagaagaatttactgaccaatatttatcgtgatatctgctttgaaaatgagagagtttgaataatatttcattctaatagttttacatgtttattttacatcactatcttaaggcttttttaaactctatattttaactctatattctttttagcccctagatatgtgctgtcaccattacaaggactcagggacacataaatgattgggaagaaagaaagaaagaatattcaattcaaacactgaggacccttcccccttgcaaatgggcaagatgcaatgataatagggcatcaaaatataaatgtgaatataaaggtagattttagggtgctggcaatgttaaaatacattatttaggggttttaattggcaaaacaaaaagaaaagctgtcatttgatgatgctgtattcattattacttactctgaagaggcagaatattctcatgtatttttagacttaaaacagaccacagttgaacaatcctggtgaggggagagggaggaagttcccatctttcataccaaatttaaccgaaagctcaattaaatagattttaatcagacagctaattaaaagattacaaatgcagacctttgaaaataaggacagaagtgtcattgaaatgaatagcaacatgtgacaagatgaaatacctacagaagagttggtgcttctgagcagcacctttcctaaaagtcaatatatgtttgggtgatttctggtgttttgcttttacaaacacaactgctattatcaatactgcatctgaataacggtttctctagagaacataccaaatagtgtagtccatttatttatttagaatacatgtgttgagcccttactctgtggatagtgttctaagttactttgataaacataaaagacaaagatcccagacacatcaagtatatattctaactgatagaatcagatgacccaaaacaaacataaaaaggtgtaattacattttacaagactataaatgttatgggattttaaaataatagtgagcaggtgtaaggagtcctaggggttccaggaatgaaaaagaggtgaggaattttaaatgaggaggctcgtgtaggcttcatggagatggttacattttagaaaaaagaggaggtagggaattatccatataaatatttgaaggaagacaagttcaggaggggacagctggtgaaaagccctaaggcaggagcatgactggtgtgtgaaaacagcaaagactgcagcagagtgatatgatgtggaggtaaccttaaatgatggcatcacttaaggttttatagttaactgtaagtgttttagatttttctctgagtgaaatgggaagccattacaggatgttgcccagagaggtacataattattacattctagaagagtccttctggctatttcatagaacaaatgaagaaagcaaagttaaaagttaagaaaatgattgagaggtgttaccattatcctgataagagatggtgctgcctcctacggtgatagaagaccgatgacatgtggttggattctgactatcttttgaagtgagtgtcatcaggattgtctgaccgcttgatatgcagtgtgttagagagaagagtgaaggataacctcgtggcttttaggctgtataaatggaacatacatggggagggttgcaaggatatgtttccaaagcaatgtaagagttaaatatatataattaaacattccaagagggtgatctaggcctaatataattgtggatatatagatggaatttcaaaccatgagcttggataagattatcaagagtgtgaacattgatggagaagaggggagaggcgaggacatttctctggggtattctagcattaagtctggggaaataggaagatgtagcaaaggaggctgaaaagaagtaaccaatgagttactgggaaaactaaacctctcagactaaaggttgagagtcaacaatcagaatcagaaatgaggaaattattgttgaccttagcaagagcaggtgttatagagtaatgaagacaaagtcccaactgaagtggttttgatagagaattgaaagaaatgggaaaggggaatatagctaactcttctttcaaggagctttgctgctaaagaaagtaaggagtgaaatggttgaattataagatgcacatgtgttcatccttaaaagagaacatgcaagaattttttattcaaatgtttttcagtggttcacattctttttagaaatatgaaagcattctcatggatccacatcctcatcaatacttagtattatttatcttctaaattctaatcttgggtgtaacaattatataaaattatgatcttaatttttattttcctgactacaaatcagattgaacactttttcatatgtttattggacattattatctatcttaagatattgattttaaatatgtatatctatcttgaaatatctattttgaaatgtagcaggttttttctcttgagatgtatttttatctgatatttttagtattttttgtatgttttataataaactttttgacaattatatgttgcaagtaactttccaggttattggattctctttgatttattcttggatgaggaacagaattcttcttcctataacacattctttgaccattcttaatttaaagcatattttaataaatagtcacagtttttcttttaatttaaaaatatttgtattatttacttaaaagataattttgtcagatatacaattctggatttgtggttattttctattagcatttagaagatattatttcagtgtctttcagtttctgttgcttgagaaaccttgagaaacctagttttagactaattgtatgtcttttgtaagtgatctgtctgtcacaccctttccctcacacttgctcttcaaatctacactttatctttgctgttttgtagctgcactataatgtggctgagaattgttgatttttattcatgttgatttacatacataaggctttgatatcactgttttcaggactccattagttgtgggaattgctaagtgattatctagtcaaatataacctgacttttattctttccctttgggatttcagttggacacacgttagattatcttactctgtttgccatgtcttttatcctctctcacaaatttcattgacttgcctgtctcttatgcctttgaccaatcttccaattaactctctcctctttcggatctattgtactgtttacagtacaatatccattaacatttctgtgtttgttatttctaaaatgtgtatttgacttttagtatgttatctgttatttataatttcttgctatatatctttgatactttaaaatttcaatctatttaaacgtatttattttattttctgctatggataagtacaatatttgatgtccttacagttttaaatatttagttgttggtatttctctgctggttatcacacacgtccactgatttctttatatattttcagttttatactgtgtgctcatatttgttagaagtcaatatgagggaatgccaacagtctaattaggaattgttttgttcaaagatatgtgtttccttctgctggaagccagggaaagctgccagtctgagacaattacagagttcctgttcagtgcaaaagactcagatgggactcctcaatttctggtgggacccaggcataatctccagattttctatgttatttttagcatctgcactagagtaacctagctttagtacttgcttaatgtatgtatatatgtatgtgcgtatgcgtgtatacatatataagtatatatagttatacatataagtatatacacatctaaatatgtatgtgtacatagatacttatttatacaaatatatgtatatatttttttacaaacctatctgtctacttagatttggattccatcacctctaaatataagctctgtaaccttaggtcattttttaaaactttttcctaacctttctttcttttacaaatctcatatttctcaataaatggcaactaacattgttaatatacttatgttccttcaacattagaaaaaaatgtgtctttatttattatcatattttttggacaaggtcttattctgttgcccagtctggaaagcagtggtggattcacagctcactgcaggctgaatttcctgggttcaagtgattctctcacctcacctgtccaagtagttgggactacagacatgcaccaccacgcccagctaattttgtttattttttgtagagatagcagtctcactatattgcccaggctggtctcaaactcctagattcaagcgattctcccaactcagcctctcaaaatgttgggataacatgcatgagctactgtgcccagctttttaagaaaaaaaaaaaaaaaaagtgtttttaaaataacctttctcctcctaaatcctatgtggccagtaaatgtatctttcataaatattttaagttgggaatttgtcactttttgttgtgttttgttttcttcttggaagcattagagtgaaggggcaagcaccggggcacaggagccagactgctgagttttaatcccatttccactacgtaagccttatgttaccttcggcaagtttattttaatctctatgcttttgtttatttgtacaacagaagaaataatagtttctcctttatgtgcttcttgtgagaatgaatatttgttactatattgaaattgcttagtttaatgctgattctcggtaaatatttactatgattatcagaacaaaaaaaaattatatcccaaattgccagaaattgttccagcttactaatgaaataccaaaaatgagaaagagaatgacttttttttccttcttaattagtggtaagtttatggactgtggagtctgtctcaagaggtttagattcagccttattacttcccgccagtatcacattaacaaacaactcaagttgtcaaatcctcagatttcctacctacagaataaggaaagtaggaataccttcctcttagggctgatgtgataacttaaaaaaatcactaatgtaaaacatctgagtacacaatctgcacataaaaataaatgtcagatataatttttatgattagttttacttaagaattgtcatctaaatttcacatgctatcaaattatatgctttaaataaagaattatacagtgctaacttccatgtgtgctttcctaacctgttaggaagctgtagaaaacagaataatcagtttcaaaaaagcatgacagtaatatgaatgaaaatataataaggaaagttaatattaaactagtgctatggtgtctgttgtttcatgattataatgaaattgctaaaccatcactgaattgtgtgaggagtttccaggtgagatatgcaatcaataccctgagacagcagtaaccctttctttaggcagaactttataagcagtgttagttccatgattttacccaaacaagacatcacaatacaaactcgaattggaagaactctccttggccagatatctaaatttaacaggaatttaagaggttctttagtgtagggcctcatgcagcatgtgttgaaaatagtgctgaaaacaagaaatatgtaatatatggatatacttaaataaactccaggctgtcttgtttccataacattggttattttctgccaatagttttgtcctcagtgagccgtggccatgacatggaatctgtccaagacacttggtgaccaagagcctctttctagtaggagtctgagctgaaaatagcttcctgaattttttcagcatcatgcatttactgtgcagctttaagctcttccctgaacacattattgtttaattacttactgtccaatattatattatgccagttatgtaaggactccagtggacctcaagcatggtaataaaatcactcataaggtcacgtgaagttcagagttgttagggaggtacgttgcagttagcttttgcctcttcccacagtaatgttcattaatacctcgtgtgagacactgttttccttgtgtagttcagaatgctactttacttcctgacccctggaaaccaggaaatgattttattagcaggcaagagaacacacacacacacacacacacacacacacacacacacacacacacactgtcactctctctctccctttctctcttagcttttgtcccccaaagttgaataacataatttttgggaagaggaagaatccttggcactgaattgtagacccatatggttcttggagatatggtctaaaaatgtaattgtttgaaaactttagtgaaaacaaagtttgtgatactatagatttatagagcatagagaaatagaaattttccacatatttgctatgtctcccacttctgcataatgaggttgaaaaaagttactatattttaatttttttgagtgggagtactaaactaattgagtattcataatgccagtctacgatctgtaaagttaaaaaatatttttgaaatatttaattccaggaccagcgactcataatatccattttttttttttttttgtcattttgcactttcttaaagcttctggacataaataacttgttggtaaatctagtatcttggctttccctttgtcctcctacattaccttcttagatattccagaatcataacattttgcgtaaagagagtaattaagattttttatattttaaagaaaagaaatttgtttctgtgttcatttatgcaccagttccatataccaggtcagtggcagagctgagcagtaagacagttttctccgttttgaatcttggacgttttctgcctttgtatcctgtactacactgcttgtcactttcacatcctatggttgtgtcttgtttgattattttgcctagaatgttcatttttttgcctaatttttatgccaaaggaagtctcccttccttaaatattccaatggatttgctcaactggttaatatactcaatagcaaaaataggtacttcagtaacagttgaagtgtttgggactttctgagggtggagggtcggaacagggagaagatcaggaaaaataactaatgggtactaggcttaacacctgggagatgaaataatttgtaccacaaacccccatgacacaagtttacctatgtaacaaatctgcacttttacccctgaacataaaataaaaattaaaaaaaaaaagaaaatagttgaagtaggaatgaatgtctgtagggccaatcaggcttacttactttgaatatgttatgcatttaatttattttagaattattaatgaaaataagccttctgttagtagaatatgtgttttgggagtatttgagctgaaagttggctctctactttctcttgggcatgctctaccactttctcagacctttcatacttttcaatagtgaaaatctgctacatgaaaggacagaacacaaacaaaacccattagctcaagtcttcattaaaatgttgcagacaaggtaagaacagctttaaattgagtgttcttgaagacagcaaagaatttaaagcttttataaggcagaatggagcaggtacattgacattcaattggttactgcacaaatttttagaaggtagggaattagtcacacattagagtgtaggggcagcaagactggaatgccgattagtggccattgtttggaaaattgggatttagcaagaggagtaaaaagtaacataagagacaacattattgcaaataagtgtaaatcttttctttattttatttttttgagtcagagttcttactatcagccaggctacaatccagtggcacatgtaagctcactgtagcctccaactcctgggctcaagtgatcctcccaaactggtgagattacaggcatgagccaccacaaaaactttactttaaaatgaaacataggcaactcatattgcaattggccactggccactctcttctgcctgcaaatttataacaccctatcaccctgccatatatatatgtgtgtatatacatatatacatgtatatagtttatacattatctcttagttattaaaagaaaaattgtatggcaaaataccaaaacaagattctcttccatgtgtgactagcttgcagattcacacagaagccatggtttctcacttaaaatcatttcataaattgatatgtttatcctcattgataaatagtgaaactaattgactccaaaaactgccgaatatttgcaattgaaacattttatcctcaaagtaaacagacgtttgtcctagaagtaacctggtgagtgaaaaaagaaaagtaaaaagaaggaatagagatatccaaattctgatattctaatacagttgactcttgaacaacataaggtctaggggcactgacaccttgtgcagttgaaaatccatgtataaattttgactacacaaaaacttaactatcaaccggctactgttgaccagaagccttactgataacacagagtcatttaataaataattgttttatatatatatatatatatatatatatatatacacacacacacacacacacatatcctgtatacttacaataaagtaacctggagaaaagagaacattattaagaaaatcataaggaagagaaaatatattcactattaattaagtggtagtgaatcattattaaagtcttcattctcatcatcttcacattgaaaaggcagaagaggggcaagatcaggaggactttgtctggctgttttagggtggcagagcagaacaggtggaggaggtggaaggggaggcaggagagtgatatgatttgtctgcaaccccattcaaatctcaactcgaattatatctcccagaattcccatgtgctgtaggagggacccagtgggaggtaaattaatcaggtgggctggtctttcctgtgctattctagtgatattgaatacgtctcaagagatctgatgggtttatcaggggtttctgcttttgcttcttcctcattttctgttgccaccaccatgtaagaagtgcctttcacctccagccatgattctgaggcctccccagccatgtgaaactgtaaatccaattaaacctccttttcttcccagtctcacgtatgtctttatcagtagcctgaaaatggactaatggagagaggcaggcacattcagtgtaactttacagaaatatatcataatttttgcctgacttgttttgctttttcacttctctaaaaatgtgtctataccataccaatccttcttacaccatgtgctttactttcagtgtcctattcctagaagtatccatgtcacaaaataagtcaaaaatagtcttgaataattggaaccttctgtcagattgtctattgttaatttgatttctggcactgcttcttctgcatctttttcctcattgtctggaacgggttcaaaagcactcatctccatcaagttgttttctgttaatttatctgatgtggtgtctattagctcttcaattcctccaagatccctatgttgaaacccttcacctccctccttttttatttatatatttttgccacatccacagtttctttcatgatttccttgattggttctgttgtaaatcctgtgaagttatgcacaacatctggacagtttctttagtaggaatttactgttttagactggatggaattatggatttttttataatgatatcatccttaatactgtaatcattcccgacttccatgatgttctctctattaggattctcttccatagcactgacaatattttccgtagaatactgcatgcaatgagtcttaaaggtctttatgacccttgatctagaggctgaactagagatactgtgtctgggggcaagtagaccacttcaacaccttaagtattgaaatcttggggttctgggtggcctgggacattgtccaatatcaaaagaactttataaggcagtcccttactagaaaggtacttcctgattcagggacaatcaatggaaccagtatagaaaaagaattgtcattgtcccagccttcttgtacaaccgaaagactgacagctcgtgttcatctttgccttcaaggcttggggattagtagctttataggtagggcaatcctgatcataaacccaactttatttgtacataacagtagagttagcctattactggagcttgcttctcttccttactaataaatgttctttttcagaatatatatatatttttcagagtagggcacttttgtctgcattaaaaatatgttcaggcagatatcttttcttcttactgattttcctaatggcatctgggaacttgtttgctgcctcttggttggcagatgctgcttctcctgatatcattctgtacatcaaacctttataaaattatcaaaccatcctttgctgggattaaattctagaactttagacttttccccttcctcgtcagataatgacttcacttgttctcaaatcatgttagagtctataggtaggctcttttctagcaattctgcacccatgtaaaagctatatttttcatacaagataaaaagatatttttcaaaaagtggaaggtattttgcacttgcttgcacagttacagggacagcttcattaattttcatttctttttttacattgatccttaatgatagattcatttatcttgatatggaagacaaccacagctccaggcctccgtttatagtggatatcaagtagttcaactttttcttgtaatatcttgacttttatctgcttcttgggaacacttctagcatcactagtggcacttcatatgggtccccttgttttatccaaggtttatggtattgcattcaacataataaacaacatgcaagaaccatgagggatcacttttactatcatgcatattttactagagagatgaactgttcatgtagaaacaatgatcatcacatggcattttaagcacatgctcataagacttgagctcattgcaatagcaatgggagttgcctatgaaattgtgatactagcacattatgcagtatagtgaagattatacattgtggtttaatactagatctttacatttgtttacatttctttggactgcaaatagcaccatgtgctaaatgtatgcacatgttttgcatatatttttaagttaacgtaaaagttttaactctttcaatagatttgcatacacttttaagttaaaaattttaactttttcaatatatttttgtatattttatgatagtgaatgatgaaaaaaagtatctttatattttatgcatttatgacatatctaactttttctttttttgctatttctatgctacatggttcatctgcaaatttttttcaaattgtcacaaatctacaaaatatttttcaatgtatttattgaaaaaactctgtgcacagactggacctatgcaattgaaacccatgttgttcaagggccaactatacccaaatgtacaaatgcaaaactacactaatcacctacacttacattctaaagtaacaatcaaatgtaatacagcaatttaggttgaaagtacaatacttgataaagtttttactgccttaaaaattgttattttaatggagcagtcagcctgcttccttgaatttacttttttaaggtcctgaatcaaacaaagataacatagtttgaaaattttttaaatgtttctttaaaaaagggggggttaagtatcattgtttttaatattttcattcagtaaaacttatttgaaatgctattttctatattttaagaagcggatatttcaacccacctattttgatttcagacacgttaacatgtatatgtgaaaataagtcatattttgtaagaccttgcctaatatctaataactgtattttaattttatgcagcattcagcaacaattgtacctgatgagctattaaaagtgtgtaaatcaaataagcttatatcaagaatactaaaaaaagtgacaaggcaaacatgtcaacatagctaaatatggctctaggattgaatgctgttggtgttagtcagtcaggatttccccttgtgatgtctttctggtattaccattattgaatgtttacaaattaaagggaccactgctaaaaatatgggattgagttgcatatgcatgccccttaagagacccttagagatgatttacaagaatgacagaatctaactttggacatttggttagttttcacacctccttccctcttaaaacttgcattcattaggagtaactctctgaagaatctctgtcttaataaattcagatccatcaactactttatgcagtgttgcagtactcactgtttatttgttaataagtacctgaaattactttcccactcaatagatacaggactgcaaagtagatgttctcctcttttgtactttttttataattagggtacagagttaccaagtcagcaaggaaggggcactttgtatgctacttgcatggctacgaattaactgaaatagcagttaaaatgttcattttaaaaattatgtaagtgtattgggttcctaaggctactataacaaatgcacactggatagcttaaaccaatggtccccagcctttttgacaccagggatacgattggtggaagacaatttttccatgggggctgggtagatggtttcagtgtgattcaagtgcattacatttattgtgcactttatttccattattattacatactcaccataatgtagaatcactgggagcccagagcttgttttcctgaaaccagacagtcccagatgggctgtgatgggagacagtgacagatcacccggcattagattctcagattctcataatgaaggcgcaacctagatccttctcatgcacagtttgcaataaggtcggtgctcctgtgataacctaatgctgctgctgatctgatgggaagtggagcccaggcgataatactggccactcacctcctgctgtggggccctgttcctaacaggccacagactaataccagtccatgaccctggggacccctggcttaaacaatagaaatttatttctcgctgttttagtggctggaagtccaagatcaagatgtcagcactttgggattcttctgaggcctttctttttggcttgcaggtagcctccttgtcactgtgtcctcacatcatcttttttcttcgtgtgcacatccctagcatctcttttttatacatttcctcttcttagaagaacaccaatcagattgttttggggcctaccctaacagctgtcatccatttaaacttaatcacctctttaaaggggttacaaatacaaatacaaaacagatacagcataaagtcacattctaaagtactggaggttagggcttccacatgtgcattttaggggttcacaatcctgcccataacagtaagtatcgttttctcaaggaaaattatttttgatagactaggtcaagttattctctactcagcataattataattaaacaattttaagcttagctttttaatgcctagggatgcttaaacaatcatattcactctgttcctatttcctttcatatgcttgctcatagtaaggactcagtaaatatttgttgaatgagtaaattacaattcctataattaatataattctcatttgcactacgtcagttctttttcatatgctatattatttgctcttcaaacaagactctgattaggtaatctcattacccctttttatatattaataaagaaaaataatcagcaatttatttaacgtgagtcagttaaggatatcagtggaatactatattttttctaaaacaggacttcacccttctgaagttagactaactgggaagatggcatagcaaaggaaatgtcagtaacaaagacaacaacaaaaatcacataaaacagattaacaaaagagaaaggaaggaaggaaagaaaaaaaagaaataaactcagcaaagcaactcgaagaggtagccttgggataagaaataaaaatattgaactaagaattagttaagaaggaatcaaggttgtagattgacacaacatgctaacataatagagtaagcaaataggaaataaaatagcacatatatcaatatggaaggcatatcaattgaaggagaggtaaccacagtcacatatacatggttcagaataacaaaataatgtgtttacattactgctgtttacagccagttggaactggcatcatattcacttttgatacttgtgggcattcagaaacaaagtgtaaagcataataggacgatcttcaacttcagtatggtacaggggagaaaaaaaattctagagagtcatgaagcccgatcatctgattctggtattttaggctgtcaggactcaagacattatgcctaggccactcttggacagatttagacccaaaaatgttttccatataataagatgacagttgaaagtcccaggctaaaatcttaaaacacagaacagtgatttcaatctgaatactggtcccactttttattaacccctgtcttgctcagttacttaagctctcttaagcctccgttttttcatccggaaacataatgataaacacggtgattacattaaaggattgttgagttagttgaaatatgcaatgcatatataatgtgtcacatagcacctggctcattgagtattgttgcaatgcaatgataaaaacattaagcacttttcttagaatacattattacatgaaatgtgtctttaagaaattcttttagttctctgagaagagcccctgagaaaggcagacaacacactacgggctcttccagctgttagaagttcctcccaaggaatcatctctttgccaatcatttatcttgtggataacttctgtgtagtgtgtcttgtcttaaaagtttaacatatgttcacaatattatgctaagtttatggcatattaatcatatggatgaaattttgttattttttatgcaagtaatttatttctacaaaaacctctgagcaaaaaccctttacgcttctctcttcaattcttaaaattccacccccattaaggtaaacattgtaaacactgcagagtgtaccttttcttgctttaatagttgcatataagtattcaaaacctgtattatagcatatagatttctttgttttatttaataatacatattattctgttcttcaaattgattacttcacttaagctacataacttggtcatctttacatgcgaatacttatttataaaatatttttgtaatataagcatatatataagcaaaagtaatataagcatatggtaaatttagtgtaataatacatataggctaacacaaacagtgcaatgcttaaatagatgccaagtacttttctggtgccttacatttattaactcataatactcataacaaacccaaaagttggactttttcttatccttattttatagataaagaaactgaggagaaaggaagttaaatcgctattcctctgtcacacaggtagtatgtagcatagccaagattcatacctgggcaatccatctctggtggccatgaccacacaggtatacaatgaaataccacattgttttttttaaaaaaaacttcataatatactatcggatgatttttaaattttattaattcttatgctgttaattatgccaatgttttcattataattttggttttacttgtctatcctaagttgtactttttaaaatacatatacaatattttttagagaagttttaggctcatagcaacattgactagaaggcacagagattttccataaagcccccgtccctacatacactcacagccttctccattatcaacatcatacacaagaatggtgcatttgttaaaattgatgtacttacattgacacattattatcacacaattccatagtttacattagggttcactcatggttttatacattctagtggctttcacaaaggtatataatgacatatatccaccattatagtgttatacgaaattgtttcactgccctaaaaattctctgtgctttgtgtatttatcactgcctccacccagccctttgctagttgtactttttgcattaaaatctactctatctagtatatatcataatcattgttgctgcaagagaatccaatgatgttgttttcacacagccattgaaccaattccagttattatacaagtaattctgtttctactgcgttacaaagctaaagtttgcttttcatacaataaggtgccagtatatatttggatctatttgtgggctccctattgtgtttcccagctctctattattttattcttctgagcatgtcatactgtttggttatagcagctttatagtaagttttcaaatcaagtaggaagatgcctccacgatatgttgctgattgtgttattaccaggcctcttcattccaatgggaggaggttagggatagagccttagaataagtctgaaccactaggaatggtatcactgctgcatttttctattttattaatatgtagaaccatatgtgaatcccaaagaaagttcatatgagaaaacccaagattgccctcacagatctaagagataggatagaactatttattgctggcttcctgttttgaagacaatatttgttgtctaggtaatatcaggatattttttggagactttgtttttctctctcgagggatgttcacaatcttttggtgctaatttcctcttaatatagtgctatttttttccatacaaaatttgaagtagaagaaaaaaaataaagaattggtagccattaaccaaagctggcattctatttccattttcacagtgagactaccattttaaggaattcaatatccctttgtgatcacaaaagtaaggtgtaattcaggagttttcctggagtccccattagatattatacaatgcatattttgtttcaatatcatggagttttaacacaaatgtaaatagaagtttaattatttatatagattcaatgttaaatataacaaagacgggaaagaaaatatattattttgatgtcatttttgttttaacttttcctaactgtggatactcttcctaataataggtagcccatatgtcattataaaaaaatgtatttctagaaattcaggtaccccatcaaccaatctttgtatctcctcatataataactttttctgtgtgtttatagaattttaagttcagtgaaaagattttcagagcattttatttttgcttctatctggagcccactcacatgtgtttatcttcttgtttttaagggggaccccaggcatgaaagtaattgcttttattgcattgaatgctaaaaggtatacagccatacattctttttgtatttgtttcttagagctgctgtaacagagttccacaaactgggtggcttcaaatgacaatgagactttattctctctcagttctggaggcaagaagtctgaaatcaggatgtcagtagagtcatgctctctccaaaggctctagggatggattcttctgtgccatctaccttctggtagcccctagcatttcttggcttgtggcagcatcacttcagtctgggcttcacagaggcagagattggagtgatgctgccacaagccagacttccttctgtgtctgtgtcattacatcgtattctttttgtgtgtatctgcatccaaatttcattcttcatataaggacaccagtaacaacagattaaggcccaccctaacgactttaccttaacttgatgtcttccaagatcttctttgcaaataaggtcatatcattttttagtagacaaataatcttactatgttattaaagtaattaaatcatatggaaaaatattctatttaattattgtattttacaaaacatttcaaaggatggatataattcagagataaccattaatattttttgcataggcacaaaatagttctagttttaaggattacaattataatagatatgaatactggcaatttatgagctgaatgtcatttatatcatatgtcaggagaaaaattctgtagaagatattgtctagtttggttataagtaaaaaaaatggttaaattattaggtgagtttatgtacagatatatactcagtctaacaataacagcaaaacttagtatgtgcattttaataaactatttttcttttgagtaagaaattgttttcttgattagtattctcctgtaagactgctttaattctgtattctctagatataaatgagaattgggaaacagaactaaaaagtagcaagtatcgtataacttaattaattcaccaagattgctttgtgagtttgcaaatgcaactgcaagtgggaagtaaagtatttctagtttattcataagtgtcctagttgaagtctttttgtaaataggctggagcctaaatttaataacctaatttaataacaattttgtctttattgttactaggtcagcagttagcatttaagatgaaaaattgatgggaatgataacttacattatccaactttatgtggttatttgttattgcctaaactccattgctaatacttatactggctaatatttcttctgatttttattatgggccaaagctatcctaagctttgcaagtattaactaatttatgctcaaaacaagtctagcagataggtaactattattatctcattttctacatgatgaaactaagaaacagattaaatttgcttatgtttatccttctaataactactgcagtgcagctttttacaacgatatcgttatttctcttttaccaaatttctgtgtgatttttttgatacttttctctctctctctctgtgcttcaactacctcatttatacagttattttaataacataaataaaataaatggattaaattgggatttcttattgttcccaacaccaaaattctctttttggtgttaatagaaattactataaaaagagaattgtggtcaaatacatttgggaaatacaacatccttcttttgaggacacatcagcattgggtctgagaatttatgtagcaaaagcatttctttcatttgaggtactttttacaaatgtatatgatcagcgatttttatgaaagaaatgccaactaataaaatgtattttggagacatcgtttgggaaattctgaatttagatcctctaaagttctcttgatctctaaaaatcctattatacggtgtttaaaggaagatgatttgcttggtgcagtggctcacgcttgtaatcccagcactttgggaggcccaggcagcagaatcactttagccaagaagttgaaggcagtgagctatgacattgacattgcactctccagcctgagtgataaagtgaaactctctcttaaaagaaagaaaaaaaagtaatttcctctttttgacacttctcatagtttctctatatgttattttttttgagctctttttccaagagttcagattatctctttgatttccctttcaactctgcaaatcgtatttactgttttttctccctactatcaccttcctggcactacacaatcatattttgtattgatcttttctctcatcattatgttcaaatatatacaaattcccaaaattctaaattatctgaaacaatatttctctcaaacatcatttattcttggcccttttatatgtactgtgatttaagggttatattgcatctttgctataaactatgtcaaatctattagaaaataggctatcgacacacacacacacacacacacacacacacacacacacacacacacggatatctaaataaatcacattttcgttaccttaagagattccattcactccttaggataccgaaagaaggacttagaaaactatctcttacacaaagaatttttaaaaatacactggagacttgtggttatattgttcttgttatctatattaaaagattgtataaatgcaataggcttattttcatctgttgttccaaaactgacataggtgttcttcctccattataccttctgctgacccctttcctagtatgtatttttttaagaaaataagccttctttttatatttctgtctccactattacaatatatattttcttttataccaagtaatgtatcttatttgaaatttatgttctgtgctaagtatgataattaggacctaagatatataagagcctgacatatattgtacataccaaatataatctaagatattaataattattatttggacaacatttcatagtttgaaaaaataattttacttcagtagtatttctaatagtattttgatggaactttcaaaacttctgcaaataagttttagtattatttgtaatttgcagataagaaaacaaaagctttaaatgattaactcaaagaaagttatcattacaattgaaattgaaggttatataatatttagataggcagagggcagaggtgaagtcatttcagagaccaaaaaaaagcaaaagtccggggatgaaagcagctatgacatatgttgtgggacataaaaacatgcattttggatagaatagggaatttaaaagaaatatgtcaattgttcacctattatctggaaaatcaatcatcttttattctcttgcaattgtaaaggctcagttttctacatattcatccaatattgttccaaatttcaggttatatgatcatgcctcaatatatgtatttgccttaaatgtttaagaacagattgctttcttgtcatttgatcatttcaacaatgtgagttcgacttaaattgagtatttaaattttggcctactgcaccattttttaaatataacctttttctggaatatctatatattgtgcatacagataaagtgtaccctttgcttattttcagaggactcataaaaaataaaactacctaggcaacatatatgttgattaaagtttgtaccttttttatatttttaatatattttctttctgtgtgcatattttaaatgtgatgtgcaaaaaaaatgtcaaagtaagtatcagtgactcagcaagaaaaggcaaaaaataagcagtgaatacaaggagttgtaattggaatatttctcaaatgaagaatatgtgaatattttatacacataataaaatctataatattaaaaaatacaaaagcactaccaaaagagatgaccatgacatgagacattggccaattaatttaccatatatgcagaaaagtcccctcaaattgtaagtgaaaggagacgttgataagatatgctgaagaaataataagacggaagagaatcagcaggggtaggatatcattataacaacttcacgttctcttttagacatagtttttctaacttctacatttacccacatgtttatgtgtgtgtgcatgtgtgcgtatgtgtctgtctatgtattattttgtggaaatcagcttaaatgaacattattaagtattgtggtaggcagaataatgtctccccaatatgcccatgttctaatccccaaaacctgtgaacatattacctacttgcaaaaaggactttacggatataattaaattgaggattttgaaatggggagattttcccagattatctgggtgattatattgtaatcataagggttcttgtaagagggagataaaagtgtcagagcaggagagagattttttggtgctgcaactgctggctttgaagatggaagaaaagggtgtaagctgaggtatgcgggtatcactagagactggaagaaaccctccttgaagcctccagaaggaacacacagcagagttgaaacatttatttaactccataagatccattttggttttctggcctctataattataagataatgtattcgtgttgaggtaagccactaagcttctggtaatttgttacagaatcaataggaaagtagtaaaaaagtcaaacattttatggtaccaataaggtgtaaatttaaatcagaatttgttactcagtcataagatcagcatatatgattaacactgcttacaaatatttcaccagaattattttagattagaaataaacatgtttaggggatgtaaaatttaagcaaaggaagtgatttaattagaaaaggtaacttccatttcggaagaaactttcaagtcaaagtgaactcattgtttctgctttatttttgtagagcttaagtttataaacaggaccagagaactgaacaactgaataaacatcagtgtactggaaataactgaagtattgggttcaatatcattatacacactattgttttgaggtcacagaacatgaaatctctgggtactttcacccagcaaaatgcacacgttaataaggcaaaagatcgtgaattttttttttttttactattttattcccatgttggctaacactgagaaacttatattctcagttggataaaacaaaatattttgggccaatatttatgctaggataagtgaagaaataagacagtcactcaaaggatatcctagatgagagcattttggtcaaacaaatttacaaatcaaatagggtataaaaatgaatttccttaattttagccatattttacaaatattttcacatagtataattgcggaaataggtccatgatttgagcaagaaaagatactctgccaaaatattaatataatatcttgctaaattgtctcttcaaaagcatcacattttattaatattttcttatccatgccctttagaacaaacattttaagagatagcatgtagtagtatttaaaactaaaaaatcttagttttcatggctaaaactttgagccactttgcaaataaaaataaattttaattgagccttaggagtatgaaaataatcagcagtaaattgaacctgcataaaaaattctgagggaactattgtcaaggaactatactaaaaatttactatcatggaatgtggaataaatatttattagaatcttctttgacccaaatgtcattttagtgcctactcatacagttagtgattgcagttatttgtgagatacagtagtgaatatacgtttaatattttggggaagttgattagctttcctgaatatttcaaatcctagattcttagatttgaaggagacctccaaaatggtcttctgttctaaattgcaacattccatttcgcaatactcctgataggtgaccatccagccccagtttgaaaaatagcatgaataatctccttcttgatctgacattggcaaaccaaacagaaataggataaaacaagatattattttaaaattacattatgctgttatttgtccactgtatcactatagttgcattagtctgcagttgaaggtattacctaccaaactcatgcatttttccactattttattctttattgcatctaaaaatgtatagtttatgttgtaaatatatcataatatttatatcaccaggtgtagtgaagtataaacttaataattcctgttaatgtctgacctgacaccttgtagatgttcaacaaacgttggtcctgttcacttttcatttttgaaaatatagtatttcatctgatagatactgagggttctattgataattcttcaactttaaacataatttcaattagatataagcataattttcatcagatttaatatgacttcaatgttgtgactacttagtataatttatatcatctaatatttgattgaacaatataaatttgaatgtcacttatgtctctgaaagaacttaaaattttttgaaaattcattcagttacagtttctaatttgatgaaattagagatttttaggatgcactttttttttttgcaaatttcacggaacctatccttaatttatgagttattttaaatttttttaaccacagttagatattttcatttttgggaattatagcacactttaagaatttttaaaaattggcatagtgtgtgctactcatgtgacagttgcactaaaatcctagactccaccattacacagttcgtctatttaactaaaaactacttgtacccctgaagctactgaaataatacaatttttaaaaaagaataaaaagaagtgtcaatgactttttatcatttttcacattggcactgttactggtagcccataaattataaaatttgtgaggcatttgtagatatacaaggttgtgtgtaaatctgattcatagacaatcttatgaattcttaccacagtaagaaaaatgaatggaagtgtaatagtaactttgaggatgaaagcttatataactacttttgtaaaatacatttctctttagcaggaatcaaggttttaattttttgcttgctgttttcttaaatttttatttcgtacttatttatttattttgtttttgagacagagtctcactctattgcccagactggagtgtggtggcacaatcttggctcactgcaacctccgcctcccgggttcaagtgattctcatgcctcagcctccagattatctgggactacaggtgcacaccacgcaatttttgtacttttagtagagatgaagtttcaccatgttggccaggttggtctcaaactcctggcctcaagcagtccacctgcctcggccttccaaagtgctggaactacaggcatgaactgctgtgcctggcctagaatcaagatttttagttcacctggtaccatatctaagataaatcttagagcatttaggtacttaatccaaaaatatctttttgcagtatgcaactgtccctgaaatccttgaaataaaaagtataattttctaactaaaaatgtagttttatactataatttttcttttaaataatagtaaaacatatccataccttttttactctgactccagtgtatatgcattggaaaaggaaaattccgtgttttagtatatttcatacccaaattttcttttacttaatattttcagtattatctgtaaaattgctttctttactgtttcttttgtattttgtctgttttgcatgcattaaaacaaaatgtgagggaggacattatttttgtaattgtctattcactgagataaactgaaatgtatatcaaatcagtcattaacccccaaatttacctaaatgattccaaatatcctagtatttctcaaaaacaaattgactcagttttgtgtttttcactagaggtccaggattgtattgatggctgaataatgagtcaggaaaattgacctatatgatttttttcttcaggaacttatgccagttaaagtaattgcattttataatataattttattgtgagtaaaatataaacagtcgacaattaaagtaaaatcatatgaaaatgggagacatatttaacaatgtgaatatcattgaacaaatgtctgttaacaatttaaaagtagcaaagaggtaatcaaataattcaaaatcgtgacgtacttctttatgcttagattcaattttaaagatgtacttatctgtaattagagactgtcacattcagtcatctgaaaggcagtaccagtaaggatcatctaccaaatttttaaatcttgagaataggcattttgcataagtaaactccatttgtttgctccctacaatattctatatattaaaaataacatgtgccaaaaaggcttcgccttagaaaatctgtacaacctttatgtgaacgtgaatgaacattgtttttagcaatagcttattaggaactctgattttcaaataaatatgtgaagatctttaatatatgaatatcagcattttcccaagaaaggtaagtggatgtttattatctgtgagtgagatatatgtcagtttagacatttaaaaataaatcactctgatttaatattgtaatatagattataaaaacattcttaagtggtgaaaatgatctgccaaatcggataaataaaaaagagtgaaacagatttaatcaaaacattctttccatgggaggagggtgtttttggtgataggaactctcttccctgagaaaatggaaatgtatttggatttaaaaattacaatcaacacatggatgaaaccatacatcatataaatgcaaattttacatgtatattttcattacactattaccactgtgattttaaatgtagtatttaaataccaataattaatttagcataatacccctgttttaataaagcaactttatatggtgatttttgttttcttatccaagctgaattatatatagtgatgataagatcactagcatcagatgaatgaaaaactgatttatgctgtacaggtatacaactctttataaataatcttgcaacttgatacagaaagtgtctataattctggcatgtttgacattcccattcagtccaataactcgttgacagatacttaatttgctacttcttgaaggtgttgcttgaagtttccttctacttgacaggtgtctgacagttcagtctcactcagagcttaacaaaatgggaaaagaatgcattatctaaacccctaggtaatatccattttatgtcattttatgactttgatagtatccaggactcaattctgttcctctggatagtgaataatgtgcacttttacttgtggctttttaagatatgtgtatatacctttagatttccttcagactctatcttgaaatgtcaaatctttatgccctgcagttcttaaactataactgatgtttacaatatggactgtgaaggaaattatgataaaaatatatttcctggtcacccactgttttggtcaatttaggctgctatagcaaattaccatagactgggatgcttaaacaacagacatttatgtctaacaattctgaaggctagacatctgagatcagaacgtcagcatggccaggttctggttcaagccctcttccttgttgcaaacaaccaacttatatcctcacacagcagaaagagagcaagctatacaggcgcttaatttcattaataggttctacttaattatctcccaaagaccctaactccgtatgctgtggggatttgatttcacatataaaattttttggatatacaaacattcaattcataacacctaccaaaatcaaaatattcataatacaaataatgctcttagtatctggcatctctgacaaattatttcagctgttttgcttttgaatacatatttatatccattcagatttatcagaattcttcatttaacttcagtacagacacacgcacgcacacacacacacatatactcacacacactttttaagatgtaagcatatgatttcattttagaatcaggcagaaccatattataagtcagtgtccacagataaagtatctaatataaaactgagtttctaaaggaaacgtattttgaggtgaaaatctgtttagcttaccagtgtctatataatatgtgcaaaatccttaacatcgcattgaaagattctttggatctgatcttaccatatatttctagcctaattaatcttctacatttaccctgccagttctctgttcctactcattgattccctaacaatgtaagcagagttcctttgttaagtcattcacagaaagttttccctattcttctctatctgaaaaaaaatgtcctctatccttggagatctaacccaaagtccatgaagcattttactgatactttcattttctgttgcagcacttgctatttcttttatgccatggagtgggcacattttgtatttgtgtcttgtattattgtgacttgatccttggattggatcttattttacttttgatgtatgtggtagtcagaggcctaccaacagatagaacccacacagtaatttggagaaagttttacataaagaataagtagatataatacagtatttatgtaatggaagattagctagtaataactaaagaggagtctaaagaatatagtaataataattataaggagaaaccattgcctctgaagctgagaggtacccaaaaagaacctcttcatcccctgcaaggctgatatccaaactttatttgtgaggacatgcccgtggctcactggctggtggacaaattgctgaggtgctggaacagcaggacttgttggaaatgttttcctctgggattccaaataagtcacccatagggaggatcctaaccagcagcactcctcttcaaagccatctaaggggtgccatcttcgtagaggtgcctcattggcaacacttcactgctatgctatctgagagggtaatggaaaatgctatccacaaggagactgcacattgaaagttaatgcaaagcaacttaagggggtgtggaagatgccatccacaggaagtgctgggcttcggaactcactgaaaagccatcagacacagtgtctgggtgcttctagccaccatgttctataggagccaggtattaaagaagctgcatgctgagaggagcacactaggaccagaaagagaaacctttctccctctagtgtccccccaatgtcatgtactgacagagctcaaaatgtgcaagttcacaagggagaaatatttatcaaacccatctccattattgtagagcaggcagtggggggtggatttggatgtgataatcaatgtattcataattggcacaatatacttgtttattgactctttgaacaaatcagaatttcttacaagatagaaatacattcttaactttccttttgtgcccaggatttttaaaaaatctcaaataaatattactatatttctccatcatattcttattaatatgatataaactttgacattttatgtgcacaagatatatcctaagcattaaagataactgtgttacataagtgcacattattgtgcttagtaagtgtatgagcatgtgtgggcatatatgggtgtatataaagtcaatatttgatttatgattgaccaatttgaaaattaataaaatgggcttgctgaaagctagaaggtagctactttaaacatcagaaagacaaatgacaagtcttggtatcagctagttaaaaacataagtttctacctttgaaaggattatgccacacattgattttcctattaatttaaataaaggtaggtataggaaatttactttagtttccatctttgaatgttataaaatattgtactaacacatgttgatttctgaaatgttataatcttattatacttaaaggataacattggggctgggtgtagtggctcatacctgtaatctcaatactttgggaggctgaggcagggggattgcttgagcaaaggagttcaataccagcctgggcaacatgatgatacttcatctctacaaaataaataaataaataaaaactaactgggcattgtggtgtgtacctgtagtcccagctacttgggaggctgaggtggaaagatcacctgagtccaggaggctgcagtgagccgtgaccgtatcactgtactccagccaaggtgacagtgcatgaccctgtctcaaaaaaaaaaaaaaaaaaaaaaaaggaaagaaaaaaacaaaaagccaaaaaaaaaccaaccaaaaaaaaaacccctcacaaacaaaagagcaatattgtttttaaaagtacattttactggccaagcatggtggctcatgcctgtaatcccagcactttgggaggccaaggcaggtggatcacctgaggtccggagttcgagatcagcctaggcaacatggtgaaaccccatctctaccaaaaatacaaaattagccgggtgtggtggcacatgcgtgcaatcccagctactcgggaggctgaggcaggagaatcacttgaacctgggaggcggagtatgtggtgagctgaaatcgcaccattgcactccagtctgggcaacaagagtaaatctctgtctcaccaaaaaaaaaaaaaaaaaaaaaaagtacattttactaaagatgtaccttaacccatttatgccgaatgtactttaacccatttgtcttcaaatttattcacattaaaaccttattattgctcatacattaatgcatgtttccttgttttcaggtttatgtatactgattgtctgttatatagccaggcaaaataaatgtcagagtttggtaaaggtttccacaaggagaagggaggagtgtttgcaaatgaaggttaaatatgctaaaattacaaaaattacaaatatcttaagtattttctaagaaatgatgcgtaaatatttgctactaaaagagttctggcatttgattcatgtggtctagattcaaattctaccttttcattcactgtttaaagtttacataactcttctggaaaatggggattctaatagtactagtttatgaaagagtttttgtggatttagtaaaagattaaactcattaacaacttacaaagctctgctgtattgaaaattgaggagaaataactttacaataaataaaaactgttaaatttaaaaacagggatatagtgtgcatgtatctgcaattcttctctctcttctaaggtttactttgtacataactacctagctgcccttcatgtaacttagaacttcatctactatctttaaaatctagtcccatgttttaaccatcttggatggttaaaaccttcaatgaccttcacctagttacacaattcagggacccaggagtcaccattaaccctacactactcacattcacatccagctggccactaagtcatgttcaatctgtcttttaaaattcaatttagtatgtttccttcctcatattcacccttaaaattttctttaactgtaaataccagcaattctatatatttttttcttatttggcttaattcatttagtttttcactgcattttatccccgcttttatcagctacattgctgtgggtttaaaaaattataattggatcatattattcctctctacaaaacttttaataccattctctccatacaccttactcctattttcttcaggataaagtttgtacttatcctagatgacattactttatccataggatgaccttaccaaaacctttaagttctagtcttaacctacctgtctagccatatctctcataaggccatatctcctcataaatatctaatgcttaattttatgagaattgctgacaattccttgagattgtttttatgcttccttattttttcaaatcttatattttatctggaatgccattataataatgtttaattgatttgtatcaaaactactgggatttgttgatggcttcttgccttatgttgttagatatttggctttttttttttggagagatggtgtctcactatattgcccatgctagtctcaaactccttggcccaagtgatcctctcccttggcctctcaaagtgttgagattataggtgtgagcccttgcgtccagccttgccaatttttttacacatattatttaatgtaagttctatggcaatttagtgaggaaacagatacagaggagttttatttcatgtccaagtttacagaattataagtggtagagtcaggccaatgctatgtttgccgctaaaaactatgttatccaaaagatgctgcaaaactgacctcaatcatattcatgtgtgtgaaaccttttgtgacacatctacatatgagatattgatgatcatgttgtcttttatgttatcactatatccacaactgtttctgttatctcaggtgtcacattatctcaggtgtcacactaaacttcaactgtgaactttatgtctgttattcccacttaattataaactgataagcagaataacagtattttaaaaatcataacctcttgcccagtgtatatttctcaataaattacatttgaatgaatgaatgaataatacagattccttcttttttttgtattcaacttcacccatacaagagagactaaaagtgtcattagctattatctttgtattcaggaaacattaaaaaagaaaaatggcatttgagatgggtgttgaaagataatgatggagaattttgacaggtggaggtagaatgagaaaaggcattaccaacgaaggcccaacttaataagagctattttgcctatactaatggacagttaacagtctgatttggtgtattgcttggaaatgatcttgctcgcaaacttattagctgttcaatttagttttaagtaaatgggcaagtggcaaatatatgaggaagtcagaagaacctttcttatattaacttgatgagtcgctataccattgaaatctcttacctcacccagagcagcccctctggaagtgctctttcatacttcatgtctcttctgggtgtgtgaggcaaacatgaagtttatatcagacacatatgaatatactcaatgaatttctgcctatggacaactacccttttgcaatacttacttgaagcatgttttctacatgaataatatcttgaagcccaaattatataattgtatctgtaatttatctgcttgatatacccttcacaataattctatagcatataatttttctcatttttaaatatttatgaagaagcttatgttgcaagagcttcattctcactgtatatacctgaatgctgtgataggttagtaatgggcactgaatcagaactatttatttctgtcctacaccaaagcccttgttttataaactaggcaactttactcccagcatgagcatgagcatgagcaaatgttacggcaataggaaagcatagtatcattcaaagaattatctagaaagtggataattttggccaaatctgagattctcagtgctgtttatacatcacaatcacccatgggaggttttaaaacttaggctcagacatcatcacaaatctccaccacagacaaattcaaccccaattgctgagagaggggtcctggcatcagaagtttttaagctcctgagtgattccaatgtgcagccagtactgagaaccactggactaaaatgaagggcacatgtatgggggcggcatgaagagtgaatagggtttaaaaaggaatattagaatcacatgggcaggataaaacccaaacagcctcactcagtaactatgtgatcttgggctagttactaaacttcttgaaatctctattttcctgtaagatggggataaactaaagcatgtaaaatacttagtatttggagtcagtttaattaatggtcattcttactatttaaaaaaaataaatttgaaaaatgataataggactatgttgtggaaatatttgactaccaactgcaggaaaggatattactacgacagcataggtgacaaaaacaaattagagatatattttttgctcagatgcttaaaatattttttttcttttcatatcttgtttgcagttaagtaatctttggtattaagcagttttaattgcaataagcttataaattattagtactccataatgaagagaaatgataaaagtctgtcttgttttgataatatatgaataatagtgagaattataatgtgctttcttttactaagcatcagatatttttcagatgaatagaatttcgatgagttaactaccaattgcgtagtaccatttacaatctcatttttgaaagacactgtcttgaaacaatctagaactgacaaatgacaacataagatactctgctttgcatattaaagactttcacattcacttctcatttggttctgcccacagccctgagacatgggaattaatgagttttataaagtttattggtttttaggggagagggctatgacaagaatccttcccttctaactttgaatgtaatgcttcttttatgacacacatacttatttggaatatgttgaaagtctagaaactaagaattaatatgtaggcaaaaggaccagtgcaatgctgtgaactcgatgtgagtagatcttagggattctaaagggcactctaatgcctttagatttaagctgaaagtcagagaaacagttaagatagcagaaacctaaaaattctcaaaatatcaaacaggcagagttaactctaccaaagtcagaatgactcaaaacactgttagcagcaaatgaaaacaaagaaagaaaacagcactatgcaacctctggtttgcttatggtacttactagaagtgagtagtcttggctgcaatgaactttatagaaagtgtttagcttagagaatgtcagaatcctataaataccctggaaatagcgggtggcataatgtcttctgcagtctcgtttcagcagataaacttcttcagttctatttagaatgcattttttgtactacggttgatatttcaggcaacagtgatgtatatacaagtatcttcaacattctattaatttcaggttcaatttttactgaaatcaatatctattaaaattatcatgttataattaataatcttaaattgtacaaaattcctattctcttgtatctgtataatatcaaattagatgtctaaaaatctaatctgattttcaaattaacaaaataacctagaagcaatactataatcatcttctctaatatatatacttaagataaaacagctaattataaacaacttatacatggaagtatgcataaatattgtgatttttacttaacacagtgataaagaaattgatacatttaaataaccatatatatagccaatttgaaatttaggtatactccaaaagtagatattttgaattgatatgtttaactggcttaattcaacataatttaggccagatatttcataaaattgtgtttatttctaaagtaatgagtgcttcttgtaaataattccaatacaaaaatatgtggagcaaaatgcgacattaagaagcacaccaaaattaggatggtcagcgcctctggcaatgagggaatgggattagaagagagaacaaaatggttgacaaccttatctgtcatgcttaatttatttcatagataaagttaaaatgatgaaatgtttctattgataatcatggattctatgtaagaatttgttacagtatttttgtagctgtttgttttttttaagtttctcaaaagtgtttaagatttaaatttgaccatattactaggtaattgatcttgatttcagttaataccctggagttacataaacagaaatttaaaataatatttttgattctacaagcattccacattcattaatgtaatacaagaaaaccagatcattctactgtgatcaacttacaaattgtgttggaatctgcctgcatatagcccaccccctcaataaggcaccataaaagctattttaagtaatattctctcaatcataataaaacacacatagcaagaccaaaaggcagtgattcctttttccatttccaacttgtcctcaagctaagcagtccggcaactcaagcaaaaactgtgtttcataatatgaacagccacttaaatactttctccccatctctttatgtttcactgctggggaagttaataatgattaaagtaggaagattttttgttttaaatcagaaagtcagttgaaagaaacctaaagttctgccataaatatctagcaggtgctgatggccacctgccacacttgcaccagattgtctatgtagccagcagtctggccatcagcagaccagagaggtgcaatggggagtctctgccttgctgcagattccgataacttcttgcttaatttctatggtggtcttgccttctaagtcccagatcttgatgctgaggcctgtggtagcgcagaaccagtagcagttgaggctaaagcacagggcattgatgatattcccaccacatagcatatcaaggtgcttgcctttgttgagatcgcatggcatggcatggcatggccagcattgcctccagaagcacagagggatccatctggagagacagtcacagtgttcagatggactgtgtggccaaagtggttcatcttcagcttgcagttagccagattccgtaccttgaccagcttgtcccagctacagaggtgatagtgttgctgccgttaggtgagaagtggacataagacacctactctgagtggctctccacctggacagtgtatttgtatatactcagggttataaccataactagacggttttatctcaggatctagagacaatctacaggttgtcaatggagaaggccacactcaacacgtccttggtatggcctacagatcatctcatagtggtgccctttgtcagatcccagaagcacaggtttccatctcaggaggctgagaggaaaaagtggccacctgaagagatgattttgtcatagacaaagtggaaatgaccctccagggcatgctgtgggatgccatagttggtttcgtccctgttcaatgtccacatgatgatgattttgtctcaagaggtggactgtatcatgtccagggcagtagcgatctggttactcaggtattgtggccttcaagagtgtcacaaagggtcttctgctctgtcatggtggtggtgaggtcaggtgtcactgcagcaacgaggatgccactcagagagaccagagggacaaacaccacagccagtcctgccacagccctgccacaaaaaagtaagccaagcagggaaattttaatacatgaaaaatacaaaatataggcataggatggaatagtttcactaatttagagtctatgtgaagggcaatattggagaaggtaattatgtacaaaagtatcttggagctggttgaattgtttgccctttgccctttatgagtcacatatatatggagaaaagaagttgtctattgccaattggtacaaggattaaaattaggaactatgaacatttcatggcagaatttttgacaatatataagtaatgaaaaaagcagccttttatatttaaaatatacagagcttatctcttatttgctgccaatccctagcaccctgtacaagattgatctattgatatttgctaaatttgttaaaggacattaataacttattgaatccgtaataggtgacatgagagaaatcagctcagggaagcaaattatgctgtctatagtcacacagatagaaaggttggaacctggatggcaacacgggtctgtttgactagaaaactccaatccatcttcttgtcaactgaatagtatttatatttattagaaacaatcactgaaaagttctagattaaaaatgtatctagatcattgcacaataaaaaaaatcttacatcttccttaagttatgattaattttagtgtgtcagtaataagataaattagttgtttggtaaagaggtgctaatctgataaactctgaaattccttctaagcccttttgtttatttatcttaccatggatacaaaaatggccacaaaataaaagaaggatgtgactattttcctaggagtgtgcattgtccaccccagtgcctgacaggtcgaactgtttgtgatgactccagaatactctgaatcccatcagtaattccttccagtgttgacaatgaaatttagaatagggactggtggtagtaggaacagggatggtgtctatggggttgcctaataactaatattatggataatatctaatacaaagggaccttcaatctggctggtagttcaggggagataggatgaagtgaaacatctctgaaatgtctgagctagataatgaaggttaggccaggtgaacaggaatgttaggagtttgacctgtaggctaagaaagacgtagataaaggcatttttgcctgcttaggctgaggttctcttcctttataaatagaatccataaaatatcattaggttcttatatttgttggaggttattaaaatttatcattacttgtgtatttgaaaaatatatgatctttttattatctccaaatgtttaagtctctgctgtgtagtagctatgatttttttccccatttcttttgtttgtttgtttctagcagtttttgccagctattccctgctacctgtgacacccttttttgctaagaaaatacttctgtcttgggtgctagtttcatggctagggttttatattctcaaaagaataaattaattattaacatatgtttctgaaaataaacttttattatttatttcaaaatttaataacagttgaaagccattaattgctcttttaaaaaactaaagaaaattataattatcagacccacctcaaagctctgcctttgtctcttatcagtccattccccttgcatttatgtgtaacaagtttactcttttagtttatgttaattgctgatatgtctactcataaactactgtataaataatattaagaatttggattgactaagaaattaactttaaattgcctctataaacattaaactttacctttagatattgttttttaggaaaacccatgaagtgctcctttgtaattaataaaataatcaaaataggttgttagaaaaactattaaacacattgatgctatagcaataatgacatgataaccagataaatatatgaaagtttataatccacaatttatttttcatatccacaaatttcttaaaaaaaaggtattaacatgtatcccagaacttaaagtataattaaaaatacataaaattttttttaaaagtactaacatatatctgcccatttaagaaatatttccatgacagacacttagatactttgcaaacaatcgtccacctcttcttctgatttagttcatgtattatgcccagggatgaaaaaccagtagtaaaccagggtacaactagcctaaagagaacctttgcgcaaattacaataaaaaatcatcctatgaactcaaggatgatgaacagaaaaaaattcaccttccattggggctcgcagtctgttgagaagaatccagactgaacttcagcccctactaaaactcttggccaggtaccaagttacatgaacataagcagcagctctgcttatcagttgtgctatggcaccgaggagggttacaaacatgctgagacattgattcttcagctgtcatgacagcgaagtgagtcttaacatggccaaatgccataaacagaacacctccaggcttctgcagtcttgtctgtttgctctaacatctcatacctctatcattatttgctatgtgacatgacacatagcaaggctaaaaccagtcttggtcatactgttcccattcacatatgggtatttaaaggtggatattttagtaagctaggttgcatattattcccatataaatgagagccacctccgcccccaacagaaaccatgttgtcaaaatagcatgtaatgcaaggagccaaggcagcccatatgcaggcctgaaggaatgttcaatagacacctggacattgtgccatcagcaaaaaaggaaacagccttcatgttcttagcaacactggggaactacttaattcattttctggagcccatgttaggagaaatattaaatgtcctaactgcttaagccacttttggtttgatatattgctacttgtagctgaaagtatcctgagtgttccaacttggcactccttcagtgagtactcagtacagcagccagagtgatcctgttaaaacacaagtggcatcttgtcacccttctgctcaaaattctcagtagttttctctttcattcagagtaaatgccaaagtcctttttcagagctagaaatcctatgtaatctgcccttgctctgtctcctcctttcctcctaccttctctgaactcattcctacttatttctctttgtccattttatttaaacagacaaggtatgcatccaacttagggtctttgcacttgctatcctctgccttgaaaactcttccctgatagcttcatggattgattcctaagactcttttgctctttacattaatcttcctctctcattgaggcttttcctggatgcaccatctaatgacgttccaaccagcaatccctaacacaccatattttctatcttccttcctgctctatatttgtccatagtacttctgtataacatgtttcagtttttaattaattatctcatttgtggtctgttattcccactggagtgtaagttccaaaaagaagtgatttttgccagttttgttccatactgcatgtccagtatccataatagtacctaggactcagaaggctcttgatagatatttgtcaaatgcatgaatcatagcagttaagcttactagactacttgcattacattattctagctttgaatgtgacaatttataattatctgtataagataaccaacatatttaaattaatttagtacttttgtacaaaaccttatattgatttgcaaatcagctgatttaaaatgtcaagtattacaacatgagtttttcatataacaattagaaagacttaggcaatctgattttatagactggtaattggtttgattgatctaatgttatttcctttatatccaagtgttctcatggtgtggccttgggatactatcagttcattgagaagagttcattgatatgtttcaggttccatattctaactgagataggagtttttatgtttcatcaaaaatatccaaaattttatgggaaggctattgaaatacacttctcccctccagttacattcctgtataaagctgggccttcctcatatttcaattcatgtttcttaacaaattgagtagaaaatcagataaaagaatccacttatcctctattaagtcaaataccaagggatttgcaagtgttaggcaattaaactattctattttatttaaaaccatttatatttatccaaaaaatatttgttagttatattaacgtttaatgaatgaaaaagcatatatattggaaattatcaggttaattttgggtgcaataaacatcaacaggtataatccacataaacaaaaactctttggaaaactcaatactttttagcaatgtaaagggatcctgagatttaaaaaaaaaaaaaaaaaggagggagtcaatttttgttactatgtcccttctgtctttatttgttaaaacatttatgtgtttaacacctcccagccccgtcaagacccgatattctaccatcctggtagtatcttcacactactgggttttgtttaaatgctaagtagcttttaatcatattatcttaaatatgatttttttctccagccaagacaccaatatttcagagaagccatttcatggcagtgactcacacttaattgttgcatctgatgcccttaagagggtacaaagcagtgtaaatgctcaacgaataaaaaaatgaattaatgaatgaatgatatatgaagagatggatataagcactttccttttagctaaaataaatctagtttgctattttatgtttcaaattatttaacatagagcttgttatattgctgacagttttctttcttttttaaacttgcaggaatatgctgtcaagtcatttgtttggtatgaatctatagctaagtaaccaattttgatagttaacttgatagttaatgttgagaatgtcaaaatatatctccacaaatgatcagattaatagatatgtaagaattcctattgcagattcagtttcaggaacttcctgctaggctttcttgacttcaatctccaactaaaaagtctgagaaactgtattcccctacaactcctcaagtaattggtaatattggtcaaggattgtttcctaaataaaaccaaagccgattacatttgagttgctaaaatcaaaataggactatactgattttagttcccaggtccactttgactcttctaccagtcactggcaaccaaagtttattaagttaaatttattcagaattcataatgactttattgtagaaatctgcgaatagatttgcacttgatagatagacaaaaattacctttgatagaattagtaaattaatagttttaattggattaggtagggacttaagatgaaactgcttaacttatttaagaaaacaacttggtctaagcagtctactagagcacttgtatagaatagtgtgctaattatgtgtttcttatctcttcattaaggtagatttgtcagaatcattctttggcaacattgtttaataattggtttatattgctttatagccctgaagaaaataaattcatatttggttataaatgccctacatttctgacttttaactaattacagatgataacttcctcaccccaattaactcaattaatgaagttttacatttttttctttttctcttgtgtgattttggtaatgttaatcaacactgaaaaacattgtttttcaaaaatttgctagctttttttatgctctgttttagtacatgttgaaacaggtataagtaactaaaagaaggcaaacaagtgtctgtacatattcttcacccactttttgatggagttgtttgtttttttcttgtaaatttgtttaagttccttgtagcttctggatattagacctttgtcagatggatagattgcaaaaattttctcccatcctgtaggttgcctgttcactctgatgatagtttctttggctgtgcagaagctctttagtttaattagatcccatttgtcaattttggcttttgttgcaattgcttttggtgttttagtcatgaagtctttgcccatacctatgtcctgaatggtgttgtctaggttttcttctagggtttttatagttttaggttttacatttaagcctttaatcgatcttgagttaatttttgtataaggtgtaaggaagggatccagttttctgttttctgcatatggctagccagttttcccagcaccatttattaaatagggaatcctttcgtcattgcttgtttttgtcagaagacatttattgggccaacacacatatgcaaaaaaggtcatcatcactggtcattggagaaatgcaaatcaaaaccacaacaggataccatctcatgccagttagaatggcaatcatttaaaagtcaggaaacaacagatgctggggaggttattgagaaataggaacacctttacactgttggtgggagtgtaaattagttgaaccattgtggaaggcagtatggcaatttctcaaggatctagaaccaaataccatttgacccagcaatcccattattgggtatatacccaaaggattataaatcattctataaagacatatgcacacatatgtttattgcagcactatttacaattgcaaagacttggaaccaacccaaatgcccatcaatgatagactggacaaagaaaatgtggcacatatacaccatggaatactatgcaggcataagaaagaatgagttcatgtcctttgcagggacatggatgaagctggaaaccatcattctcagcaaactaacacagcaatggaaaaccaaacgccacatgttctcactgataagttggagttgaacaataagaacatatggacacaaggaggggaacatcacacacgagggcctgtcaggggtggggacaaggggagtgagagcattagtagagatacctaatacatgtggggctgaaaagctggaagatgggttaataggtacagcaaactaccgtgacacatatatacctatgcaacaaatctgaacattctacatatgtattccagcgcttaaaataaaattgaaaaaaaaaaaagcaaaactagcactgaggaaacacctaaagcaatcctgggactcataaacactcccatattttctaatataattctcaaaacagtgtccagttattttaagaacagaaaatgaactgaggctaagaacaataaattatttctccaagatcatgcagtaagtaggacaactgggatttacattgttttttttttttttattctgaaagactccttatgtcttacttcaaaatatttctatgttctctaaaaagtgaactgagctaagcctacgttttgtggtgcataaaccataccaacataccaacatcattatggcattaatcattcattatggtaccactttgctttatgttccaaggcattcactgtcttctagatattttttattttatcatgaataattttccttatttaagcatactattattattattttagtactaataattcaactttatcaaaacacattttttatttctcatttaaaaatatctttaaagagtcataagttaaataactgttctcagcacagactgctatgggcagatgccaagaaataagttctgttgagtttactaagagattcttcatagttttattttttaagttgttttctttctaattttatggttttattacactcttatttaaactaaagcaaaaatacttattctacctaggtctacagtcttcatcactttaagaggaaaacaaagctattccatttaagtatctgggtattgcaataattcattgtgtagttacagaacatatcatagagcagtcatctaacccttctctcagacagccattcaaggctgcctatgtctttctcaggaggagatagaatggttaagctgtcattatcttctagtgccactgaaaggacaatagtttcaatgccatattgcctgacatttaaactgatataccttgggatattgagaaacagaagggactaggggaaggagagagccagtttttaaattgttactatataagaagattctaggattttttcccactctgaattttaacttgcattccatgtaacaaaaaatagaccatgtaaaatgaatatcatcattttatgtctattcttttatatcactgtgaaagaaagcaacagaaatttaccaaagaaccaaaggattgtgaatgacttttcagaatatgagtgagtatgcttcacagaaaaccaaagagctgctcccctaattacaaatggctggtctgagagatgtcaaatgacaatgagattaaaaaggtaatgtacaactcaacaaaaacgtgagctaaatgattggagatccagctgtagtataaagttaaacacttttactctgtagtcagagaaacctggattcaaatgccaatttcgttttttttttttttcaaacctgcatggctttgagcaagttaactggcagaaagcttattttccttatctataaaatgattccaggcatggtggctcatgcctgtaatcccagtactttgggaagctggggcaggaggatcatttgagcactggaatttgtgaacagcctggacaacgtaaggagatgctgtctctacaaaaaattaaagtaaagttagctgggggtggtggtacatgccttagttagtcctagctacttgagaggctgagagaggaggatcacttaagccatggaggttgaggctgcagtgagctgagatcacgccactatactctagactgggagacagagcaagaccccatcttgctatataaataaataaattatacatctatataaataaaccccccaaaataagaaagtaaatagaacataactgctacctacatcttaacatggctctgacgattaatgatacagtgcataaaagactgtttcagcaatgattagtgtataaaaaggatgtaataactagtaatattggccacaaattctattaatatgctttatatgtaaagatatataaaataagtaaggtattaagagaatacaaatatcaacttatgaaaataaaaaaaaggaaagattagtaaataaaaatgagaccgggcatggtggctcactcctgtaatcccagcactttatgaggccaaggcgggctgatcacttgaggccaggagttggagaccagcctggccaccaagatgaaacacgatctttactaaaaattaaaaaaataaaaaataaaattagccaaatgtggtgatacctgcctgtaatcccagctacttgggaggctgaggcaggagaatatctttttttgttgtttttgtttgttttgttttgttttgttttttgagacagagtttcattctgtcacccaggctgcagtgcagtgacgcaatcttggctcaccgcaacctccgcctcccgggttcaagctattcttctgcctcagcctccagagtacctgggattacaggcacccgccaccacgcctgactaatttgtgtaattttagtagagacggggtttcaccatgttggccaggctggtctcaaaatcccgacctcaggtgatccacccaccttgacctcccaaagtgctgggatcacaagggtgaagcaccacacctggccagagaatctcttgaacccaggaggtggaggttgcagtgagccgagatcatgccactgcactccagcctggacaacagagactctgtcacaataataataataatataaaataaaaatgaaatctatttagtcctgttatttgcctgcactttttctctatgcatccaagtggatatagtaatgaactcacttttatcaattacagtattcatagtgttcataagaaataagacgttaattaggtcatagggaaaagtcagtataaactgactttaaaaggtatattgaaagatatggtagatgttatgtttacaaaatccctagaataaatttaataaggcatgtccaacagttgtttcttaaagtatatgctagtgcaagccagaagcatagaggtaattcaacacagcatgaacaatactaacaggagccacagcaatgcaggataactttccatagctcttaatgattgagttgaagtcaagggcacgatgtagactgtcaacatacttccagagaagcgggggaagtctgtaataaaatcatctgacatggactttaagtagttttccataaatattggttaatacaagtcaggttgtgataaagaacagtagagtctaaagttatacaagactctgggatgtactgacacatgtacttcatccataaaccccatcaagggctgtcaagaatgagtatctgttctttcatccagtcataacagtggcaataatgttaataaacaattcagcaaattacttcatgttgccctatagctcaggaatgacacttgatgatctttctttctctgtagcaaatgacttaaaatattcttattcagacagaagaagtaatcatatatgccctacctaacatgagcaagtttttaccatcacataaacagctacagatgaagaataaaaggataaccaattctaaaggactgccattatctaccataccctaaaatattggataaattgagaatgaaattgtattatgaatttttattaatagcatagtgaaaggatgaactattttcaaaatcttggatgttaaaaagaatagttttaggcagcagcttccgctgttagcttattggtggctgtggtaacaggctcctgcatagcactgagcctcctagaatcttcctccagttaatttcctgtgggtgacgatcactcctgagccaacaccagcacattttaacttcttcaggagcagccatcatgacatggaaaactaactgcttttttaaaggatgttttcacagatacctgttgaaatcagatagattcatgtcaaataagttaggtcccaaattcgtttttttagcagcattgatttgaaactgtcagttatgatagagtaatatctacttaaagttgattaagagaatatttattccttgtcggtgtcaacttaaaggatttcccctgaacctttatatttatattgcaatgtaagaaacaaatgctagtactgtgtcaaaagctattgccattccaatgaatatcatcaatatttccttcaacaatatgggaggttctcttttgatttttatttcatatattttcttttgttttgtctaaggaatttcatttcatatctcaggcaaagataataaaaccatttttcaccataaagagtttaaatgtttctattttcattttgctttttattcatttaagccttatgtgttgttgtcatttggcattataacagtggaatattgtctataggtgatctccacattctagcataaagattagtccttttatgagatggagaaatgagggattctgaatttttgtcgtttaatcaggcagtatgcaaacgtcttttatgagccaagcactgcattactggggtatggtaatgaataagacagacacagtttataccctcaagcagcttatactgcatcagagaagaggtacattaagcaaatggttttcaataactaaacacattatttcaaatgtagaaaaggctttagataactacttggttataggtaggttgggaagtactaatatttctttgtgtgatttctggacactgcatttttatcctaatgaggcctgtaatacttacttaggtctgtgtggtgtttgtgatggggatggagaataagggatgagaaagtgtgaaaagacacgtgcagaatgttctgggaatgagatttaataaaacacagctcttgataatgtatcaagtgaaactgccctgttacttcgccttggaaatgtatgatgagaccctgtttcctcaattcagttagcatgggttgaatacctacatagtatcagaaactctgtaatacaacaaagattgaaacagctttacttttctgagaacttattttaaataagtcaaagaatcacaaaattttaatatgatatggcagtgctcaatggaaagtaaaatttactgtaaggagacaaaacaagggttgagaataataaaaaatacaacaagcagctgaaagaggtaaaaaaaaaaaaggtaacaaatgaagatgaggttgagggtagggaaagtatctcaaagtgtcaaaacaaaggtaggaaggaggaagataatctaagcattctatgcatacattaattatttttggaggctgcataagagaatgaagacattgaataataaagtcagataagctaaaagtagctagcagtaggtagagaggcatgtaagaatattataaaaatgtttataattgtttatattatctgtctatctagtacagaggaagttctggttcaggaaattctacagataatgcttatgctgtttctcatacgtatgaggctgtacattagttttacctactgccttctacatcagaattgcatgaggtcctgttgacaaggcagatttcataggctgtagcctaatgccagacataagaagaatttttaaaatgggaccaccccccatgccagttcttacccccaggtgattctgaagccactaacatttgagaataattagataaaagcctgtgacaatttccttccctacatttcctaaaatttacatacacaaatgtatgcatacatataaaccttaaaaaattgttttaatggtaatgagtgtatacactcccctccacacttcgtattgtctttcactttgtccatataacaggaatcccaatatattgtgtccaaatttccctctagacaactccttgacagcagatcacaggcttaatttgattgtggaatacttctacggtagtttctgtatttcttggtgtcagagaccctttatattcttaaaaaatattgagaaccaaaagagctttcatttatatcagaggtcagcaaactgtagcctgcaagtcaaatacaaccagtatcttctttttgtaaatagctttttttggaacagagctactgccatttatttttgtatcatctatagctgttttctcactgtaacgacagagttgagtagtgacagagatcatacggttggccaagcctaaactatttacaatcttgtcctttacagaaaatgtttgctggcttctggtgtatgtggattatagctattgatttttagcacagtggaaactaaagctgaaaaattaaaatcaagaaatatactagcacacattccattagccatcagagctaatgttcaaaactccactgtataatcatgaatgagaatgaaaaaggcaaatagcatcttagtattattaagaaaatagttttgacctcatatgacaagctgaatggatttgatgaacacagtttgggaaccacttggatggtacatggcaaatagcagccgcttaatacatatttgaatgaataagtactaaccaaaaaaaaacagaaaatatttgcattgttatatattacagtttacaaataattttcatgtccatttctactttaggaaaatgtaaggaggcagaaatatcaaggaaaaggattttggtgtaggagatattagagcatgtaggctgagtagaaagacggccctagcctagtaaacagaattaaagacacacacacacacataaatgttaatttaaaatagaccatataaatgcacttaattgacttagtttagtatttggtaaaccacatagactacaaaatagtcccatagtaaaggaaatataatgtaataatctaataggtgggggaatagaagaggaatctttgaaacagcaaagcacagatctgcttcaaaagaaaatcgaaaatcttcaagcgaagattgcttgaggaaattttaaaatggaagacacagggtcatcaaaacaccaagggttcagtctaggtcctgctgctggctgcacagaaggccaatgactgagactgtgagagtattgccaaggaagtgcttcagtcgaggagatgggagttcagtctcaaatccatctccctgaatgactaaaattaggagtttctatagcagggaagaaatgtagaaagcaggaactctgaatggtaacgacacaatcctgatgaacgaggggcctggtgtttcattgtctggatgaaatgatctgctgagtttcagttctttgatactttttaagaggcctggggatcctttcctgagaaaggaactcaaacaaatacaagtttcaagctttaagaccagaagggtccatttctatgtttacccaagaacaagtctccgtgaaactattgggtccgtttcaacactaccttcaaaaaaattggggaaaactgtattcagtgtgtaattccactctagacatagcctgtatttgtacccttcaggttaaaaaaaaaaaaaaaggccatgtacatttttactcatcaaatgtaaccttgaaaaaatattcagtggttaaaattttatgttctgaatttctgtctaaataagatgaaaaatatgaaattccaagaaaaaatgtttttggtgttcagaaatggccaaaggtatttcaacacttcttttataatcagaagttaatttgagaaggggtgtggcatactaatatactattatactgtacctttccatgttttacttggtaaaaagtaattggatttggactaggatctatttattctcatcacatatttaattgcacgcaaatacatgctctatcataaattaacaacaacctaattgtggttaaacaatgtatgatttatgtttgagccgcgaattcaagtccttgttcaaagtctttatggcaaatgtctccttttacatatgtcacttgactataagctttattcctaggagagatatctaagtgctacacagtaaccaagcattcaattaaaataatgttttaaaaaaatgagatcagcaattatgaacctaaactcatctagaaacaatttgttctattacattatcgaaaacaaatgcaaacaaacttcagaaagccatggtgttttacctccttcaatattatattgacattatttgcacagcaggattagaaagtaatccctgtggagatattaagaaaatcatttatttttctgttagatacacaaatgggtgactgtgtattatacaatacataatggcttttaactgggagacataaaaattgaatatcactaccatgtgtgacatgtgaattttgatataatatttataaatattttagtagttaccatttaccagatgggagtgatgtgtgtctttgtgagcatgaaacatcttttttatgataatagtctacacttgagataattgattctgattttgcaatatggatgcaagttctctgtactatatacagtattcctagcttttagcaaatcaaataatcccaaacataaatacacatcaagatgaatgttagtaatccatttgactaatgaatattaaattgaaatgttttacctctgtgtctgctataatttgaaaccaaaaggctgaacaagcttgcatgtacatttctattatcaaatgtaaccttgaaaaaataactttaatattttaacatggagaaaatgacatggaagcccatgttctattagacataaagcattagactgttactgtctatatgaaggtggtaaactaacattcctccatattttgtaatctggaagaaatacctgctcaatctctgttaggaggtgagcagggaactttagccccaattttctttatccttttaggatcatttcctctcctctcagatctctattacctctatcatcacctttctgaaatgctatggatttatttaaagttacttagactagtctttatgtgagttctatagttgccacgagcaacaatacaaataaaacattacagggtcactctttccttttctactgattaacacaatggattatctggccagcgtcctgcttatgaattggtgtgtctgagaatgctatggcagtgattttataagtctttcaagcgagcatgtgtaattttagcatttcttgatgcatccttgaagaactgctctttggtgctttcaatcattttaatgaggtatcttagtttgatttacaaatttggtaaacatgacttggtgttgttatgtttagactttggttcttatttcatactgtgtgttgtaagagttctttttttttttaatactttatgttttagggtacatgtgcacaatgtgccagttagttacttatgtatacatgtgccatgttggtgtgctgcacccattaactcgtcatttggcattaggtatatctcctaatgctatccctcccccctccccccaccacacaacagtccccagagtgtgatgttccccttcctgtgtccgcgtgttctcattgtttttaaaattaatgtttttaaaattaaaaagttttctttaaaaactttttaaagaaaagtttttaaaattttcttttaaatttcttcttcaatccagtggtcattcaagagcatattgtttaatttccatgtgtttgtatagtttccaaaattcctcttgatatttacttctatttttattccattgtagtcagagaagatgcttgatattattttaatatttttgaccgtcttgagacttgtgacctaaaatctagtctattctttgagaatgatctgtgtgctgaggaaaagaatgtgtattctgtatctcttggataaagtggcctgtaaatatctattagatccatttggtctatcgtacagattaagtctgaggtttctttgttatttttgtgtctgaaagatctgttcaatgctgaaagtggggtgttgaattctccagctgttactgtattgggacctatctctctctttagctctaataatatttctgttatatatctgggcactccactgttgagtgtacatatatttaaaacttgttatatcctcctgctgaattgacccctttatcattatatagttaccttctttgtctcttcttataggttttgtcttgaaatgtatttttacaatataagtatagtgactcctgcttatatttccattgctatgaaatatatattttttcatacttttatttccagtctatgtgtgtctttacaggtaaagtgtgtctcttgtattcaacagatgcagatcgatcttgttttttcatccattcaaccagtctcagtttttttaatagggaaatttagttcatttacattcaatattattattgacaagtaagagcttaactcctgccatttttttaaatttgttttctgtttgtcttgtagtcttctcttccttctttcttttctccccttcttcctctactgaaagtgattttctatggtgatatgatttagtgtctttttttttaaacatagggagtttattcagtcctcaattattcccaaactccagatgaactgtctttttgaaactcagttacttacattaattcttcataattagtaccaaaagcaaaaatgttgcttcaagaaattctacgtgaaaatgtataatcttgtttcttggggcattttgtatcctaaaagctttcattgagcagcttcttcattgagcatatatgtccttccttcttctatgctacaaagccaaatagtttatactgaaaacatacttagccttgccctcaccagtagtatctttccaagttcaaaatcaaaggaatagttcaaagaaatatttgaagctctcttgcttcaactgcaatattcacatattgaaaatagcaataaatgtagtatttttgtttctcttggtactctgtttctctgtttcagtaactaaatgggttaattctgcttgctaaaaggcctcagattcttttcttcttaataactattccaaatggagaatgaacactgaaacaactgctttcccaacttatcttgattccaagatctgctctggtctcatcaagaagatttaggatatggatggtttatgtgagttgactcagagacagattatgatcttcctagtaactcctctcctcatttaatctaggctgtactagtaattgctttcaccacataatagaacaagttaattgcaaaattttgcttccacaggaactgtcaggtaaaattcactgatttaaagccagctgaaatctttttgtcagaaatgtactcacttttttctcaaaacatttaaattgtttaaatttaccaaatatatattttttcaacaagtaccatacattttccagaaataacaagatagtttatgacctgtatcatctttccacagttataattttacatatgcagaagtcggggttacaagcttatttgaggagctatttatgtctttcaatgtgcttctaatattattagattgttttatttccagaccacaagactcattactatttattccatatttagatgatgattagtttataagaatctaaatatcagttaatattagtttcgctagaaaaagtttaacattccagatgcagtcctttttcctacaaacaggtgcagcattacaagtaagctgcatttagatgcatgctctccagttctctgtggcaatgtaggccaagtgaagccagaaaaattattgcccaaggggaaacatttgtacttctcacttcattttgctaccttatcactaacaatatggtattcaaacaaacacatatatttatatttatagcttaattttttttttcctttagcaattctgacagctttgagttctcctcttgagggaatacataggaatatcatctctaattttattttctttttaacttattgcatttataccagctaaggactgtgaagacaaggtgaaagtgtaaataggcagggctgcagtaaaatgaataaggctccttaactggccttaatgcaatgcttctggagaagttactaccaaattgcagtgtttgcaactttacaaaaccccttaggaaaaatctaggtgtcatctctctaaatacgatggttagatttttaagaatgctgcatgatgctatgcttgtaaattcattatagtgatgtagcccagactctctctagggatcattaaacagcatgcattagggttttggtgctactgtacacaatttctaaacctgctattccataagttatttgttttacttgaaaggacttatggtatctgtgaccacaaaatatttgaagcatagtgattacaaagcagagacggcatgcctgcaatgctcaccatctactataggagagaacaaaaaccaagaaagcagtttttcctacaatgtggtagttatttacatcattaataaataacatttactggatgttgaactcatctatcttagttgtatatgaggaaatttcatatgcttactgaaaagggaaagtttatattttgtgttattctattatttagaaatgtttctaaaatttgggaagataaagtaatataattcgttcacaacaaccactcagtaatgtaggtcaaagtgtacatctccttttagatagtaggcagcttggcaggtgctgagaaatagtattttttctccttgcctagaagagccatctagaagcaaatgtgatctacatggaaaggcaagataaagataagacttagaagaaaaagatgaaaaacaaaaaaagtgggattacaggcatgagccaccatgccaggcctaatctttacttggaagaatgactgacagaaaaacagatcatttagatatgagtatctaaagatctgagagagcagatatcaaacatcaggtgtggtaagaaatgtggtagaggcaggcatttaggggatgtgtattagaaaagatgaggctgtagataagaagtcaaaaccaaaaagaattaaagccaggcatggtgttttacaccggtaatgtaagcactttggcaggccaaggctggaggatcatttgagcccaggagtttgagacaagcctaggcaatataataagaccccatatatacaaaaaataaaaataaaaaatacccaggaggggtaacacatacctgtagtcccagctacttggaagctgaggtgggagaatcgcttgaaccagggaggtagagggtgaaataagctgtgattgcaccactgcactccagcctgggcgacagagtaagactctgtctccgaaaaaaaataaaataataaaataaaaacaagtcaagaagctgaatataaaatcaggtaaagcagaagttcataaattcagccatcaacaacacaaggtctaattcttaaacctcattttgaattcaagaactcctttcacttagaaaattagtgtgggccctgtagaactttggtttttatgagctatacttattgatgtctgctgtatctgaaatttaatcttagaaaatgtgaaaatatgttattacttaaaatggtaatattaaattataaacctgttgcatggtaacataacattttcatgaggaataactatatttttcaaaataaatacaatatcatgagaagatactgctttacccttatacaaatctattttatgttatcttattagaagattctgcatccaatgtatttcagtacttggtttctgttgaacgacttgaggaaaatttagtgtcacaaagatgtgtagttggaaagggaggattttttacaataaccttcaaatatttataaatatcttctttgatactataccaaattcaacaagtagtttaagttttagttgcaatgtagaatctgaaatcatatcaacaaacttttcactttactaaattaaaatccgtaggtctactgtgctctttgaatgcatatttactcatgaatgattttgtaacaatgcattcgtcatttggaaaatgctggttcactgaatattgcagatcttgaaaatgctgacgtagtttattatataatatcaaatcccattgattaatatcaccactgatttaataaaaaaactttattgataatctattaagttgactgtggtagataaatttttcaaattctatttttgcttgaaattttgaaatttattaaattcaacaaggagtataattccgttttccttgaattaacaagcttaactcatttttgagaaaaatctgtcagatactcaaatctagattactagtttttctgtcagtcattcttccaagtaaagattaggccaggtgcggtggctcacacctgtaatcccagcattttggaggccaagacgggtggattattggaggtcaggagtttgagaccagcctgaaccacatggtgaaaccccgtctctgctaaaaatacaaaaaattagccaagcgtggtggcaggcgacgtaatcccagttactcaggaggctgaggcaggagaataacttgaacctgggaagaggaggttgcagtgagccaagatcatgccactgcactccaacctgggcgacagagtgagactctgtctctaatcatcatcatcatcatccacctttaaatacctatatgtgaatgggaacagtatgatcaggattgattgtagcctttcttgtgtcatgtcctacatagcaaatgatgaaaatttcagattgtgccactgcactccagcctgtgcaacagagcaagactctgtctcaaaaaaaaaaaaaaagaaagaaaaaaaaaagattgaatttgatgaagaaatctggctagaccagctcacattcccaaacaatcacacaagatgtctatgcctccttctcattttgtcacatagcgtagtattaaaaagctattctcaagggttaatgcttttttaaaaagtatcttttttactgctttaataaggacattcttaatgaaactggatttatgcatttgtctatttacttgtataataataaatttgtggctgttgagcactaactagtacagtccagtgccatggccttgattaggattaaagcaccaatagttttactgatcattgctctaatgacatcagtacaaatgtgcggacaaggaggataataatatctcagataatattgtgaaaatagtcctgacttgatggtcccctgaaaggtcttgaagactcccagggaccacataccacaccctgaaaaccactggaatagaggcactttgattgatttttctaaatgccatgtcttgaaactctttttattctcttggtttattttttggtttgtttttgatgctcatattcatacagagcagaagcagtagccctgtaacaatttcctgtctttactttttgagttccttaagatatagcattaaattgagttttaagttgctctttcattcatgaaatatctgtagagggcttaccatgtcctgtgcattgttttagaaacttgacaacacctctttgtaaacattattgttgacattggagtgggagttatctccctactttttattccttttggacatgtagatggggtacctgaccaaaaataaaaattttaaaaaaacatagtaaatataccatcctgctctctgccctcctccacccttctcaatctcctttacctccttttacactccctacgagtccaatggatatcaggtgcacacctggcagcaaccacacaattgagaagcaattttgttgttgttgcatgcatttttctttagagataatccctttgactatcatcctagacctctttatattcttccaagaaactcgcttcatcatttggttttcagcatgtatttgtttcacatatacaagctttgctctagtgtgtagtaatttaaggaatgcatttttattctgttaatctgttccataattatgatattcgacaatgtctcttccattttatggtcatagcccttctttctgaaccctgtttgatctatttttccacctggctcttcatttctagccccaacctcaaagctatttaggttttttacctccatttttgtcactagagaaatctatctcttcttaaactgttaaattcatgacttcttaatatctagttaaaattacagatttcatagccacctccttctccaagttggcctttattccctgggatgatgtgtctagctttcgtcttcatttctgtttataatttcaccttttattttaggttcaggggctacatatgcaggtttgttacatggtatatcgtgtgatgctgaactttggagtacagatgatcccaccatcctggtactgagtatatagtacctaataggtattttttgagtctttggcccccttcatctctcctccctctggcagtccccagtatgtattgtactcatctttatgtctatgtgtacccagtgtttagctcccttttgtaagtgagaacatgaagtatttggttttctgttcctgcattaatttgctaggataatggtctcccactgcattcatgttgctacaaagacataattttttatagctatgtaatatccctttgcttacagcttgatctcttcagaccttgcttttagttgcttatcaggtcttcccctttggtttagattcctacattcttggactcctgtgctcctctctctacctttgttttgtctaatccacctgcattcccactgtccacctcacgtattcataattcccctttctgggaagatgaagtgacgtgaattctttactcacccttccagcttagattgcactccagtttaaatatttcagtcagctctccacacaaaaaatacttgaaacaaagagagctcatttttattgtgtgccttacatgtatttagtcattacagtaacccaagatgtaggcgctatgctatttacaaaggaggaaactcagtcatagaaagattcccatgttcccattgatgagccctgaatcctaaggagacaatctgtcttcaaagccagcactttttgttaacacaatagagcctcccaccagtggtatccttttaaacatttaaaatgtaaagataccacttttccattttctctcactatgatcctgactttttatgtcacaagtcaatccatggccattttaagaaatggaatatgttgctaaacatatggaaactctttctgcttggctgacagctgagactttagccattgtcagtgttgcaaatagacaacctcttccttttctaattatgctgctgcttcctttggagccttgcctaaatttttgctgaagcattaggtagacacaaccaggtcaaactgcagaatctcaacccccagcacttctgctcctggcattttcccatggctcagtctttcacaaatactctaagaatggcagatctctgtgacagttttttcttgggcttctttgccataagcactcaatagctgctacatgatttaagttatatctcgctggcctctctatcactgtctttctcttcctttcctgctctttaatattttaaaatccccttctcctaggctgcatttgtgccttcaaataataaatatgaatttctttaaaataacaaaatgtctattttgataacataaagagatgtcttctacttcagatctctgtaattttaatatagctttattcttacatacacagctatactgatgaatttgttcccattaattttataatgacatatattccattccatacttagtctagtgtcataaataattatttcccaaggaatgtttattttatggaatggaatcaaataaaataatctgtttcatgacacaggacagttaagtggcaaacgaacaaatcgtgttccatttactttcttttttaaaaataaagtatactaaaatacttatataataatgatatatatgtttttattcagtagacagtattagcttcctgtgcatttgtgcattcagtgtatatgtatataatagatatatgcctttagaaaggattttcttatctccatgtcaacagtcaaaggacaaggtaataagtaatcaaatcccatcactttacacttatcttactagattttgctattgaagtaatttacatctatattgtgtctgaatggtgaaaataatggtatgttactgtgcatctcttccatttccacagtcattgatgtaacacaaacagctcgaaatcagtctttttggaagtgttcacaccacagaaatcaacaaacacaatcacacattcagggatttttttttttttttcacagagatctagttgctaattatttaccagcactcaactagttttaggcttgacttaatgtagagacacaagttaggctttcaattctctcctttctctactgccttcccttcctgccttgcttcctctacacatctctttctctcttcactcctcttctctatctcaattcattattgtttctactccatatgtatgtgtaccttattccctcctgctaaagaaaggctttctctatggggtgagagaaatggaagcaacaaacgatcatcatgaaatagagttccatgacctgaaaacttcttcaactccattttgcaaagtgcaaatcggaggccttggagtggcctttgattgttctaatacccacacctggaacaatgcctattgtcaagttaatgggtaactagattgatgagtctacatcattaccacctgagaatttaatgaagcgggctacggggatctggagtcacaccagaatgactctattttggagatagggtctttaaagaggagattaagtttaaatgacacagttaaggtaggcctaatctaatctgactggtggtctttataagaagagaaaatgtagacacatatagagacaccaggggtgtagctgggtataaggaagtccatgtgaggacactgtgagggagtggacatctgcaagccaaagagagaggtcttagaagtaactaaactcctgacaccttgatttgtatttttagcctccaaactgtgggaattaaatttctgttatctaagccactcagtgtgtatactctgttataagaggcttaataaactaatacacttgcattagctttccagggtatagagggctataagtatcctgtatatgccgcctaccatcaccatgccatttaccccagcactgaattgaaactggatgatgtcaattgatgatgatgaaaaagaggtgtttctgagtttgtattaggatgagatatcaagcttgaaagcatcttgagtactataatttacctatcagataggatacatcagcagatgcatttttccttagtacttgcctttatctgcagggcctggtttctcttctgggagatggtggaatgtattctttgacttggggatttataacagttggtacagaattctgcctggaatgcactctatttctaaggaaggaagtttgagaccatgcaatgagttagggagtgggaagaagcagttgtcaaaggcaggtaaaaggcatgacttggctaaaatatggagaaaaacatatcctataacaaaatagtaattttaataatttaaacagttgtgcttttctttgatagttacctcacattgtcagcttctagaaacattctcatctgcttaccccttcaactccatttttcaacttataacatcttttcttttagcttattaagcaatctttattatagtctaaaaatcacttatatttactttgatattaccaagacattataatctctaccttaatttattatttattatgtaagattggcttctaatatgaggctagatgattatttcaatggcataaagaaccaagactttttacaataatttgtacttattttccttgtttcattgctatgatttttaatgattgaaatttccagaaatctactttatcatgggttattacagtaaatttaattgcaagaagtaataaagcaattaaagattataatatattttatagctttctacttgagaagacagaattaatcacatgatatgccacaaatttaaatatctttaaaacaattatatttatggttctcagaacattgtgtgtttttcaaaaatgcatgttttatatttcatacaaatattcaaagttcactaatactattgaactattaaaagatctacaaagtttatcagcactaagaaatcattgtttttctagtaatatatattgatatgtttatagataaatacaatatataattataagtgaatctacactacatactggttctatttagatatacattgaaataaaatattttcataattcatattgtatgttataattattctctgttacacacctgaacaaatattcttataaaaatatgcattgtttcaggtattttattcattgtaaaactttttgtaaacaaatgttacatatttacctcttggtgatagttgaacatttttcatggatgttaataaacaatttattttggtagtgaacacaaacaggattgattgacatagatatggttttatttgcagtgttcatacataaacttagaagatcacagacattcattgtgagtattttacaaacccagattgtgtactatggtatcatgtttatttcttacccatatattttagtatttttcctcctaaggagctagccacttttaagaaatttcaagaaaggtgaatctgaattcccaaatgatagaaacagttcagttattttattacaatatagcaagctgctgcagatgtcagtgaccagttaaaaaggttgaaatgtagagctgttgaatcgagacccacaatgacccaagagcaatttacttccttcagatgattgggatgtgttcaaaaataccatttgagcaataaatttctggatatccagagactttaagtgagtcagttgtcttttgaaaattcttcatataatggctttattttaggcaccaataggaaggcattaaaatcatttcattgccacaggtgtgtgcatatgcacatgaaagtcaaacggtgagagaggagaggcagcaaacatgatcatttaattatagtcaagtttacttttaattagtattactgaaatatttttaatttgcagcttattaatctattgtttcaatagcaaatatccttaattatttcaaatcaggcttcatgatcatttaatgccatgtgatggtaatatgtacttgtgaattactgctagacctaaaatattaacaaatcagccaaatactttaaataaaaatttagcaattcaaaagtgcttgcttataagaaagtatgatttttttactcttgatggtaataagaataaataaatatgacatggtaatttgaccatttctatctcaccagaaaaacatttctattaaagcaatgaggcaaaggcaaatacagctcattcaaaatgcatagtaaatcattgagagggttcagtttatatttcattgtagttatttcttatcaggattacagaatttttagagtaatctagtcttcaatttaataaaacatataatagctttgaatagtttttccttcttctacataatcagatattaagaatctcaaaaatgtaattaagagataattatgtaggtaatgtttaacatgcaaaagaggcatatcaaacattagtatatctaaatttcagttaaagaaaagttgtgatgcatagcacttaaaacacttgttcaactttgtaatgaatcagtagtacaggtaaaacaaggaccaaactctaaatgccatgctttccattattataggtcataggagtacataatattgcctagtgaggccaaagtaacacctaagttcctgcctacagagaaagtatgtgaaaaagtgggtgaactttgtaacggtcattcacaaaacaggaatgaatcaaaaaatatgtactttctttgcaaaagaatgcagaaagactcctgagaccacctaaaaaattgcaagaaatcaattcgtaaatatttagagtccttttgttaagaaatttgtaaagagtggtaattatataattaggtctgtgcagaaggggaagaagcaggcctttggtcacaaatttaagttgcattaaaaacattattaaagtattcattacaggcacaatgataggcaaattaaagacaatctcgggtaagagatgaacacttgtgttttctctgtatgtggaggggggtgtatttgtggcatttaaggcaggatagagatgtgtaagggaggtatttgtctataaaaaatcatgttctattttactaggaattcctcatctttacctttttttctcagctgaatacatgctccagccagttccagtcttttcatctgtactgtctcctcttttccctttctgcctcttccagaagactgaatcattaataaactttctgcatcttcttccctactagctcctttccctcagataggctgaactgtcttccaccttaaaataaacaactccacgctgaagggaaactctttcttcaaatttaaattgcatgcttcactccattcacttcaattgtcttaaaatatgtgtccactttcacccatttctgcttcagtgaccccactctgaagctctttgatataatttcctcatcatcaaatgcaatgatttttttccacagtccttgttattagtaaactctcccaggccacagattccattaaccatgccctccttcttgaaagtccccatgtcctgggtttctacaccatttttcctgtagctcctcgtggcgcactctttgctgtaaccacactggaatattatgaagagccacactatttcacacctctttacctcagcacatactctttcttctgctaggaactttcattctcccatgttatgcctgaatttttacccttccttaaattttcagcttcattgttaattattttgtgattctcccttatgccttcctaccatgaacccaggaataatcaatcattctttctgttctgctgtaaattctttgtattttaatatgccagtgtttgcattttcttataatgtgcttggtctgctctgcaaggatatgaacttcttagaagcagaggcaaatccttgacatatagcacagactttggaatcacatagaccatgactcaagccttgttgatccacatttagctgagtgactatggacaagttgtttcagctcactaaccttcaggtcccttatctgtaacacgaccatcacaaagtatcagaaggattaaatgatataatatatgactcaggaagtgccaaagtggattattaaaggaatgtcaaataaataattgattaagacaatgaaactctaacatggatataaacacaataaatgtttgataaatttatattgaataaatagatgaattaattaatgagaggtatttcctttgtatgaagattttttgttttatcttttacactgactttctccaatctcatagaaaatttaaatcctcactgtcactccattaaaatagtattcatatttttatttctgtcatgcttatttgaaatgacattttatctcaccagaattttgactccataaaataaagacacatgacttcctttttttatttgccagagcctaccctgactcatagtagctatttaatataatttatatatttcaatggtagcattttattaaattagttaaaattatttttgagtgaatttaactcttacctgtcaatagtggcttaaagagcatataagtctgatgaattaacagtgaatttggaaaagaaaaccaaataccaaatggtcttacttgtaactgggagctaaacattgagtacacatgtacacaaacatgacaacaacagacaatgtggacttctagaggttggagggagggttgagggaaagggttgaaaaactacacatcgggtaccatgcctgcttcctgggtgatgatatctgtgcaccaaaccttagcatcatgcaacattcccatgtaacaaacctgcacatgtacccccatatctaaaatcaatttgaaattaaaaaaaaaaaaaagatgagaactgtgaacagatctgtggtgcaatgactccagagtgccagaggaccaaaattctttttttctttctttcttcatcatgtggcttcaccttatcatccctaaatacaaggggtggtctgggctacagactttattttgagtagccatatgcaaaaactcaaatttgagagtagagaactagtagtatgtgctataattaaaatcacacaaaatgtttgaattaatgtgctgtatttccctcatgctgaacaagacatttaatccaatagaagacttattactactttcttacatttaggagaaaacatataactgtcttctttttcccttctctgaattctgggctgaaaagatcactccaggggcagagacatttactgagaaagccatcaaaatatttgcttatctgtgcttgaggaacatagagtgatattcttataccacaatgagaacagctaatttaattatacatgtttcgaacactgcaatttctggagagaagttgtgatgtgtgtttgtgtgagtgaggatgtgtgtgtgtgtgtgtgtgtgtctgtgttttgaggatacttagccttaaattagaatctacgtaaacaagatgatatgaaagtcaggaaaagtaaactttaaatatatgttttaaaaaattacacaatagtaaagttttacgaacaagtgcaggataatatatttccaaataaaggtacacaagttttcaaaatttatctcaataaaaatgtattattaatgtaaataataaaaaaatttagaaaggggaaaattttttaaatgaagattgaaagtttatagtttatagaacaatgtcttatttttgccaatctctttgccataatgaaattgagtattctgcttagctcttacttcaaaatatccatttggaaaggaaataatattttgtgttttctacatctggtttaaaggataaaaattcaaatataaattatagtcaccaaactagttttattcaataaaagttctggcatatctgctattcccacttggaagctattctttataaaaagccattttgaaactataaccatacagaattaattgtaagccttttggatgtcccaaatctagcattgtgagactacttcttacagctacctagtgacagaatgacaaatgaatgtcctattcactgtagtgtaaagatgactgacttaatgagctgtgtcctacttgtcaattaagtttctacctctgtatgtcactttagagataaagcaattccctgaaaccacagtataaaggagagaaagatgtatatggtacctgtctttaccttaaaggcgaatagtcctgcacatcagataaaaaattatttgttattattactatatttattatttatatatgccatatgcatgtatattgtctactaatagattcaatcactttagatgaccatggtttcccatgttctttttgttatttgattctgcatatgacattgcttacttaattctagtcattcaaaatctatcactaatattgtaattccattttccagaaataaaacaaaattcatattccaatattgcaaatatacatactatacactagtgtaatggccttgggaatataggtcaaaggaaagtgataagttaatataaatagaaaaataaccattgttgtttataggatttttattaaacttaacacacacctttttagtcttaagaactgattacttcataagtataatatgaattatttttatctggaggtgaatttcctgactagaaataaatactatcttagagatcaatggagtacaagaaggtatataacattaatatttttctttctaattttaaatataggaaaggtgaaatgattgttttcactcattgtacaatgttaacagtctacttgaaggttgcatcatgtcacgcgatgtttcaggctttttccacttgaaatatatttacaattactaggaaaagcctcacgcaaaaaagatactttaaaaccattactgtaaaaagtggatgagtctttcctccaagctggaatttttttccaattatccttaattggttatctgtatctctactcctgtgttactggtttatttttaagacagctgggtctacagagagatccagtttcaagaactaaacaatagatttgattcttccttgttccttgcttttttcaccaacaatttacacgacatatttttctattatcatattttcattcctgtccttcttgtcctctgaatttctatacccactatctaatatcaggccattatttaccaaaactccacctcccattccagtcccttcgctccttaccattatgtttggtctttccattcttaacaagcaatatgcctaaatttaaacagtatactgaaagcctggagtttatccctctaatggcaactgcacctttggaaagcataatagggtcaaaaatacaagtaaatttgtgtgtgtttctgttgcatttttcaacactttttttccagaagatagtatgaaaatcattattgataatcagttgcaatcaaactatgaatttacttaaataaggctgtaccattagatttcacttaaggtttttccactggagtttaagttaaaggatatcactgttatgaagcaaaaacttctctcctgtgaatatcttacctgatgcattagagaagttatccaaaatgtcagcatttttcttcaacatcttgtacgtagttggttttatgtacggacattgttaacttctcaccattgcagggatacctttaagcattttgctttatggcacttcacagataccgaactttttttaaaaaattggaatcttgtggcaaccctgcagtgagcaagtctgtcagtacgttttaacaatgaacacgtgcttacttcatgtctctgtgttatattttggtagttctcagaatatttcaaacattttcattagtattatatatgttaaagggatctgtgatcagtgatatttgatactgttataattgttttgcagtgccattaaccacgcccatatgatagcaaactaaatcaatcagtgttgtctgtgttctaactgctccagcaatggattgttccattcccctcccgctcctcaagccttcctatttcttgagacaaaacaaggttgaaattgggccaattaacaatcctacaatgatctttaagtgttgaagtgagaggaagagtcatacatctctcacttttaatcaaaggctagaaataattaagcttagtgaggaaagagtgttgaaagccaaaataggctgaaatccagggctcttgcaccagttagcaaagttgtgaatgtacagggtgtgttggtgtgttcttaaaggaaatgaaaagtgttactccagtgaacccatggatgataaaaaagcaaaagtgccttgttgctgatatagagaaagttttagtggtctggatagaagaccaaagcagccacagcatttctttaagtcaaagccctaatgcagagcaagtccttaactcttcaattttatgaatgtgaaagaggtaaggaagctgcagaagaaaagttggaagctagcagaggttggctcctgaggttcacagaaagaagtcatcttcataacataaaactttaaggtgaagcaggaagttttcatgtagaagctgcagaatgttattgagaagatatagctaagatcattgatgaaggtggatatacccaacaacagatttccaatgtagataggacagcctgatattggataaacatgctatctaggactttcataaatcaaagcctggcttcaaaccttcaaagaacaggctgactctcttgttatgggctaatgaagctgttgactttaagttgaagccattgctcatttgccattctgaaaatcctagatcccttatgaattatgctaaatctattatgcctgtgttctataaatggaacaataaagcctggatgacagcacaactgtttatagcatggtttactgagtatcttaagcccacttttggagacatagtgttcagaaaacaaaattcctttcaaattatgtctgctaattgccaatgcaacctggtcaacctagacctctgatggagttgtatgaggagacttatgttgtcttcatacctactaacacaacattcattctgaagaactgagtagtaattttaactttcaatctaattatttaagaaatacttttcctaaggctaaagttgccatagacagtgattcctctgatggactgggacaaaatcgtgtggaaaggattcaccattctggatgccattcagaacattcatgattcatgggggaggtcaaaatatcaacatgaacagaaatttggaagttgatttcaaccatcatacatgacttttaagggttcaagtcttcagtagagaaagtaactacagatgtggatttgcaagagaattagaattttaagtggagcctgaagaagtgactgaattgctgcaatcttatgataaaattttaatgaatgaggagtttgtttgttttttttctttcttttgagacggagtctcacactttcgcccaggctggagtgcagtggtgcgatctcacctccctgcaagctccgactcccaggttcacgctattcttctacctcagcctcctgcgtagctgggactacaggcacccaccaccacacctggctaattttttgtatttttagtagagacggggtttcaccatgttagccaggatggtctcgatctcctgatcttgtaatccgcctgcctcagcctcccaaagtgctgggattacaggcgtgagcactgtgtctggccaggagctggtttttatgaaggaataaataagaggttttaagtttccatctcaggaaactattcttggtgaatatactttgaacattgttgaaatgacaacaaaggatttcaaatattgcataaactgatttgataaagcagtgaaagatttccagaggattgactccaattttgaaaatcctactacgggtaaaatgatatcaaacagcatcacattctacagagaaatcttttgtgaaagaaagaaagaatcaatgtggcaaacttcattttattcttattttaaaaaattgcctcagccccccaaccttcagcaaccagaactctgatcagttagcagccatcaacatcaagataaaatcctacaccagcaaaaatattatgactggctgaatgcacaatcattcacaatttatagcaataaagaattttttaaattaagatatgtgcattttgtagacataatgctattgttgatttgatagactatagtatagtataaacacaatgtttatattcactgggaaaccaaaaaattcatgtaattcactttattgtaatatttgctttatagctatattttggaattcaatccagaatatctttgaggtctgaccctattcttttattttaaataattaacaaaaagatccaaaatgaatttccccttcttccttgttatcttatagaaagttgctagactatgatttgtgaaaattatatcctcagattttttccttggattatatttccagattcaccttgtaaaaattcaaacaattctaggagacaatcatacacaaataagtttgaatgacaccttgattgaggagtagataccttaacaaagagaataaagggtttctttattctctttattagtgagaatagtgagaaagaaatgatctgctgatccacaactgaaatttcttcagatagcagcaacttgcctacctagagtagagtttctcagtcttgacacttgacagaaatttcttcattgtgggcatttgttctgtgcattgtagaatctttagcagcatttctggcttctgtccagtagatgccattagcacccctctagtcatcaccatcaaaaatatttttctattttggcaaatataggagggcaaagctgcctctagctgagaaccactgacaagaagaagaatggagtaataatcatatttagtacttcacaaatatcattttatgcaatacttacaacaaaccaaagaattgtctttttttttctggactaaggcccagagaagttaatttttaaattgaagattacagacttaacaagtggcaaacctcagaactcaacattataatttatactggaaaattctacagagttgaatagaacgtaagaggtgacaaataaacattgtgtccacctaacaattttgctgagggccagcaccggtcagctttctttttgttaacatcaattttacaaggctttgcttactcgagatgttggtctatgtatagaattttaaaagcgatttaattttattttctactttgtactcagagcttggattgtagttgttagactatgatttgtgaaagtgcttggaagccaggaaaaaggcagagttttgctattacaatgatagatttgatggcatttcaaagtaaatattgcctataaagagagtaagagtatacaaaacctgggagatcagctataaactgtcagcatttttcaccttttctcttgaaacttatctatgaaatgttaacttctgaaaattgcagttgaagactaaggtagaagttgaaaatgagaggaaaagtgattagtttatttatcctattcatttattcattcggtcaacaagtatgtaatttccatgagggtaaggacttgatttcattcctgttatgactgccatttcgcctgaaccctatacagtacctgaaaggcagttatcaatattaaatatttatcaaatgaaaaccagtgtgaaagcataagaacatgtttcttatcctttacgtatgtgagaaaatgtgctaagtacactaactttaaagagctaatagtttaggaaggtgtgtggggcagggagtagatgtgcataaagacacttaatgagataatataatatgttaagtttaaataaagttataaatatatgacagtaccaagcattttaagtctaagtaaatcaatccttccttacttattaatcctacccattttaagccaaagtctagattattaaattatggctctaccaactttaattgagcaggatttatcattactgtctacatctatattagttttctattgctggtaacaaattatcacaaacttaacaacttaaaagaataaccatttatcagctcacagttctgtgggtcataactcagaaaaagaagggacttttaaaggatggtaatattatgtcaggctcatccttaatctccctatcgaaaagtcacctgcaccatattatataacctaatcataggagtaaaatctatcaaacacccagttctgtgaattacgcaggggacacgcacactagtgcgaaggaaatcttggggctatctgagaattctatctaccaaagcaatcatctttttctcatgctgttttttctcatatggtcctcattgaccacgagactaggttaaccatagctgtcacagtacctactatgatcttgatcttaataatcaccatctttattgtcattgcttttttaaattttgtcttcctttttaagcgataggcatggtaatgtcagggactggtctggcttggttactactacatttctgacacctaacccttccctggactacacaaaatagatgttcaataaatatgtgatgaaggaagaaatgaaagcaaattcttattaaataagaagtaactaatcagactactctttaagttaatccttgttcctattgttcacattttagctccaattttaccttcccacctcattgaaatattgcaaatgtccaccctggctactccatggatcatcattctttttatttacttcctatctcttatcactttatataattatctctgttgcttatgtgagtacttccttattgtctgacgcccactatattataagaccccagaatttttctgtctcatttacccaagtatctccacggttttacctaacaccttgtctataatgggtgctcaataaatgctgaaaatatgaaggcctggcagaattgtcttacagggcatggataaaatttcatgtcccaaagggtactctggatatttaaaacctctcgacaagcatttcaggacctttctaacattttgggacaattgtttcaatcttaacaaagctatctgtaattttcactctaatttcatagtacatttacctcatattttgctacccccaaatcaaggatgttttatgcaaattaattgacaaacttaaggcaattatgaatgaaattcattaagggtttactataacgtgaaaattctaatttcatgatataaatttatttctctaacattcacttgggtgtaatcttttttttattttctacaaagtgaaaattgttttttgtatttggctttaataattgcttgtgttctgatttttaaacttctattagtcggcatgtttctgtgctgctccctgtgtttccctttggaaactcaaagtaaaaacaatatgaaatgtatcactatttgtaaagcactttaatcttcctagagcttcctgtgccatcaccaactataactccaagcatgtcatcctattcactttgtcaaatggaaagtaaaagttttctggtactttgcagcttgataaaatgtctcttagaaaataccttaatcagcataaatttcagttgttgtgcatacattttttataactaaatgttctaatgcagttttaggtatcctaaaatgtaattatttagatagtaactgcaagtaaataagtccttcattcattttcttttaaatcctgaaagctcagtgctctaaatactgctttggtagaaaatcattgacagctgcagactcctggcacttgagacggattgataaatgcacaacaacttttagaaaactccattcattatttaccagtaattatctcccactagctcttctctcggcacttacccatttagtctatcaactgattaatgctaaataactttctaagtctttgagcttaaaatagtaaatcttagaaactgtcttggagttatgcgttgtgcagaactttagagtttttctgtctgatgaaaaaagactgaattttcatttatcttttgatttaggcttttattttttacacttaactttgccaacatgtacatttctacatttttcctacacacatatcgtttgtccatagtgagttaattgccttttaaactccatcctcttaaatataattttgcactgtcctctttgtgctcctctctgtactgtacctaccacctttcattacagtccctatgaagttttgaaataatcacttattcacaccaccgactcctccagcagcctgtgaaaatacttaacctgttcccctagtttataaattcaggcaactagaatgacaaaagtggatatcaataaatgacaacggaaaatgtcccaatcaagattaaattacagcagcctgctcatctactcttcaaatactctgcagccctcattccaaattccacatcagcttttaaccagtagggtaagtacatatttgtgaagctttctctatgtagtattagtgtgtatcttcactttcatcatttttactgtactatgaaaaatatgtcttcattttatggttttgagaacatgtcgggaagtatagctgaaaattccgtgccacaggattttagagtggaggtttctaatagttttgctattgttaggtcaccatggaaggaacatcattgaagtcagtcagtgtagttatggtgccctgagatcatcgcactctcgatgttatttaactaagatctatgacctcaattagagtgaaaaggattcatctctcagctccacaggcttagcaaaagtctcagccattcagttcaaaggattaaataacccatgttagatggttacaattaagactagtaaatactgttttatttccatttagtaacagaatagacacgcctcaaggtgcttcccattaataagatgaataaaattaaacagttacataacgtgtctatccataaatcatttaaattcaactaaagtacctgactagcagtgttttacaataacaggcatagctgccatttgacataaacctgggttcactctgagccaagaacaagatcaacacattgaagactgtccttttcaaaagtctggcaaaagaaatttggattgttgaccaaaacttcttagtcacttcccatgggaaaagaagttcttttggaggacagtactgaatagcttggcatatgctgacacttcgttacagtcttttcaatagcagaatcatttccaggccaccagacacagtgaatgattcctgaatgtgctacatgtggtgtggccaagatgacagtactgccatctggaataataacaaaatttcttcaaaacagacatcctttatggaaggataactcatgcaggtcatgcatcaaggccttgatttcttttgacatttccccactggactttgcagtcacaagcaaaagcacatttatagcaacaaaatactactgcagatatgaactacataaaccacaccctattgccttttgtagccttccagatattaggaagggtatagcatccattgatacatagatactactactaggcctttccatctgatgtgaagaggttacattattgtttgtcatgggaaaagatacaagttcaccagtgacagggacaccatagactactgtgaagataatggtagtacctggataaacaaagacatcttatctcaacctgtatcacggaacataaattcagcagtttatggaaatattctgattgaaaatagcattgctttattgcctaactaacccgtctacctcccctcctggatccccaaaatttatttgatacagccaatagatttttttgttcttgctgtctttattaatgacttcattatccagtgattttcaaacattctactaaacctacaaaacttgtctttgtattaaatcaatatagaagctaaaggtataaaatctgtaggagattgttgtcttaactcgagtgaggtttgaggttccctgacaggatagattggtcccctttgtatataatccctggaattatttctacagaaccctagagcaccaattgtttattttcaaaaactcctgcctttactgtcataatatttacacagtcacttctctttctctagtttgaaagaaaccctgttataaacgtgaattcatcagatgatgttcagagatgatgtctaacaaatggatgttttggaataggttattgaagtaataaaatacaaggtcttttttactatttgtgatctattaaaatggcacaaatagttggacaaaaggaaatattcagaaggatgaaggaaacattcctgaaggaaaaatgtgaaaattaattgtattcttctgccagttgtcaacaagcacctttgtctataacttgcctaatctataaatatatgtgtaaaattttgtcattagacatacatatctgatccttgctatcatattcccttcaggctaaagtggtgtgtaaaattttctctagatgaagtatgttgtgactcaattcactcacagtttcactctttggccaatttgatatagagtacaaaaataagatcccgtgtgtttttcaaataagttgaatgactgaatgaatatttgtgccactgaataaatgggacgactgactgaataatatttcggccataaagcatatgtgttttacagtttgattatcaagaaacggcaaagcaaaaatactcttgtttgaaaatatgcaatacaaacaatgacactaacatgacagcttgcaaaaatacaaacatcgttatcatatactagtgatgaattatttttgtaaaagtgagtaaattaaaatgaaaaattaatttcagctatcactaatagtaaattgataaaaaatggagaagacatgtaagcagttattattcatttacagaaccaaaggcaagatagatttctttggttttcaaatcatggcctacctgaaaaactctcttggtccggcaccctgtgaatgatactgcacacatgttgaggatatttgggatagtgagaggaatattgtgaggaagtgttgtcagaacttcagtaggattttacagtccatcatcactcaaattgttgatacagacatagatggccttacttgttgcctctctgatacactcttacccacttatcagttgcttccttctctgtcatccgtatcacttcatacaaatctttagaagcttccatactgcttttggtattctgcttacctaacagcctctccctctccatcagattctattcagaggtaagtattcacttttgtgccttctttgccttgtcccatgcctaggaaataagtgtccaattggtgtcagcagactgagtaaacaatttttaataaagataattttaagaaccaaatggtgttgttagaaatcattgatgttatccttttttttttttcttctgagatggaggctcactctgtcacccaggctggagtgcagtggcacgatctcagctcactgcaaggtccgcctcccgggttcacgccattctcctgcctcagcctcccgagtagctgggactacaggcacccgccaccatgcccggctaattttttttttttttgtactttttaatagagacggttttcaccgtgttagccaggatggtctcgatctcctgacctcgtgatcctcccacctcggcctccccaagtgcggggattgtaggcgtgagccaccgctcccggccgatgttatcctctttttgatagctaactcacatattctctggcatatttaacattaccatagaatgctaacccctggcattctgttttttgaaacaaattaaacctgtagttaatggctcattcaatgaagcttttatgtccatcatattatcatgtcttccttcagtcttcctgtggatctttttgatggcttagtagtttaaatgatttttattacattttaagaaatttaagaataccgatactgtatttcttcttttacatagtaaatacatcatgtaaatgattccatttatcattaaaaatggttgttaaattttttattaataacatattggttattgcgctgcaataatttatcccattgtcttttataattattcaaagtaacagctatcctaagtggtagttgagcagtttattagcacaaagtcactgaaaaaaagtgctattgattctccttactgcaattaaggaaaccctttattcactagaatcaaggaagaaagctagagtgaaatatgtcaaacaccaccaagagcagtgtgctctgctgccacatctaatggcgataccacaattctaatcagagaagacagtgcagttccacacatacaaaactaagaatgctaatgctaatttagcttgagtactccagtcagtcaaaaatggtaattgagcaagtgattatggaacccctgaatgcagagagaagtttagctgtactattatttttttttttttttgcatgtcaagctttagagaacagtagttaatgtgttggtaaaaggctatcagtaaaatggatttttaacacttggttgctcaatggaaccttaaaaattcctatgatctgcattccagggtatctgtcgtactagatttgctattgtcctgtttgttgaagcttcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccattttcacagttggttgtactttggctcagaagagattttggtgtaggtgataggcaaatgatactgaaaggttttctttctttctttctttctttctttctttctttctttctttctttctttctgtctgtctgtctgtctgtctttctttctttctctttctttctttttttaatgtgcagttgacaagttaactatttcatagtctaatgtattgctattactccataaactttgaatatattaagacaatccacaatgtgctagttctactacttctttgaatagatatattctacaacagggttggttttgaatcatggggcttagctacacagaattttcatgggcagaattatttgaaaaacaaaatacccgtacccaccctttcacaccaacctcataacaaacctgaagcatattaagccttaggagatttggttccctaccagacgcagctaccagagattttggttattttgctcccatacatacgaatttatctattacaaaatatttgttctctaaagatttcattcttctgccaattcaaagttttattaaaacagattagtggaagattaaaatagaaacaagtaggctattctttctcctttaaaacaacaaaggcaatcagtatgttgacattatttgtgactagtttctaaattgtgccatctttatagtagtttgtattatgtcttttgataaattgtgtttgacatgtagatgaaagagcagaggaaaactacattttatgtagtgtgtgtgtgtgtgtgtgtgtgtaggataatgttttacaatgaaatctgtagaaacaccctattaatttcatgaactaacttctaaagaatatgtcaaaaataagttggcaggtacatcttagcatttatcaagagtaatattgccagaatatgtttctatttatattgcttaaaagatgcatgaaaaaaatctacttttttcaaacatggaaatgtaaataagggatttcaaattgtttgattttcttctaggtccctgtctatgacatctaaattacatattaggatgataagtatatacaattttctgtggcctctaaaggaaattacttttaattttgtataaatgtgagaacaatatgtgtttccttctgtgtgtccatctctgcctctttctctctttctttttgtatttataggggtaaatttttcatctgacagattaaaaacattagattacatcccgcttacagtaattacagcttactggtgatactgtcattagctgagcaattttaatgtctaatttatagcaatataacgagtgattaattcaagatgaaatttatcataaagtgtaatcacgatgaaatggataggtactcaatacagaagcttttagcagtcatatgtgaggcagtacccaaaaaacatttaaatagtttaaatttcaaaaatccagcagatgaggtccacatggatataatgagctgatcgaagttttctgtcaaaaataaccaaagcaactggtagttcggatggctcatgtataccttctatttgaaacaggcagagatcttagcccatctttgtgtccttggtgtccaaaacatggtagatctaacattcttttttaaaattaattaatgggggaatgaataaataacaactgagttaccctggcttataaagcccgacattatcccagctgaaaactattgactttcttttgcattattcaccacctcaaccacattcagccagagtgttcagctttcctttccttgatcatgccaatctctttcccacctatcacagcaatttctctccctataatcctcttcccctaaaagtagtcagagcatggttgtgtctttctcatcattcaagtctctcctattcaaagaagccttccagaccaccttaacttcaactatcattttctgaaatgtttgtgcattatatacttgaatattaactataagttgggtgcagtggcccatgcccatgatctcagcattttgggagaccaaggcagaactacatgaggccaggaattcaagaccagcctgagcaaccaatatagtgagaccccgtctccacaaaaaaattaaaaaaaaaaaatagccaggcttggtggttcatgcctgtattcctagctacttggaagactgaggcaggaggattgcttgagcccaggagctcaagtttgtggtgagctgtgatcgtgccactctactccagcatgggtgacagagtgagactctgtctctaaaaaagaacaaaaaaaccataatgtctataaactatatatataatatattaagtacattatacggacacacacacacacacacacacacactttctctctctctctcatttagaatgttcatcttcctcttccacaggagtttaagctccataaggacagcacttttgttattttattcacgttgaatgcagaacagggcttggcttacagtatttaggtgtttcataagaacgtagtgaataaatgaatactttggaagtgtttccaaaatttgttctcaagtgtatcacattgatcactcctattgaaaagaattaaacattataatgtgaataggtgagatatatgtttcagatatatatttattttagtttattttaaataaaaaagaaatacatagtgaacaacaggaattattttaaaaagcattaacagatggcattcaattattaaattatagttcatctttcatagtagagaaatatgaagttgttcaatgcttggaaattgttgtatgcattacatgtgataaaagaaaaaaatagcactaccaaggggcaggggaaaataatctttactagattttacagtttaaaattaggttgctgaaatgtatatggcaaaggtgtgtgtgtgtaattgtgcttatatattgtgtttataactttagtgacaggaaacaatataaaatcatatgaataacttgtgataacatcagcacataatgatccctttcttatctggtgttttattgtactattcaaaagtgctaaataaaaaattcttctaaacatttttttcattaagatggatggatatgtattttctccttctctccccctacaccccatttctctccctttttcattttttaaaacatgtattaggtaaacagaatgttggtagatagaaatatacagatagatagaaacaaaaagtcttctctcctggagttgcgatgcctggtttaacattctgacttggtcactaacttgttttgcttttttatttttttgttttataattgttaactatgttttatttactttttttttttaaaagaactaaataacttcaatggtcatttagccactgggattctctgattctttttttttctgttaatgtaacaagttaaaaggttaagtaaatctttaggcctcagattttttattttgttttggtttgttttgcatatgaaaattataacttaacctagaaggtccctaacatgatgcaattattattctattaaatacagttgagttaattgattacaatttgttttaagttagttaccagaagtttaaaaaccatgtcctggtatttatgccagctgtacattcagggttctctttggctatgacatcagggcagagtactgacactcatgagtcaaggagcagggaagagggtataggaagccaataatttagaaacttaatgacttacactccactttcgaaaccggcaaatattagaattttttttaactcaactttccaaggtaataattttaagttttcagagttcagtgacttagagacacattgcaacaaaatgtacaaaagtcttcttggctccatactgtgaaagacaggggaaagaatattgtctaatgttttctatggataaaatggttgcttaatttaaatgaaaatgttttttactaccttgaggggctctttttcctgtgagtttctttggtgtttcagagagagtaagtcctattcaattaaatgtatagtgaaatttgcgtataaaaagaaataaactctccaataaatctgtggtcaggtgtatgtgtgagtgtgtgtctgtgtgtgtgtttgtgcttatttgtgtacatataggttaaactttgcatttgagaagaaagtttctgaaattgatttagaataatttttatgtttattaacttatttttagtagagaaattacagcttgtttcatatcataattatgttaacaatttattaggataaaatgaaaatgtatgccaaacatcaacattactctttattaatatcaatttatgaacacatttatgaagaaagaatatatgaagaaagctgttcaaatgtaataaccaagaagacatataaatggcaattagttaaactgaaaactttccaatttcatcttagaaaaaggaaactagcaatatgaaaataacaaaaatcaagcttaatttatggaattctccatgaagaaaaatccttaattatatactgcatatttttggtaaggagaaatgtttttattctacctaaaatttttctagaattgtagaattaaatgatggaaattgaaaattaattatttggatgattaaaaataagaaaatcattattttaatttgaaaaaaaaatgttaatactcttctgcagggggcaaatccatgcaagtatatcttcaaagtcagaggaagccaagaggcttaaggaagaggtgaacatattgttctcagaaagaaacattttataggaaatttgaacagaagccatgcctgtgcctccagcaatgagacatgctggcacagctcagtgaccttaccccttggacccagggcttatataccatagggaaagaatgtgtaggacaattgcagggaaaggcaaaggtgctctgtgaatatgcctaagggcaggatttatggtcaaagctgttttgaaataatgcggtaatttttggtaagtacatgctcttactcaagaaacaaaagataaactggagatcttagaggcctttctagaactggagttaactagaagtcaacatggtggattagtacccaagatggaattgctttagcttccacagataccaacagaaaatatagtattataatagtattgagtataagaataaagaaattggactatgatagagctcaaatttcataaaatgaaaatttttttgtttggtttgattgtgcttctttggatcatatatcatgaaatatatttattattgtacttataatatcagtctgtaatcatttagatgtttagtttattaagctcttcaattctattatgtagtatagttttcacagactcatttactgaggtagaatagatcttattacttttattttaggaatgaggaaacagagatttagctaaatcaagtgtcttaaggaagcagcaaattgaaatgccaggatccagtcccagcattttcattctaacttcaactttttttttaatataaccacgattatatgtattttcaaaaaaatcatttaaatgttatattattaaaattggacttgaactcaccttgctccagtataaattctacattcaaatcttgatttttatgtctaggtttacattagataaataaaagataaaaatttagatacgcttctattgtcaaaagccttgtatatctaaagctaaaattacttctgatttcctatccataaaagagaggtagagggagggaaatcttgctgaatttgatactagtttaaacatcctctaattgaggtttttttgtttgtttgttttgttttgttttgagatggaatttcgcttttgttgcccaggctggagtgcaatggcatgatctcggctcaccgcaacttccacctcctgggttcaagcaattctcctgcctcagctacccgagtagctgagattacaggcatgtgccaccacacccggctaattttgtatttgtagtagagacggggtttcaccatgctggtcaggctggtctcgaacacctgacctcaggtgatccacctgcctcggcctcccaaagtgctgggattacaggtgtcagccactgcgcccggcctcctctaattcttattaaagagccctgtcctgaaacttctacttccccctattcttcttacactcaggaagagaaaggagcaggaactgataaagggacccttctcacttggaaaccctcaacctttgaatatccagattttctgctgcacatataattgatattgtcacaacatttgggctcttttgtagcagtctgtgactgatttcgtcttgttttactttatttactgtaacttcaaatgttgtagcgtcttccaattagtagcctcttcatgaagataggactgagtattttgcataagacattcattcaaaataaaatgaaagattaaattaactttattaaaatgaaatgattcggatagcatcctactcattagcctttagttcattttaaaacaaatataatattatcgtctatgctttcaaataaatgtcatacctccatctaattaatagtgataagcagttaagaaaaaataaaaattgggttcaatatgacttttacaacactattttaaacatccaaagagtactcaattattttcctactttccattacttttgaaagcgaagtattagatagcttttaaaaaattacaacatttgtatgtatgagtaaaggttagaatttaaagacagaagctacaaataatatttttcatcttttctatatgaaaagacaccagacccatttaatgcacgccatgagcgtttggggactttgacaagctgacttgtagatgtaaaaaatctaattaaaattgttgtcaattaagttacagtggtactcagataattgcatcactcttcaaagatttgtcttccaaacattaattttaagtatttcaaaccattttattttcttttttcaaaaactttctgatgcagacctggtgttttgttgttggtaattagtgtttacaatcattcacataattttttaaacatttgttttaggcagaattcaagtgtgtatccataaaatcagtaacattttgttttgtaattagaaaacaactggactttattagatgtaaatattgtttaaatttacggtgaaatttcgtgtgccaaggaactagaggtagcaactgaaggataattcatgaaactaaatattaactcaaaaggtttttttttttttttttttttttttttcccgagacggagtctcacactgttgcccgggtttggagcgcaatggcgcaatctcagcctactgcaacctctgcctcccgggtacacgcgattctccttgcctcagcctcctgagtagttggtattacaggcacacaccaccacacccggctaatttttttctatttttagtagagacggggtttcattatgttggccagactggtctcgaaatcctgacttcgtaatccacctgcctcagccttccaaagtggtgggattacaggcgtgagccacgtcgcccggccaaaagtattttttcataagcaaggttgtaaagttaaggttcaatacaacacatttggttgtgtaggagtgaacatctggaaatgtttaataaatataattttactgcatgttagaaaaatatagctaattcttttagaatattattttgaagaaaataataatatacatggtgtgcagatatggcacaatacatgggggtgggctgaattttgggaaacactgatttaatatcacatttattgtatagatgagggaactgagatccagagaaataaaatgaattattctaaatcatgcagttttaggatagttaattaaatttgaaagcaaataccatatctacctagaataaataaaaatgacttttttttgtcaataatcattaagcatttactgaagacttacaacatgtgtaaggtgttatgatggattaaaaaatgcttcccaactctattagttcaattgaggaaagttcttgctttaaggatatttgaactagcagagagcgcctttactggggcctggaaacatgtgggacactaaaatagcattcacggtcatacagtgttctcttcttaatacgctctcaattcaatctcctatataccaaatactataatattaaaattctaatatttttggctttttgctctgaagtcatttaatcctcaatttccagagtgatccctttgtaatgtttagaaatgtcaccttatatatttaaaattatgtattttgacagtgtggattctctgtttcgaacagcaaatttataaattatgaaattaaaaaaacccaattatcttttttttttattattttatttatttatttatttatttatttatttttgagatggagtctcgctctgtcgcccaggctggagtgcagtggcaccatctcggctcactgcaagctccgccccagcctccagagttcacaccattctcctgcctcagcctccagagtagctgggactacaggtgcctgccaccacacctggctaattttttgtatttttagtaaagacggggtttcaccgtgttaaccaggatgatctagatctcctaaccttgtggagacgcccacctcggcctcccaaagtgctaggattacaggcgtgagccaccgcacccggccaaaaacccaattttcttgattattactacagttcagctatatcagtgcacatcttatctaccaggaaaatgggtaaaatgcatcatctgagatctttatcaccagagattctgattcattagtttttatttttacaaaacccacagggagcagcagaacacacagggaggacagggtagagactaagaatttatagttttagcaagtagcaagctaattccaatgttggtggactgtaagccatgctttgagaaaaatttaatcataagttataaaatatagaagtgagaagtaaacatggttgaattgaattaatccctgaaaacatattgaactttattcagtgctattttaattgtattttttaaagtaaaggagaacatgttacttcaacatctatcaagagtgaattatggtttttatttgtgttttaaaatatcttggctgtgtacatttataagaaacaaaacaaatttttttaaaaaactctccattaaaagaacttcatgctaactctgggacctcaatctatgtatagagtctcaacaggaaacttaaatgacaaggaaatgagaaaaattttgccttcttattccttgttgaatcaaggcagagtccaaggttagtacactgcatctaaggtaggaaattgcttaagcagttttcaaaggttcattctgccttcaggcaaggattttctatttaaaagggataagtttagccaggagcaaaatattcctcattgttttttctctaaagacagaaaactctcagtaattttaacctccttgattgtatgtgtggagcaatatgaagctctgaagtaactttgtaactgtgctgagtccgtgaaggaggtacactagttgagtaatgaggatgagcgaggcatcatttatcaaaataatcttcaaaatcttgccttacttcacacacattcttatgtacaagataaagagaattaagttatccaggtcagcatcagcccaaatatacagtttgttcttttgttcttctacagtcagcataaccaggctacaatcaggatacctcccatccttatcagaatttcacaaagaagttcattagtgtgtcctgtcactctgaaaaccatatagtcctgcaaagtggtttgtaagtccatgttgatggatttatgccacacctttagggacaaagatcaagcatccttagctactttataatttggagaatgacttaagatttcaagattggggaggctttttatattttactctccttaagcttttaaatcctctgctcagtatatttacttcttctcagataagttttatagagttggagaccagaaaagaaaaaccgtctggtgtttcttgctccccaggtatttctaaacatttcaatagctttgctacaaatactcaatttgtaccattcaaaattaggacataaattcagaaatcggaggataaaaataaaggcaacatggcagttgtgattgatataactgggttaaattcttctacagagaagagtttttcaagaagcagttagatatctactttcacaggttgatttaaccaggatgtcacttgaacaaagaaaaattccttccctacattgtctgcattacattaattctccattaaaaatgtttattattcagtgtaggaggcggttttactcagtcatctttcaaatatctgcttcactcatctgttccaactgatggtgatagtagtttagaaaaagtatttttaaaaaacaaatatttgaaatcatttttatgtagcccagcagtacatttcatcgacttcaataaatttgatcttattgtttgtttagagtaatattggtgtctgttatttgttgataagtctggctagaggatggggagaaaagagagagtacctggatggtagtttgaactttaaaagtctctattattaagaagttcaagatgattttacttctgtaggatataccgcttgtttaagatttcgtggctcttttcaaaagcaaaacagtgacatctgttttatgatgcatatttgtaaatttcttatactgaatcacacttttttctttttatattcatgtattcttttagcaaatatttattgaattctttatttgcatgatatatagtgatagaaataatattccctgagctcaaagtttatcatttagagagatgacatccatacaaggaattagagaagatagcctttattgaatgtcataaatgaataggaaaatctctagcaagagttcaaatgaggatgaaatcatgtaagacaaaatcccatttatacaaacccgtgaggctatctaaattctgttggtatacaaaatgttatttcacgttttgctgctcaccaagctttgagggaaatggcatcattttaaattaattactcttgattagcataattatctggctttctagagctttatcttattttgacatcaaactgttaaaagcatatagaattgtatgtatattctattttcaatttcgtttaatgcaaatgtatatagacaaagactagaaaaaagatataaaatatggtgattttattttcaaaactgttaatgatactatctttctaagtatatatatttttaaaagtaggaggtatgagggtattgatactttgcctctcccaatcagggaagacagagtaaatactgatgtgactgacccttgtgaaggttgactgacaccaataaaatgacacccaaaatagtacttcttcataggcatcagactgagaaaggaaaaaatgaaataaagtaaatagtactacatctggcacatctaagcccacaataaacattagccctaataagtgctaagcagtcttctcaatgtatagccaggtggactagtagcagtgtatacccatacagctgacttcagagaatttcaaagcacctttgttctggaagtgttatcttctgccagagatcccatatacacttgcctgtaaggcaagggaaccattgtcatttttattcatagctttattcccagggcctaacttactatttaaaacaaagagactttcaattatatttaaaccaactaatcaatcatttattaatttaaaaatctcagtcacaaaaggaaaaataagctttaatcacattcaaatgtttcaacacaatgtgcaggagaagttaagtaaacatcatgcaatgtttctatgttaatttgttctacctggattagtggtgaaactcctcattacggaaagtcaagtatgcaactgttctttggccaagagcttttgaatctcatagtgctccgaattaatgaatccaattggaatccagtaggtaacttagcttaaatataagaataaaagaaaattgtgtatttataattttttttaccaaacagaaagttcaacacagttttgtatgtataaaaatccaaggaattttttgtccagttttggattcagaattttttacagaactcatgattctaggatgcaaacaggaaatcaggatctcaagtcaggctaactctgcaaactgtgtttattcccgttctgtgataatgtgaccttcccaaagcaactcaagattaagtagacaggtagggatgaaaatgaaatatttttggtggagcatttggaggagtattaagaactgcttgcacttgattacctattaacaactggtctttgaggggctttattttcctgtaaagatgatgcaaaagtttttcctctttatcttagatgtcttcaagagacagaatttaaatcataaacattctagtccataatattttttttctcagtgaacaaatttttttccaccttctgactagatatcaaatactaaagcttagtttcgacttttcttgtcacaaaggaaaaataatgaatgattataattatctgattttagctactgctgcagctgaaggcaactgaattttgaaattttgtcatataactgtatatcatagaaagtgtttgtttcgtttcaacatatttctaattcatatttaaggataccaattagtatctatatattctagagggataataaatatggccttttcaaaaaaacaaaaacaaataagaaaaaaacacaacaatttggccacagagatctttcttccttttttattttggacataattttgctcttttctgcccaggctggagtgcaatgacgctatcttggctggctacaacctctgcctcccgggttcaagtgattctactgcctcagcctcccaagtagcgtggattacaggcgcctgccaccactcccgggtagttttttgttttgttttgttttgttttagcttgagactgagtctcactctgtcgccccaggctggagtgcagtggcactatctcggctcactgaaacctctgcctcccgagttcaagcgattctcctgcctcagcctcccgagtagctgagattatagacatgagccaccatgccccgctaatttttgtatttttagtagaggaagggtttcgccaagttggccaggctggaatccaaagcctgacctcaggtgatccgcccacatcggcctcccacagtgcggggattacaggcgtgagccacccagctcggcctctttttttctttaacaataaaaatacactcactcattcaccaattcaatgttatagttctcagagctcgccacctgagttactcaaccctaaccaaattgtcattttcctggcttcttttctttcatgatgccatcttcacctcttgattttacatatataacatttacctgtcactttccaatacagaagctaagtacttggccaatcaaatccttcactgaatactagagggttctcaaggtggccatgtgagaattagtgcaatataaagacaaaagaaaaaatatttcgtctgcttccttttttttcctgacccaataattgatttgcattacaacacaagtcaaggtaaaaattctatatttatgattttatagttgtcaatagatcatatgacagtattgtgattagagaaatggaaggttgcagtgcttaataaaacaaccataatggctgctaaaaacttttgttatagttattaggtagaaaacattactttttaggtattgtttttattaaataggaaatgaatgttgagaaaaatattgtctttcaaataatgaggggaatgacagaattaatgtgatgttgaaatgttttatgaaatatatgttttgatgtgatatcctaataggtgtaggatcataagcaatacactttttaaaaagtattatacttttaaacatattgttttaaaaataaaattagataagtgatttaaatactgttactaaatagtatgttaggaattaattttctatacctttcaattttcattatgtgctggtaatattcttaggacacatatcatttagtaaggattagagccagctggggcagattatggctcaggaataatccttaaggaatgcccagattcaattattcctacttaaatgatttagtttggatgcatttggtggagtagagttttattttagaagaaaggtgatattttttgtctttagttctactcttgaaatagtctgccagattgatggagcctcatttagggctcatcagaagctgtgaacgctgcaatatggtttgattatagtgctaaatatcaagcaacagagacaagaataccatttagccaggtgtggtttacacatatttgaataaaaaatattttcctcagaacttaagataatttgttttgtacagaaagcatattttacagatcttaggaagcaagacttttaaataatgtaagactgtaaataattttagtaaaatatttttgattaaagaaacattactgaggcaatactggatagtcagtggctctctcattttttttttaatttcaaatgcctagaactatattaggggttttcagttagaaaaacactctgttaattaaaaatgagacattttatttactgtgaaatattttagacccttcatcacattaatatacatgcatacctcagagatactgtggcttcagttccagacctccacaataagtgaatattgcaataaaacaagtcacaaagatgtttggtgtcccagtgcatgtgcatataaaagttgtgtttaaagtatactgcaatctgttaattattcaatagcatatgtctaaaaaatgtacatattttaatttaaagtaaaacctttggtggttaaaaaatgctaacaaataatttgagccttcaacaagtacaaatctttttactggtggagagtcttgcctccatgttgaaggctgctgagtggtcacagtagtggttgctgaaggtcggggtggctgtggcaatttcttataataagacaacagtgaagtttgccacattgattgactcttcctttcacaaaagatttctctttagcatgtcatactgtttgatagcatttaaccacagttgaacttccgtaattacagtcagtcctctcaaactccatcactgccttatcaactcaatttatgtaatatttgaaatcctctattgtcatttcaacaagatttatagcatcttcactaggagtagattccacctcaagaaatcattttctttgctcatccataacaagtaactccttatctgttcaagttttaccatagtattaccacaacttagtcacatcttcaggctctgcttctaatgctcttgctgtttttatcacatccacagttattttctccactgaagtcttgaacttctcaaagtcatccatgagggttggaataaacttctcccaaactccttttaatgttgatattttgacctcctttcatgaaccatgaatgttctgagtgtcatctagaatggtgaatcctttccacaaggttttcaatttattttcccagattcatcagaggaatcactgtctatggtagctagagccttaagaaatacatttcttaaataatgagactgaaagttgaaattactccttgattcatagctcgtagaatggacgttgtgttagcaggcatgaaaacaatgtgagtcttcttgaatatctttagcggatgtcttgggtgaccaggcgcattgtcaatgagcagtcataatttgtaagttatactgttttctgaacacttggttttgaacagtgggtttaaaatattcagtaaaccatgctataaatggatgtgctgccatccaggctttgttgttccatttatagaacacatgaagaataggttagtataaatttactggatccaggattttcagaatggtaaataagcattgacttcagcttagggttgtcagtttcattagtccctaataagagagtcaacctcttctttgcaagtttgaagccaggcattgacttctcctctttagctatgaaagtcctagatggcgtgcttgtccagtataaggctgttatatctacactaaaaatcggtttagccacttcatctatgatcctagctagacctctggataatttactgcagcttctacatcagcacctgctgcttcactttatacttttgtgtcatggagatggcttctttccttaaaacccatgaaaccatttttgttatcttctgacttttcttttgcagctttcttacctctctcagccttcatagagttgaagagagttggggtcttgctctgcattaggttttgatttaagggaatgttgtggctcgtttgatcttctatccagatcactcaagccttctctatatcatcaacaagaatgtttggttttcttattatctgtggtgttcactggagtaacacatttaataaccttcaagaacctttcctctacaacacaacttggctaactattcggtgcaagaggcctagcttttgccctgtcttggcattcagcatgccttcctcttgaggcttaattgtgtctagttttgattttaaaataagggatgtgcagttcttcctttcacttgaattcttagaggccacggcaggacttttcactggcctaatttcaatattgttttgcctcagggaatagggaggcctattgaacattgaaactctgcctctttccagagtacaacaagttaactctagctacctgaagcctcctttaatgttcacttgaaggactaatggaattgagtggaagctcttctcaattaataataatgctatttaaaaatttcatgttgaatcagaatgtaatgctttatgtgaaaagaattactaagtatgtccatacagtgtcagttgagaaatgttctgagaatggtactatcaatgtagatgataagctggtgacatttggtctccccaaaaaaaaaaaatcgcatctaaaaggcaaagtgttttaaataaaggtgtataggattaattactgctgcacagtgttacagaaacaagctgaaaaacaggaacagattcttctttcctcttaaacaattcaaccatcaaaataaatttattgaaataaaaaaactgttaaaatttaagtaagttaaacttgatggttttgcctcttgtgtaatcactaatacgacatcttcagtccttgtcaggatagaactaatggagtacaacgtgttgtaaggctgtacttttatgaattaatgatctgaggtttgatggtaatgtttctactgtctttgtaggtttgatcttcctttgccactgctgacagagctaagcctgggggtgttctggttgcaacagcctttccttattgttgtttgattttgagaactcccatgttattgatacgtggagggaattgtaaaacttgttgtgaattaaagctaagcctcagattttttgtgtctggatttgaaattaactcagctctcacttgttcacattgctataaatatgcttagcattttttgtgaggaatatctaaagtgccaagaatgaaaagtgggctgccctgatggtacttttcatttcaaaatcaaacatattccttgcttttgtctgtgatgattctgttgtttaaagaacatgttcttacccccgtttttattgtttggggattctttgttgtaagatgactctcagaaattactttttgattgatagtcagttaaaacttctgatcagaatgaagttgtcttcttcaccactttcagttgtaattctggccaaaagcaaaggaactttgatttacttaatttgtgcacttggctaacatgccgtttatattagactgtttggaaatagcccaagtggtggctgtattgctctttgtgaacctgttatgggtatagtaactctcaagtaggaaccaactgtgttaaaatgttaacttccacatggtaatatactatttctttgttttttaagaaaattcaactgaattttaagctaaatgttcttaatgcaagatcaatatcttgattctcatggttttcttttataaattttggtttatttttaataaatgtggacttgcaattgcaattacaactttcagccctttctagtacaaaataatataataataataagcctcaagaggcctatttcctgaggcaaaacaatattggggaacagccagtgggtggagcagccagaaccagcacaacatttattagtcaattttgccatcttatataagcatggtttatataagcatggtttgatattacaatagtaatatcaaagatcacttagtatagatcaccacaatagatataatcatgaaaatatttgaaatattgcgagaatcaccaaatgtgacacaaaaacagcaagagaggagatgctggaaaaatgggcacaatagatttttagatgcagggttgccaaaaactttcagttagtaaaaaacacaatagccttgaagtgccataaaatgaaatataatgaaatgaggtatgcctctccctgtctccaagaaaaatatccaagaaagacctttatatttgaccagagaatctttaaatttgaaatatcttaccttgctattattattattttaaatttaattttatttaatttaattttatttatttgtatttattttttgagacggagtctcgctctttcgcccaggctggagcgcagcggagcgatttaggctcactgcaagctctgcctcccaggttcatgccattctcctgcctcagcctcccgagtagctgggactacaggtgcccgccaccacgtccggctaattttttgtatttttagtagagacggggtttcaccgtgttagccaggatggccttgaaaacctgacctcgtgatccacccgcctcggcctcccaaagtgctgggattataggcgtgagccaccacgactggcccttaccttgctattattttttgggggaaaaaaaaaactgttgaaatcactaatctaaatattattgcttcccttttacaattatctcctgtcttcaatttccttgctgtgtttaacataaataactctacatatgatttctgtaaaaggccacataaacccacagtactgttaatatggtgttttgtttttttgttcatattgttatcattattgctggttccttgtgctatttcccatcctggaggtctacactctcctgagagatggtaaagagagaaagcccagcaacataatgtctggatggctcagtatccttacataggacacccagagggtgccccaactcagcgtacctgattactgggtttatttttgcagagcttggtgcctggtgactagaaaagcagacattagaaatttgcatatctttgtttttgttttgttttgttttttatcagctctggattgaagaaagttggtagaagtagcagcaggtcagagaagttccttttaaggttctggccccagtacttatgtgcagaaatcatttgtgtcatgttcattgtgtcactcattgtgcacccctctcaagtgctttaaaatgtcttctccctagttagaatcaatggatcttgattctgatctctgcctctaattgcatgatggttttcatatcatggtgtcatcattagataatggtgctaggaccaggtctactgcaaagtagagtagaggaagcacagttttgacaaagatcttttcttaatcagatttcgcctgtgtattttggatgctttcactattgatgaaaagagaatattggcaaaatatgttcaaagtgcctcctgttttctttacctttttctctcttgctttcttaaaatctgattctgtccttaagttctggctgaactgtgcattttcaaattttctaactcattgtctttatttctttctgtcctcttttataccatgttctctcgctaataatagcttctcatttcatgcacacactgtttctatacatctgtttcctagtgcttaacacaaagaataatgcagagtaaaccatttatatatgttaactgaattaataaataaatgagtgtgatagtatctatgaaacctagagttcgaaggattatgatgcagcctatatggtgtatgatgaaccatctagcttaacttgttcaaagagagaagtttatgaaaagaattgttatttcatctttctcaactttctggtactcaaacgattatattgtatctattgtttaaaactgtcatttattctaattattaactccagaacacataataaatgtacttattagaaatacaacatcttagggtagaataaagggctcagaagaggtttttggggggtagtatttaatgatttaaatatttagtaagaaagtaattatttatataattatttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacatttttataatatgtttctcttgcaccctttatctagtagctgacaaccatatagtgatccacttatcagttctttttaatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaaaagtatttaagagaaagtaatttttaccgtttaagtattaaattttacctaaacttctattacgtgaatctcagtagatacgttcaccattataaagaagcagaagttctggccagggcaatcaggcaagagaaagaaataaagggtattcaaataggaagagaggaagtcaaattgtctctgtttgcagatgacatgattgtatatttagaaaaccccatccatcgtctcagcccagaaactccttaagctgataagcaacttcagcaaagtctcaggatccaaaatcaatgtgcaaaaatcacaggcattcctgtacaccaataatagacaaacagaaagtcaaatcatgagtcaactcccattcataattgctacaaagagaataaaatatctaggaatacaacttacacaggatgtgacagtccttttcaagaactacaaaccactgctcaaggaaatgagaggacgcaaacaaatggaaatatatcgcatgctcatggataagaagaattaatatcctgaaaatggccatactgcccaaagtaatttatagattcaatactattcccatcaagctaccactgactttcttcacagaattagaaaaaactactttaaatttcatatggaaccaaaaaagagcccatatagccaagacaatcctaagcaaaaagagcaaagctggaggcattgcactatctaacttcaaactatactacaaggctacagtaaccaaacagcatggtactggtaccaaaacagacatatagaccaatggaacagaacagaggcctcagaaataaagccacacatttacaaccgtctgatctttgacaaacctgacaaaaataggcaatggagaaaggattccctatttaataaatggtgttggtaaaactggctagccatatgcagaaagctgaaactggaccccatccttacaccttatacaaaaattaactcaagatgaattaaagacttaaacgaaaggcctaaacccataaaaaccctagaagaaaacctgggcaatatcattcaggacgtaggtgtgggcaaagatttcatgacaaaaacatctgaagcagttgcaacaaaagccaaaattgacaaataggatctaattaaactaaagagcatctgcacagcaaaatagactatcatcagagtgaacaggcaacctacagactgggacaaaatttttgcaatctatccatctgacaaaagtctagtatccagaatctacaaggaacttaaacaaatttacaagaaaaaacaaccccattgaaaagtgggtgaaggatatgaacagacacttttcaaaagaagatatttatgtggccaaaaaacatatgaaaaaaaaagctcatcatcattggtcattagagaaatgcaaatcaaaccacaatgagatgccatcacacgccagttagaatggcaatcattcaaaagtcaggaaacaacagatgctggagaggatgaggagaaataggaatgcttttacactgttggtgggagtgtaaattagttcaaccgttgtggaagatagtgcagtgattcctcaaggatatagaaccagaaataccttttgacccagcaatcccattactgggtatatacccaaaggcttttaagtcattctactataaagacacatgcacacgtatgtttactgcagcactattcacaatagcaaaaacttggaaccaaccaaaatgcccatcaatgatagactggataaagaaaatgtggcacatatacaccatggaatactatgcagccataaaataggatgagttcatgtcctttgcagggacatggatgaagctggaaaccatcattctcagcaaactaacacaggaacagaaaactaaattcctcatgttctcactcataagtggaagttgaacgataagaacacatggacacagggaggggaacatcacacaccaggggcctgttggggagtcgcgggggctaggggagggatagcattaggagaaatacctaatgtagatgatgggttgatgggtgcagcaaaccataatggcacgtgtatacctatgtaacaaacttgcacgttctgcacatatatcccagaactcaaactataagaaaaaaaagcagaagcaattaatagtgttgcaattaattttcagttttaaaaatgtataagtacctgttatgtgccaggcattgtattacacactaaagatacaaaagaaataagaatttagacatgatctccagatacaaatagcagactaagcaaagtagaaagagaagtcctggatgaaccacaaggttgtttatctgttctctaaataagaagtgtgaagtgttttggaaaagaaagggagaggttgccttccttttcactagtcatcaggttgtcacctagagctgagcagcatttttttttaagaaaattagcacatgtactgggtgaaaacagcctattttctattttaatgagctaggtacatagaaaggaagacgtaaaattttcctaaagtagaatcagtataggctgtaatgttttgcagccagaatctgggacagacttgcctatctgagaataaattgttacatcggcatcataagagtcataagtactgggggtgcagagtacagagcccacttattgagtcacacttgcacatataatgattttcagtctctgatatatgtaatgcataaatggccattaaagtcagatttttcaagggcagttctgtgtcaaatattctttcctgttttcttaaatattgcattaacatattgagagattcccattattttacctttgaaagtatgcctcttataatgtattttgcacccaaaagtatctctaaacagacacatatttaattatatttgattatgaaaatgtaatagctggtttttttttttgtttttgtttttgttttgagatggagttttgctcttgttgcccaggcttgtgtgcagtggcacgatcttggctcactgcaacctccgcctccagggttcaagcaattctcttgcctaagcctccctagtagctgggattacaggcacctgccaccacacccagctaatttttgtatttttagtagagatggagtttcaccatgttggcctggctggtcttggtttaaactattctgttaaaaaaaaattgagggaacttattctggggtaaatgatgttttcaaatacattgttttttgaaaaatttgttctgagagatatattttcttcattgttaaaaaaaattgagggaactttttctagggtaaatgatttcaaatacattgttttttgaaaaatttgttctgagagatatattttcttcattgttgtggaaatatattatgtaagctatattattatgtgtgagaataaagaatgtattttctctgaaaatgtggcagctcattctttgttcacagtgctggttaaagagattaggccacaaatattagccatcacattgttaatgcactcaaactgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctgtttaaaagatttcctactgtgccacagctggcacaggtgaaagaaattaagtaagaatgcagtagcacaagacatcatcacccactctgcttaattatagaagtcagaacttgaaaatgagatttatgaggataagttgaaatgcagataatatgtttcgggataatgtagagttgatgatgtgttattttggaatcttaaatttccaagttctgcataagtaaaggatgatggtatcataaatccaagtggaaaatggatccttcagtgtctaggccagtgagtttgatgtggacccagtaaacttttaaatttgataattaattacctagagtgtgggtactaagaaaataaataactacaagctagcaagtcttttggttacagctaggtcagctcaaggagctgtgtgaaaataatggtctttaatttttactaggcatttaacaaaaacatacattatatttttgtccacatggtagagaaatatggaccaaagtacattcataaggttgatcaaacctacccaaatagtgttcatataaatctagagagaaggtctcctttaccgtgttatggtggtcttcttttattagcttttccatgattggatgtttatttgcttattatttttcagtgactgaatatgatatttttaaggttctagatgatgatttagtgcttgcatttgtatgaatgtttagtgttatcttgaatggccaggaggatagactataaaccaagtaggtctacattttataagacaggggttttacatttgaagtttaatgttaaaaaataaataaataaactacaagtacagaatcctgagggtcccagcttgacaatatttcaaatggagaatattggtgattgcagtaatctggagcttaattaatagaaggatagattttaggcaaaaacaggtaatattcctactatgtactatattgctcagacttcatgatgagtacttaattatggggaacacgtttaaaagaacaattgtctaactgaaataaattcagcaaaataataagattgttgaaagttctcaaaatcttgttcagtgaaccgtgcttgatttactatccagattattcaaccagtctttattttatggtggccataagcctgtttccctcctgagaatcaagacttcttccactattaatccttgtatttagggtaaagttgactctacagtctgcttcttgggcaggtcaaggggagttcttgaaatagaattaagatcagtaaagatgcactgtacggccataattgctatttatggccagtgtccattctaactggcctgaacccagttagtttatatatgttatgttaaacctgtctcccatatttaagttaatcaatatattatatttgtcatgccacagggattaatactgtggttaatgagaattggctggggacattttctgtcttttccactaaactcagagttatgaagtcacaaagctgggactatcttaacattaaaatggataaatctgtgaggccaacatggggtagaatgtaagacaagttttgaagatggcaaaacaaggttctaaagatgtaatctgagcctctggtcataccaaacctgtagctggtagatctactccagtacatgggttaaagaaagaatgttttgcttaagccaaaacccaaagagcttgaattgacacatcatgtagaaaacatatatatatatatatatataaactgaaagatgtttagcttacaagaggtgagggaaaacaagttatataagcttatcagacttctcctcattatttagagagaatcaaaggctctatctgatgtaggaaggtagaattttcaggtagaccgaattgggatcaatgaaaaaggatgtacatcttcacaatttgagttaccagtaataaaacaagctgtcttctgtgcttaaaaaatattaaaatagagtgtagtttataaagactctcatattgagttgaaagttctactatctgttactcaaatccttagaatgtgttaactaactactgtgccagacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctccccatgtctctctaagttctctgcactaatttcaaagttaatgaaaaacaactatccatctctttaatactattcagattttaagcctgtgattttgtgtataaactattctcaatcatacaaaacagtgtacttttagagaaagggcaaagttcctattttgtttgttttaaaaaaaaagtaagttagaatgaatgggagttcatttttaagtcaacatctatttcccttttttgtcactctactttctttcagaatctttccatgccacttccagcaggacttacacgtgggtgccctggcttccttagttgcattgcagaatagttattgtaaacagaaaatctttcactgccaaatttgaacttggagtagggggtcttccctaatttgagaaagtcattcaagtgtgtaactatataggaaatgtattactttataagtttggagaggcttggaaatattgctggaacacaacgaaaaaaggaaatgaaatgaaacctcattaactctgtccctaattcttttgtaagcagatagcagttcccttgaaatggaaaactgggaaaaaggccacaaagaaattatatgattattctcctaagatcacataggaatgaagtacaacagttatgagcataagctaagatgatttaggatgctaaattttggctaagcaaacatatacacttttccagcttaggaagagattcacgtatccaacactacatcttctttacattttaatttttacttcatctgaaaaattgtaagttaaaaaaaagttgtagataatatataagaaaatacaaaacaagttcaaacccacacaattatttttcatatattctagttatttctcactgatcattttgttgaaaatacatgggatatatcaatgtcctgactgcatgaaaaagaatttcagtgaacatccctaaaagaaaagacgcatatccatcctttcttccccgtacccagcaaaatgagaacataaacatttagtccctaaaagttttcagttgccagaaaaacaaagaaatatagttacacatccatttttaaccatatatagaacctagctctgatagacttgaaacaaataacactatttttcccaatgatttctaaaagcagcaaaccatgaaatacaatttcattttcctctaatggtaatagaagatatttcatgttgctaccaaacatatactgtatattcttgtctcttcaaagtctattttttattagcttaaaaccctgagctgttaaatgtagcataaaacttctgtgaaattacactgctttgcatcaggggaaaagggtcttttaattggatgattgcagaagaggagagaaaaaggagagagccttcaaaagtttgggtagttcagattttaaaaatctggatgcttcagcaaaattgccaatcctctgagctttgattattattactaatgtagcgcttacagatactgtaaattagatcttgagcacattatgggccaaataccatccttttatactcatgtgtaacctttaacaggtttcaatgggaaatgtgcatggttactcgaaagcagttttcccattatttttctactctaaatctgatacaaaataaggcaattagaagaaacatgttaaaaaattaatagtaacaataactttaattttgtatagacttttccaattacaaagagttttacacaacataacattatagctgtatagtgaaataagtttgtgtatataaaatcatattaaagcatcttcaatatcaaaatttaacatcagtatatctgataaaagatgattgtttagatttatgtttgacagagtagcattttgaaaagaataaaattttgaattcaattctgttaaatggtcaaacacgttaattttaataataggagtaatttatactttatataatctataaacattattcttttataattgtttttagtttatatttttcttgtatgtttgtaaatctgtcttttgttttccctttatttgcttgtttgcatatttctttttcagttttccgaaaaaatttagctatattatgtttttatttttctggttcattgtcttggaaagtattcaccaggatacaggcttccaacaaggcatattctgaggaagcatcctaagtcattttcacaagtggttgaatttctgagaagtaatatcagtcttgagctacttccattatataacctaggataaaccctgtgcattctagttattcaacaggacttggtatttcctaagcctgtatcaagatgcattaactgatttaatagtcagagttctttaattgtttgttattttgttttattcatttacattttttacaaacaagaagaacactatgatcttcagatcttcagaccaaaaaataagcaaaaacaatgttgaatgctattgtgcaaaatgaaagccatcaataaacaatatttgctgtgggtttttgcttgtacctaagttgatgaaacaaaggatatctctacttttgtggaagagagagaacaataatagcaataaacataatgaataaacacattttatagcctgatggaagatgaagatggtaattcctatagataaagaacagggtcacaaagatcaggtttatggaggagagttgcttgtaattagtcctagccctcgtcaaggaggtgagggaatggtcaagaaattagatgggagaggagtgttctagagatggaggggaaaggatgtaaatttgaaaatgtgcctgatgactttcaggaccagctgaagggtaaatagtgaaaatagcagggaaaggtgaggttagagaaagatgggtaggaatacaatatgaaaggtcattgtcaactttaattcttatttaggtgtgaaaactctaacagactctgagtgacacaaagtggcttttaacaagatcattctggtttctcagtttacagcacattgcaggaagctaggggcagagacaatcatttaacgttttatctacttttttgtataaatttagggggtacgagtgcagttttgttacatgggcatattgtgtcacagcggaatctaggcttttaatttaccttcatcagaactgtatacattgtatccataagtaatttctcatctcctaccctcctctcaccttcccacccagtgtttgctatttcatactatatgtccatgtgtgcaatgatttagcttcctcttataagtgattacatgaagtatttcaatttctgtttctgagttatttcacttaagataatggcttccaggccaggcacggcggctcacgcctgtaatcccagcactttgggaggccgaggcgggtgaatcatgaggtcaggagatcgagaccatcctggctaacacggtgaaaccctatctctactaaaaatacaaaaaacaaattatccaggcgtggtggcatgtgcctgtagtcccagctacgccggaggctgaggcaggagaatggcatgaacctgggaggcggagcttgcagtgagacaagatcacggcactacactccagcctgggcgacagagtgagacttcgtctcaaaaaaaaaaaaaaaaaaaaaaaaagataatgccttacagtttcatccatattgctgctgcaaaagacatgatttcatgttttatgactgagtagtattcgtctgtgtgtgtgtgtatttcccattttctttatccagtcatctgttttagacacttaggttgatgccatatctttgctattgtgaagagtcctgctgcaaacgtgaatgcaggtatattttatacaataattttttttagcggggggattagataccccatagtgggatgctggattgaatggtagttctatctctagttatttgataaatctccatactgttttccatagatgttgtattaatttacattcacaccaaatgtgtataagcattcacttttctccacatccttgccaaaatctgttattttctaactttttagtaatagccattctgacttatgtaagatggctatcttgtggttttaattttcatttctcagatggtaagtggtgctgagcaatttttcatatgcttgttgttgcactgagttgcttgtagattctggatgttagtatttttcagttgcatagtttaaagatatgttcacccaatctgtaggttgtctatttactctatgattataacttttgctgtgcagaggctttttagtttaattcagtcatatttgtctagttttgttttggtttcatatgcttttgaggtcctagtcataaattatttacctaggccaatgtccaaaagagtttttcctaggttttcttctagaatatttatagtttcatttgatttttgtttttaattacgtttatgcagtgaatcacatttattgatttgtatatgttgaaccatccttgcattcctggagtaaaacccacttgatcatggtgtattttattttattttatgatgtgctgttggatacagtgttttgttgaggatatttgcatgtatgtttactagaaatactgatctatattatctttttgtgtgtgtgtgtgtgtgtgtccttgtcttgctttgtatcagggtgatattggcttggtataatgtgctggagaggattctttactgctcaattttcaagaacggttttaataggcctggtatcagttctttgtatgtttggtaggactcaagtatgaatccatctgttcctgggctttgtttgtttgtttatatatttgttagtacagatttaacctcactacttactattttggtgcaaaagtaattgtggttttgccattgaaagaaacagcagaaaccacaattacatttgcactaacctaatattctatttgggatttctatttcttccttctacatgcttgaaaagttacatatttctggaaattcattaatttcctctaagttttttagtttatgagtgtagagatattcatagtagtctctgaggatttttagcatttctctagtatcagttgtaatgtcttctttttcatttctgattgtgtctatttgaatcttctctcattgtttctcgcttaatgtagctagtggtctatcagttttgttcatcctttcaaataatttcttgtgttgttgattctttgtaatttttttggtttctttttcatttagtcctgctctgatctttgctatttgtcttctactagctatgaagacactttttagtttaagttccatttgtcttgttttgtttgtgttacatttgctttccaggtctcagtcataaattctttgcctaggccaatgaccagaacagtttttcctagattcttttctagtatttttatagttacaggtcttacatttaagtctttaatccatcttgagttatctttgtatatgtgagatgtaggggtccagttttatccttctagacatggcagtccaatattcccagtaccgtttattgaatagggtgtaattctcccaacatatgtttttgtcgactttgtcaaagagcagttgactgtaggtctatggcttcatttctggattctctgttctagtgatctatattttgatttttatctagtgacaaaaatctatgtgttgattttatttagtggttaacacatggatctatgtgttgatttttataccagtaccatgctattttggttactatacctcatagcatcatttgaagtcaggtaatgtgatgcctctagattttttctttttgcttaggatcgcttcggttattcaggctcctttctggttccatattaattttaggattttttttcctaattctgtgaaacattacattgtaattttaatgggaattgcattgaatcagaagactgctttagtcagtgtggtcattttaacgatactgattcttctgattcatgagcatgggatatttttcccatttgttcatgtcatctaatctgccatcttgaagggaaaaaaaaaacccacaacattttaaatgaataaaatgaaggctgaaataacaatgtgaactcaggcagatactatgtgggttcttaggtttttataaaattgcaaagtaagtaaattaatatccaatgctcctagattttccataaccttttttcttacttctcctgtgcacatttctctttgtcagacttaatcttagcaaaggattcaatacccacacattaagaatatttctttgactttttaatgagttacctgcattttaacctggaggaacccacaggaataaatttcaaatggttaaatgtcaagccttaaaaaccatgaataattatttttggctaggaataaaatttagatccgtggtgaaccccagtaatttctggctcttgggatttttaatgggaataatttattataaatgtttctctccatcagaaaattaaaaaattttaaaaggcacagtatttttgtttgaggcgagttgataagtctactaatttctctaaaaatgtcatcgaattattacacagaaacaagtagttgccaggcaagaatcaaggcattagagataaaatctgatttacataccgcacttctctctcctcaatgtgctcatagtataaattggaggcaataggtaagtaaacaatgggagggtgttggagagagatctatcatagagggaagtatctatgcttatgaccgtttatctaaacatcattctcatctttgattctgtttaatcatcactacgattcaactcaatgcagtttcttttcttatttctaagaatagtactatattctgtctgtcacacaggctctttcacctggaattgtcactaacctctctcttttcctcactttcaactttaaatttggttctagaataattccttggaatttaataaaagcatattcaattaaattgaatataatattaatgtatggccttttttcaaaattttttcttcatatcattttaatgactcctgtatactcataaaagtttaagtttcaaagcattagcttgtaattttttacacatacatacccaaatatgaagataattttaataccttatataaataaataataaaataaataaaatatatttattttcaataaatgtaaatattatcttgatatttattttgcactcacagttattactgatttaataacttgatatgaaacatccttgttttcagaagtgtactgtgagtttggatattgctgctttttattgccacaaaagagtacataagcatttagcagccagagcatgaagcccatagggtgactgtggcaacagagtttctaatataaagtcgatgtaaaagtatgcaggagagaaatagaagaaaaataagaaaaataattaggccagacctcaaaaataatgcttatataaattagatgtgataaagtgataggtaataaaacttcaagggccaaacaaattaagaaatgaatgatgtgaaatggaatcagctcaggggagcaatgacaatggatggaaccaaagaaagaatacatttatgaattacagagaaagaactttagattaatgaagaggagattttatcatatcaacagagcaattgagatgagtggtccataaagctttatgactttagcatgaattctggtggaaagaaatattatagtagatcatgttaatctaattttactatccttaaatgtaatggcttttaaaattgttagctgaacaattcaaggtggcaatttgctacatcaatataagcagtctcttgtgaccttttaggaatactgagctactgattagttaagtgacagtgatcctttttcaaaacaaatgctatatagagattttactaatttccctacttaattaagaaatgatatttatttcccctaaggacaaaaattttcaatggtactgacgatcatatattagatggtaaagtggattactgaaagttagtgccactctaattaaaaatttgattcatcccacccaagacagaaatggggactgaattttatatcccattgaataaattaattccacacacaagttttaagttcctaaagtctttaacttcagctgtggctctaaaaaaatcaacatgactctaatttataaaatataataacgttaaaattttcatatgattgtgaggatagagttaggtaataaactaaataactacattgtttaaaaatttacaaatgcataggagatctgtaaacattaaaatatgattgaatttttcaatagataattgttctgatgtttgaaatgttctggaagtgttcatatagaggagtatgctgtccaatatggtatttaccagctattgatggctactgagcacttcaaatgtagctcatttgatgaggaaattaattttttaattgtatttactttcaattaatttaaatttaaatactcatatggggctagaagctccaatattgggcaatgaaagtctagaactcacatcttaaatttgatttgattgttgaatacatcaagtttgtaattaatgtagctgctgggaggtattgctacaatcagacaatcagaggactcaaagtttgcaatagagatttaaggtaaactgtgagcaagacacttttagtgatgaatttctaattaatttattaatttcagtactgagttcgctctataattaagtcttaatatgcatattacttaaagttaattataaatactaattcttggttttatcaatcacaaatgggtgtagggggtagaaaatgtgaataaaaatattggagagttaatttatatactagtcttacactgagaggtgaatagtttatgtttggtacagattagctacatttagtcaaagcaaatattgtagaaaaataaacatagtgcctcttttgaatatgtaagtatttttagtgacaatttgattattcaaattgattatttgaaaatttgattatttgacaatttggattttagaaatctgtagacctgaagcttcccttgaaccaggattaattaaagacaatattgccaattaacaccagacagtataactggtgttcttgctgtgcttttatgtatgtgctctaggcagagcttttactagcttacacatctctacgcagatttttaagcctttcaagaattttgccacttctgagctgagctcagagccaaaggagagctgaattttagcactttggtggaagcagctttcatgcccctcaggcttatacttaaatctgtctttactctaggaaacttcatagagctctcttggcctctgtgcccctttagtttctaaactacaagggaacccagccctttcatccttaaaaaagacacttttaggactttacttatcatttatttatttatttttttagaggcagagtctcactctgtcacccaggctggagtgcagtggtgtgatcttggctcactgcaacctccacctcctgggttcaagcgattctcctgcctcagccacacgagtagctgggactacaggcacctccattaataactactaggactttaagccttttcccctagaacaaaatcctctggtgttttatttttccttgacttagattaatctcaattttacagtttactactcaaagtgttggccttggactagcagcatagcttcactctggagcttgttaggagtgcagaatatgaggccccacaccagacgtactcaacgagaatcaacatcttatgatccccaggtgtttcataggtacataaaagtttaagtactgtatgtagcacacttcttcttgtttgctccataagaatacaaaggtattttattaatggaatttgtttttatagtacttccttaaatgagccaaacttcatgatcatcaaccagtatatgccccgtttttccattccagatcattctttacattttatttattaacttttttaaaaaaattaagacaagtacaagaaagagccagacattcattcttcccttgtcttaatgtaaagtataagtgtgcatattcattgtctcatctgtcctgcactcctctcactttagcagcaactctgtagaggacaaggatcatttgtttctataggtaggtatttggtacctcttagaatattatctacctgtcctagaaaccatatagtccattccagttttaaatttttttttgagacagatattcgctcttgtttcccaggctgtagtgcaatggcgcgatcttggctcacttcaacctccaccttccaggttcaagcaattctcctgcctcagtcccccgagtagctgggattacaggcatgtgccaccacacctggctaattttgtatttttagtagagatgggtttctccatgcttgtcaggctggtcttgaactcctgacctcagttgatccgcctgcttcagcctcccaaagtgttgggaatacaggcatgagcccccacacctggccttaaaatgttttctttaaaaacttaaattttcagctgggcacggtggctcatacctgtaatccaagcactttgggaggccgacatgggcagatcacctgaggttaggagttcgagaccagcctgaccaacatggtgaatccctgtctctacaaaaacacaaaaattagctggatgtgttagggtgcgcttacaatcccagctactcaggaggctgaggcaggagaatcgcttgaatccgggaggcagaggttgcagtgagccgagactatggcactgtactccagcctgggcaacaagagggaaactccatctcaaacaaaacaaaacaaaaacttgattttccttattatctaaaaacacagtaagtttttcatgaaaatctcagtgctaagcattgtgagattcactagctattctcatgcagatcttaatgtagggactaatgtctatcagatgcattcctaatctgattttgttaatagtttttttattgacagtaattcatcagagataagtactagtttccttttacatgtaaaatattcagtataattgtattgattgaattatagcatcaactattttaacaataaattattcctactctacacatccactgagtacacattatgagtaacattatggtaactgctgaaatatagaagtaaaaattagagttcttattttgtagtagcacaaagacactgaaaagcaagatagagctttcttagaaaaatattagcgttaaaaatgtgaccattacttgtcgtgaacctgggaggcggagcttgcagtgagtcgacatcgtgccactgcactccagtccggacgacagagcaagactccatctcaaaaaaaaaaaaaaaaaaagcagccattactaaacaaaaaatatgaaaaaaaagtactaacaggtagcacactttgctagattcaaaataaattttatagtatctgattctaaacagcatgttatagatgaattcttaaagagaatagttatataaaaaattctaatttattttggaaaattaaatttctgtcaaaacctgtaatatttatgaacagacatacttttcttttagcacgtcaacagagttgttaggttgtcttaatccttcactggctacctgcactttcccttcaattcgtcaggcacctttgaggctgtccttatatcttcatcaattgtcttcaacaaaatggatgagactatgaatagaagctcattgtcatgaaagtgatatgagaaataaatttgctgagtaaaagattataaattcacattaattgattgttcaattttcttgaaaactgatgattattctgattttaatatgtttggcagattttaaattatatacttgtttttcaaaatagagcttggtaagagtgatataccttatcatatctttaaaagaattattttttattttaagtaattagtgtcctaatctagccatatatacaagaattcagataaaaagtttactggttgaattaatctacactatcatagaactgtgaaaacatgcaataaagttagtttttttctttttttttttcaagaaatgctttagcaaaccaaaacttgttttgcgatagccatctctcctatatatctctaataaaagagcactttttcacatatttttaagtagctattccattataaacaccttccctcaatttgaaatcaattaatattttaaatactggagaaaaggcaaatctaatatatatcttctaaaatattttttacatagtagcaaaacctctgattatggctttaattttaaaccactcccatttgcctaacgctgtcctgattccaggattgaaatttccacattctaggaaactcctcagttgcagggatacttggatgattggtcaccatcatgtaccattttattgccttaatattttaatattcaaagtgtaaaaatgtgtcttatacaggaattcagagctccttgggatgtctatagtgataactttaacattatttgctaatgccttctgttattttaaaacccattaattaagcacctatttttaaagcattttttatgttaaaaatttcaatagatcatgctctatgtccttaaggaactcatagcttaaccaaagagcaaggcatacaaaataataaattataaatatgaggttggaattgttaaaagaaagcaaatttcttctaaacacagaagacttagacacttactttacctaggagaaattaaggaagtcctccattagtcctaattaaagaagttgtggtattttaggagaaacaggagttaaccaaaagagaggaaaggaggaaaggatttccaggcttggtggtatgaaaatgaaggctgtactcagtgtttggtgagaaatttaaagccattataatataggatggatgatgtggacataatcatttggaagagcattgatgaccagaattgagcaataggatttaccctataggagtggtttgaaaaaaataaaaataaaaaaaaaaagtaaatgctcaggacttaatcagaatcacctgggaagattttacaattacagactgctgcaccacttccagcccaatcccccagagaacctgctgagcagatctgaggtgccaattacttcagttcatatatttgtaatgatcttcataggattacgatgtctgtggagatttagaacctccagatttcccatagagagccaatagtggtaattaagcatttgatttacatgattttatttgatttaaaaaataattctagaacatttttgtagagacagtaggccactaagatttctttgaatgatgcagttgagagataaggaactgtactgaggctttgtcaagggaggagaaggtagtgctaaatacaatgagaattttcaaaagttgagtacaatctattttttcagagtgtggctgccatttggtatccttgggggactggttttaggacctcttttcatacaccaaaatttacagatgcttgagtccctgatataaaatggtgtggcacttgcatataacctatgcatatactcctgtatactttaaatcatctctagctcacttataatacttaatacaatgttggtgtcatgtgaatagttgtcataatgtattatttagggaataatgacaagaaaaagtctgtacatgttcagtacaaacacaattaaaaaaatattttccatctatgaattcatggatatggaggaccaactccatatgttttacgaatatttgttatactagtttctgatacagttgatatagtttgaatagagtacaaatactgcacgttgaatatcagtatataataggacaaataatgagactatttttctcatgttttccactgtatctgtttatttcttttttcattattggattgattcatccacatagtaagtaatttttaactgcccaccatgtgccgaacagtgctaactagatgaagtattcatttattgttttttggaaaggattgaaagcaactttaattaaaatacaaattattgtatttagtattcatttataataaaaatggtatattttcaaaaggaccatacatttcatacaggtattgacattaaagtgttctacttaccttttctttgcgaagaatttagaggggcatttataatataaattgttaccacttttctgaaggacaacttacctgtgtaacaaaaacacttaaagtgtgcaacacatagtggatatttatttctgcaggtagttaggtataacagttgctgaagtagtattcttaccacgtgtatgctgtattgttggactgccatgataaaacaaatactatgtcatttgtgcatatcttttttttttaacaaaacaaatttatacagggattttaggaccacaaaacaattgctggtgtgtcatgaagaaaatatattgtggaaataatatgttccatctgtggttttcttttttaaatgtaccaccttaatacagaactgcatctctaaatcaaataaccttaagcaataaatagagacttgctttcaagtattggcaaataaatgccttttttttttttacaagaacaattttttcctagttgttcatgtgaatttaggataaaaacatgcagcaacaataaatcccttgtggtattaattcttaaggtttatcacaaatagtattagagataacaaaatatagtcaacacaagcttccagtttttcctgtttatggcttaataataatttggacataaagatgcctactttatcagcatgttattggcccatattttatatttggggaatgataagaattttttcataaataatagaagataatatttttatgttatcatgtctgtcatgtactttactatattattgctgaagacaaaacactttcttgaagaagttttatttaatctatacaggatattatatttcagtcttcttaggttttccaaagtaaaatgaaacaatttttacatttctacaaggatatatgagcttttaacttcgtaaaagagaagggtatactacacatgatgttcatctgttcagcagcaaaaaggtcaagaagctaaacaaatatgccctcaagtctgaaagtgaaaaatagatcttgtaagcaagagagacactaaggtattacattagagataggtagcattttggaaccttagctgcaacacactatttgtaaaatgtatttcccatacgtcctgatggtaattgttatgcattttagttacacagatagtgttttgatatgtacagaaaaaaaatgtttatcatttaaaagataccttattccataatatatataaagaaagttgttattatagtcattaccaggtacaaatcagcaaaaaacacttatgtcaatagagtttcaagaagtactttaatatgaaatgttttaacattattctgatttttaaaaattgatacatttgttgagtggtatttaaattttgtgatattatttaattgtagaggcaatgagttatagagatgtcgaaaacaaactctttaagaattgtgaatatacaactatgatttcttaaagtttgagactttataaaagcagtggttccaaaaaaagtgcataaatacacatttacacgtatgtttacacataacttggtgggaatcacagatgagttgtaatttacccatgacatcaataaatacattgtatcttatccatgacaccaatttggaacctagaatagaaacttctataaaagtatagaagatttgttttacttccttatatacaagtagagtattgatcctaattttgatttattaaagaggataactttgtggtttaagattatattttgatggtgaataatcatcaatattaataaaataaatgaaaatatgaatcttgactttaaaatttctgtacttctcataaaacttctgagtatgtatgaaaaaatgtttggtttttcatgataaaagttttgtgaatatcaagtttgaaatatattacagacatttgctactttgtctcctcaccttggttctgtgaaagaatcatctggaaaataacttggaaagtttaccttcctagtataaggaggggaatagtgaaatacgacaattagaaaacttgtgttttattgctattctgggcactaactattattattattgttacgtttttgtctgataacaacctacattttttccagatctccatctatgcattcacaaggcacacatgtctttcaagattatcctaaatataacttttatctgaactccctctgttttatatttcactttcattcttcaagagaccaatttcctgcatgaacttgtcctagatgaagctcattttcataaatgttattttcttttgtaattagactgtatacgggcatctaatcactagcaaaactgcagcacttgaaaaccaagattatactgtagcatttgactagctttagaaaatatagtagatttttattggataatgaataacttactggttgagagagaaaattgtctgtatgttaacaaaaaagaagtataaaacgaagaaacgtttcactaagtcactcagtataccagagacaataaataaagtgaaacgactcaaattctataaaaggaaattcctcttccctcacaaaaaatgactactattttttcaaacattcattagaagtggatagtacgttctacttgtaagtacagaattattttaaaaattataattagcaagtctgctagtcattcatagcatactgcatttgaacagtgtttgaaaagcagaaatggtttggtccaaaatatattgtagttaatatacatgtgaattacattagttttattaaaacaacaatgaattaacatttgcaaatcgatctttggtttattttagcatccaaatatgtgttgtattttctatccactttgcattaaacaattgtacatatttaataatgtataaagagataaaatgtaaacatattttccccaatgttaaacagtcatgcattagattgtgcatggacatttttactcaatagtctattgggtaaaatgcttggtaattatttccttagctatatgcagactttataaaagtgtaaatttccctcttatactatgtttttaacactttaaaagaaacatatatctatgttcttcaaatattatttctctaatctttggaaatataatttttttacttttatttctggtttggagtgtaagtgcaggtttgttacataggtaaacttgtgtcatgggggactgttgtacagattatttcatcaccccggtattaagcctagtaatcattagttacttttcctgatcctctcccttctcccacccaccgcattctgataggccctagtgtatgttgttcccctgtatgtgtttgtgtgttcttatcatttagttcccacttgtaagtgtgaacatgcagtatttgattttctgttcctatattagtttgctaaggataattgcctccagcttatccatgttcttgcaaaagacacggtctcattctttttttatggctgcatagtattctatggtatatctgaactacatttttttaaatccagtctatcattgatgggtgtttgtgttgattctatgtctttgctattataagtagtgctgctatgaatatgtgtacatgagtctttaaaatagaatgatttatattcctttgcatatgtattagtctatcttcatgttgctataaagaacttccccagactgggtaatataaaggaaacagattcaattgactcacagtccagcatggctgaagagtccccatgaaacttacaatcatggccgaagttgaaggggaagcaaggcacctcttcgcaaggtggcaggaaggagtagtgctgagcgaagggggaagagtcccttattaaaccatcagatctcatgagaacttactcagaataatgagaacagcaagggggaaaccgcccccattattcagttatcttcacttggtctctcccttgacacatggggattatgtcctattagccttattctaatgcctaacagcatagattagttctaccatttttgttgtttcaaaacatctagatgtctatgctgttagacattagaatagggcttacttggggcaagtataatgactggaaggcacaaagagcctcaaggatggtcaaatgttctggtttttcatctgggtgctggctatgctagtgtacttattttgtgaaaatactattagctttacaatatgaattttaaaattgtactttggggattatgggaattgcaattcaagatgaggttttgggtgagaacacaaagcctaaccatatcagggtagtacccagaaatgggattgctgggccaaatgttatttctgcttttagatttttgagggatcaacccactactcttttccataacagtggaactaatttacactcccacctacaatgtataagtgttcctttactgcatagcgtggccagcatctgttatttctgactttttaatagtagccattctgtctggtgtgagatggtatctcattctggttttgatttgcatttctctaatgatcagtgatgttcagcgttttttcatatgattgttggccacatgtatgtcttcttatgaaacgtatctgtttatgtcctttgcccaatttttaatggggttatttgtttttatttttggtaactttgtttaagtttcttatagatgctggatattagacctttatcagatgcatactttgcaaatattttctcccattctataacttatttgctcactctcttaatagttttctttgcgatgcgtaaactctttagtgtaattagatcccatttgtcaattttagcttttgttgcaactgcttttggtgtctttgtcgtgaaatttttcctgtgcctatgtcctaaatggtattgcctaagctgtctttaagagtgtttatagtgttgtgttttacatttaagactttaatacataatgagttaatttttatacatggtataaggaagggttccagtttcaatattctgcatatggctagccagttatcccaatttattattttgaagctagaaaacgatcattgtctctgtaattttagagaaaccgacactgtttttaaattatactttaagatttagggtatatgtgcacaacttaaaggttagttacatatgtatacacgtgccatgttggtgtgctgaacccattaactcgtcatttaacattaggtatatctcctaatgctatgcctccccccagcccccaccccacaacaggccctcgtgtgtgatgttccccttcctgtgtccatgtgttctcattattcaattcccacctatgagtgagaacatgtggtgtttggttttttgtccttgtgatagtttgctgagaatgctggtttccagcttcatccatgtccctacaaaggatatgaactcgtcattttttatagctgcatagtattccatggtgtatatgtgccacattttcttaatccagtctatcattgttggacatttgggttggttccaagttttgctgttgtgaatagtgccgcaataaacatagctgtgtgtgtgtgtctttatagcagcatgatttataatcctttgggtatatacccagtaatgggatggctgggtcaaatggtaattctagttcttagatccctgaagaatcgccacactgacttccacaatggttgaactagttaacagtcccaccaacagtgtaaaagtgttcctatttctccacatcctctccagcacctgttgtttcctgacattttaatgatcaccattctaactggtgtgagatggtatctcattgtggttttgatttgcatttctctgaccagtgatgatgagcattttttcatgtgtcttttggcggaataaatgtcttcttttgagaagtgtctgttcatatccttcgcccacgtggtgatggggttgtttgtttttttcttgtaaatttttttgagttcattgtagattctggatattagccctttgtcagatgagtagattgcaaaaattttctcccattctgtaggttgcctgttcactctgatggtagtttcttttgctgtgcagaagccctttagtttaattagatcccatttgtcaattttggcttttgttgccattgcttttggtgttctagacatgaagtccttgcccatgtctgtgtcctgaatggtattgcataggttttcgtctagggtttttatggttttaggtctaacgtttaagtctttaatcgatcttgaattaatttttgtataagatgtaaggaagggatccattttgagctttctacatatggctagccagttttcccagcatcatttataaatagggaatcctttcctctttcttgtttttgtcaaagatcagatagttgtagatatgtggcattatttctgaggactctcttctgtaccattggtgtttatctctgttttggtaccagtaccatgctgttttggttactgtacccttgtagtatagtttgaagtcaggtagcgtgatgcctccagctttgttcttttggcttaggattgacatggcaattcaggctcttttttggttccatgtgagctttaaagtagtttttttccagttctgtgaagaaagtcattggtagcttaatggggatggcattgaaactataaattaccttgggcagtatggccattttcacaatattgattcttcctacccatgagcatggaatgttcttccatttgtttgtatcctcttttatttcattgagcactggtttgtagttctccttgaagaggtccttcacatcccttgtaagttggtttcctaggtattttattctctttgaagcaattgtgagtgggagttcactcatgatttggctctctgtttgtctgttattggtgtataagaatgattgttatttttgcacattgattttgtatcctgagactttgatgaggttgcctatcagcttaaggatatattgggctgagacgatgggattttctagatatacaatcatgtcatctgcaaacagggacaatttgacttcctcttttcctaattgaatgccctttatttccttctcctacctgattgccctggccagaacttccaacactatgttgaataggagtggtgagagagggcatccctgtcttgtaccagttttcaaagggaatgcttccagtttttgcccactcagtatgatattggctgtgggtttgtcatagatagctcttattattttgagatatgtcccatcaataccgaatttatggagagtttttagcatgaagggttgttgaattttgtcaaaggcctttctgcatctattgagataatcatgtggtttttgtcgttggttctgcttatatgctggattacatttactgatttgtgtatattgaaccagccttgcatcccagggatgaagcccactggatcatggtggataagctttttgatgtgctgctggatttggtttgccagtattttattgaggatttttgcattgatgttcatgagggatattggtctaaaattctcttttattgttgtgtctgtgccagactttggtatcaggatgatgctggcctcataaaatgagttagggaagattccctctttttctattgattgtaatactttcagaaggaatggtaccagttcctccttgtacctctggtagaattcagctgtgaatccctctggtcctggactttttttggttagtaagctattaattattgcctcaatttcagatcctgttattggcccattcagagattcaacttcttcctggtttagtcttggaagagtgtatgtgttgaggaatttatccattttttctagattttctagtttatttgtgtagaggtgtttatactattctctgatggtggtttgtatttctttgggatcagtggtgatatcccctttatcattttttattgcatctatttgattcttctctcatttcttctttattagtcttggtagctgtctatcaattttgtttatcatttcaaaaaaccagctcctggattcattgatttttttaaagggttttttgtgtctctatttccttcagttctgctctgatcttagttatttcttgccttctgctaacttttgaatgtgtttgccttgcttctctagttcttttaattgtgatgttagggtgtcaattttagatctttcctgctttctctagtgggcatttagtgctataagtttccctctacacactgctttgaatgtgtcccagagattctggtatgttgtgtctttgttctcattggtttcaaagaacatctttatttctgccttcattttgttatgtacccagtagtcattcaggagcaggttgttcaatttccatgtagttgagcggttttgagtgagtttcttaatcctgagttctagtttgattgcactgtggtctgagagacagtttgttataatttctgttctgttacatttgctgaggagtgctttacttccaagtatgtggtcaattttggaataggtgtggtgtggtgctgagaagaatgtatattctgttgatttggggtggagagttctgtagatgtgtattaggtccgcttggtgcagagctgagttcaattcgatgtccttgttaactttctgtctcattgatctgtctaatgttgacagtggggtgttaaagtcttccgttattattgtgtgggagtgtaagtctctttgtaggtccaaggacttgctttatgaatctgggtgctcctgtattgggtgcatatgtatttaggatagttagctcttcttgttgaattgatctctttaccattatataatggccttctttgtctcttttgatctttgttggtttaaagtctgttttatcagagactaggactgcaacccttgcctttttttgttttccatttgcttggtagatcttcctccatccctttattttgagcctgtgtgtatctctgcacgtgagataggtttcctgaatacagcacactgatgggtcttgactctttatccaatttgccagactgtgtgttttaattggagcatttatcccatttacatttaaaattcatattgttatgtgtgaatttgatcctgtcattatgatgttagctggttattttgctcattagttgatgcagtttcttcctagcctcaatggtctttacaatttggcatgtttttgcagtggctggtaccagttgtccctttctatgtttagtgcttccttcaggagctcttttagggcaggcctggtgttgacaaaatctctcagcatttgcttgtctgtaaaggattttatttcttcttcacttatgaggcttagtttggctggatatgaaattctgggttgaaaattcttttctttaagaatgttgaatattggcccccactctcttctggcttgtagagtttctgcggagagatcagctgttattctgatggacttccctttgtgggtaactcgacctttctctctggctacccttaacattttttccttcattttaattttggtgaatctgacaattatgtgtcttggagttgctcttctcaaggattatctttgtggtgttctctgtatttcctaaatttgaatgttggtctgccttgctagattggggaagttctcctggataatatcctgcagagtgttttccaacttggttccattctcccagtcactttcaggtacaccaatcagacgtagatttggtcttttcacatagtcccatatttcttggaggctttgttcatttctttttattctttttttctctaaacttctcttttagcttcatttcattcatttcatctttcatcactgataccctttcttccagttgatcgcgtcggctactgaggcttgtacattcatcatgtagttctcatgccatggttttcagcttcatcaggtcctttaaggacttctctgcattggttattctagttagccatttgtttaagttttttttaaggtttttaacttctttaccgtgggttcgaacttcctcctttagtgcagagtagtttgatcgtctgaagctttcttctctcaactcgtcaaagtcattctccatccagctttgttccattgctgttgaggagctgtgttcctttgaaggaggagaggcgctctgatttttagagtttccagtttttctgctgttttttcctcatctttgtggttttatctacctttggtctttgatcatggtgacatacagatgggattttggtgtggaagtcctttctgtttgttagtgttccttctaacagtcaggaccctcagctgcaggtctgttggagtttgctggaggtccactccagaccctgtttacctgagtatcagcaatggaggctgcagaacagcggctattggtgaacagcaaatgttgctgcctgattgttcctctggaagttttgtctcagaggagtacctggccgtgtgaggtgtcagtctgcccctactggggaatgccacccagttaggctactcaggggtcagggacccacttgaggaggcagtctgtctgttctcagatctccaactgcatgctgggagaaccgctactctcttcaaagctgtcatacgggtacatttaagtctgcagagttttctgctgccttttgtatggctatgccctgcccccagaggtggagtctacagaggcaggccggcctccttgagctttggtgggctccacccagttcaagcttcctggccactttgtttacctactcaagcctgggcaattgtgggagcccctccctcagccttgctgctgccttgcagtttgatctcagactgctgtgctagcaatgagtgaggctccgtgggtgtaggaccctctgagccaggtgcgggatataatctcgtggtgtgccgcttgctaagacagttggaaaagcacagtattacgatgggagtgacccaattttccaggtgccatcgtcacccctttctttgactaggaaagggaattccctgaccccttgcgcttccctggtgaggcaatgactcaccctgcttcggctcatgtttggtgcactgcaccctctgtcctgcacccactgtccgacaatccccagtgagatgaacccagtacctcagttggaaatgcagaaatcacccatcctctgtgtcgctcatgctgggagctgtagactggtgctgttcctattcagccatctctccacccccccagaaactgacacttaacttttaggctcatttaatgtaaaaatgaactgctctgaactggttgtcaattcaaatatggttttaatatgaaattacaaaaacataagaatatttctaagaagaaactcactatgtaatagtccaaaatctaaaaacaactcaagtatacatcagcaggaggataaatatataaattatataataaccacttagtgaaatactgcaaatcaatgaaaatgaatcaccactatacaaaagatggatgaatctcacaaacgtcatgctgaatgaaagaagccagaaacaaagcgatgcttattttttgatttcattcaaaacatcagaaatggcagaactaatctatgctgttagacgttagaatagggcttacttgggggaagaataatggactggaaggagacacaacggaggctctaggacgctgaaatattctgctgtttgttctgtgcacttgctatgctgttgtaattattttgtgaaaataccattaaactttacatatgaattttgttcttttttgcatgtgcattatacctcaataaaaaagttgttttaaaactggaatatatcaccattttctaccatgcatcatttaaacataattttcatgaaatgcaatagtgttatataatcactatgtagtaatcttaatgcatattggtttaaatttgcatattttaagttttgaaaggataactgtcaggaaattgaagtatatactatcagtgatgtttgtaagttttttatcatttttgttagtgaagaactaacatgtttatgctgataattgaatatactgttttatattacaatgtgaaatctactttcagaaaacttgatatggaatgaatgtttcctttaaagcttttcagaattaaaatattgctttattgttgtaatcttttaaaaagatgcaaaacaattaacatcagatttttcataaagatacaaattcaagtgaatagtactaataccatatttaattagaaatcaataaaaaaatcactttattctttataaatactttagaatacttatttctattctgccattttctttgttttattttctgttataaaagccaaccaaaaatgacaaaaatataccaggaaagataaactgcgacgtaactggggagtagatacattatacacatactactttggcaatataaaaggaggaaataatctgttattacagatagctccatgaatattcaccagtgaagcacataatgatcatttccacagtagcaatacagagactgcgacattgaaattattcagtcctcctgtaaactagttcaaccattgtggaagtcagtgaggcaattcctcagggatctagaactagaaataccatttgacccagcaatctgattactgggtatatacccaaaggattataaatcatgctgctataaagacacatgcacacgtatgtttattgcggcactattcacaatagcaaagacttggaaccaacccatatgtccaacaatgatagactggattaagaaaatgtggcacatatacaccatggaatactatgcagccataaaaaaggataagttcgtgtcctttgtagggacatggatgaagctggaaaccatcattctcagcaaactatcacaaggacaaaaaaccaaacaccacatgttctcactcacaggtgggaattgaacaatgacaacacatggacacaggaaggggaacatcacactctggggactgttgtgtgttgggaggagtggggagggatagcattaggagaaatagctaatgttaaatgacgagttaatgggttcagcacaccagcatggcacatgtatacatatgtaactaacctgcacattgtgcacatgtaccctaaaacttaaagtataattaaaaaaaaaaaagaaattattcggtcctctaaagtgagggtctgctgatttttccatggatgtgtaagaaatcgtcaccatttctgaaattaagttttgtttgttaagaagaaacagcctaactttttagatagttttaaaaattatcttccaaaacactgctgcatggacaaaccatagagcactaaatcttgtagatagatcggtccatgccatgctgttgcatgaggttatatttttctagttacattcactgcatcatagcctggagaacaaaaacacagcatgacaacatatgccatgtctctaaaccatgcatctttaagagtctgatattcagcctttcattcatttaccttccttgttagcctttcatttaacactgattaaaatacttcaaatgattaattattgcacatttttgcctgatttatcacagctcagcaataagatcctttgttgtagcttcatcatattaatgtggaagctgttaatgtgagataatattacaaactcttctgtttctgacctgcttttcttagttcctatcttctttacctgagatccatcacttaaaacagcctttccccaaaggtaagcagccctctttaagagtcttgccacattttaacatatgaattaatctaagcaagggtccagaataaaataacacgtggtgtctttgctcaactaggttagttttccacaccttcctgtaacattatcagcagaagtcattcacacataaagcaacgacctcaaaattaaaaagttactttggataaaattcattttattgtgtaatctgggtattccttctctgtctctcctttcacccccaccatgggactttaaaaaagtaagttgtaatgctgagatttctgtgtcaaggttaaagagtgaagagaatcatttcagagattagaggtgtcactcatgtcaagaaacattataagagatctctggaggcatgtaccaacatattaaattactacatggaaaaataaattgaaaaagaaaagccctgaagtaatgaaagctgactacattttcaaagcaactactattttaagaagagtatatttcctttatccacaaacaaatacaaggcaaaaactgggtgtgtaacaatatatgatcttctttatgatatttacatgttggttgtgtcacccaaactagatcaaatgatttttaaaataacatttatattggtaaactctttcaaaataaatgtagaaattttctgtggctggcttctaggtgtggaattagggaagcaacatgtattaacttgaaattcctacccaggcattcacttgaaaggtacccaaagttatatttgatagtaacatagttttaaaagcttctgctttctgttttaactgatttgcttctacaccactccatggacatcattaagcctttttatttagaattatgacattgcttttatttcattaatttcactagcacaggttcaaagggacaagagttagttttagatgtaatatataatgtaattaaaaagttcccatcatttgtgtgtttttgtagtcactacttactaatgtaagtagtctgcacattccaattctgtttactacagaattaaagttgcaacatcaacagttgtctgagactgtatgttttatcttgaacaaggaaaataaggttttaatagttctgattgttattaaaagcctttatgaagtaacatttataaaacacttctaatggtggagattaattttgcccctcaggtattttggtccaagtaaataagaagcgactgatggtcccactaaacaaaataactacaaggaaaatgcaggaatttcttttcttcttgttaatgaatattttgaagatggttaatttacggttatgtagacattctgcaatcagctaagatgttaagtcacatgttttatatctatgaaagctactattttgtagtggtgacaatttgttgtgtgaatcagtatgtacaatgaagagtgacccattacatacaatagaaagtggtggtagttcaccatagaaattatctgttgctataataaatttcacatattctttgatttttaatgatttctaaacaaggcatataaatatgctatatacatcatattaccaaagacatcctttcaagtataactgctgaaaaagagtctattgaatgagttagtaaataaatgattatttatttgcaagccttttggtaaaatagcgttatttacacaatgaatttcattgttttggcattgtaactgtgtcttattctgttttgtgctgctaaaagagaacatctgagactgggtaatttatagagaacagttctggaagctgggaagtccgagattgagagaccacacctggtgagggtgttcttgcagcatcatatcatggcagaaggcataacatgagttaaggagcaataactaactcattcccatgataatggcattaatccattcataagggcagagtcctcataacctaatcacttcttaaaagttccactctcaactgttgcactggggactaagttcaacacatgaactttaggagacacatttaaaacatggaagattatatcccaaccagctctcctttaaaacccccaaatctgatacttacctgattgataagagtatttaaaataataaaatgagacaacatctttaaaacatctttctagtattatgaacttggagataaaccaatatagtccaagttgattatagctcatattccagtatcaacatgttcccagcactaaagcaattattttctacagttaaagagaagttttatttcataagagaaatccaaagagtaatacccctatcttagttgttgagggatcctgtaaagaactgtgaatctgatgttttatcttacttgctataatagcttacaggttagcctgccagttctatggatgctggcagaacttcttgggacaaagagaaaatattttatttttcacaggaatcatagccagtgtgtcagcattttcttgtgtttgtgcccaagttccaattcccacagggtagcacaaagagagctagatgctacctgtacacagttgggttgcaataacaaaaaaagagaaacctgatcctaggtacaaaaaatcatttataatgggtagtaagcatgtctggacttagtttactggacagtaaccatgcctgacctttgctctagtgagaatcactatctatatcttcagtgttttttgctatacagatttgagatcctttatccaaaagacagagccatcaagagttgtctgagagtgtgcatttaattttgaacacggaaaataaggttttaatgttgcagattcttatggagatatttacaagcctttttgtgaagtaatatttatacaacacttctcaatgatgaggattaattgaaaaatctgaacgatttcagatttttgcatttttttggatgttagaatgtttgcattatacttaccagttgaggatctcaaatctgaaaatccaaaatccaaaatgcttcagtgctaatattctttggatgccatgttggtgctcaaaatgtttcaaattttacagcatttcagatttgggtttttggattcaggttgctcaacctgtataagcatctttgaaaacttaatccagaccaaaagggctaccagtgctttgtttccaagactaaggaaacttgagaaaccaacagagaattgtctctcaacagaaccagatacaggtgcaatagaaaaaccaccagtctattttattatccttataaattcccactaactacagctgtttagaccaattgcttcagcaacaggaactgaaaatggaaacttatttacagagtaaaaagtagagggctggaattgtgtgcatccagtaatataattttcatataatttttatttagaaagatttaagtcatttcatgatatttagaagtagatatgtagagaatgtagtcaactcagcaataatctcatagaaatacaaaatacactaatagagtttcccatgcatatttaggttctcatacacggagaattaaatacaaagtaataaaaaatgactataaagtatacagtgaatatgctgtgccaatgtagttctgcagcataatatatccataaattttcttgcctttattgaacttacataatttctcctaacatttacttgagatgcattcttgtgatttatttaaagaaatgatatttgtggccaaaaattggaaagtgatatttcgctttagtacataggtaattaaccactgaactaaaggtctgatcatttatccactttcacattaaagtgcaaacactgaacaaaacataggtaagagatgtttcccatttcaagtggcaaaatttctagtgattttgtggtttacagaattcagttgaggtttgtatagtcattcacagagcaaaatattcaaagtagttattttttgagaaccatctttggcaacatatagcagtttttgatttccccatctagtaaaagcaatgagctaaagaagtccaccttccaccccacccccaaatgaagcccaaattaaactgttctaagtaggcattgaattcaacatattcattttgcttaggattaatttagaatattaaattaatgtgatcagtatatcttctttttatgtttatttcattttctttttgcctattagaaatactttaaaaaggcaaactctgtaaatcctcaatctttaaaggagccacatcagcatcagctttaaaagaacatctttttttttattgttaaatgaagcacctgttaatattattgttgcatgaataaaactgtctcttcatagctctttatctaaaaaagactgatttgaatgaaggtaaacatatgtggatacagatttccttgattttttaatacattcataattttgtttctttttttctcattttatataacacctatattttgattaaaaaaattatttcttctttaaaagatacattaaaaaacctaacttataacaagtgtaagtaatttttctagttgttaggttataatgttttaactttagtttttgtatagtaagtatggatgcatttttcgcaccacagagttgatcaaaataacagactgacataagagttggctgtctgataatattgtaacttgtgaactaaatgagcatgtaaaagtcatgctaacattcatttatttgataaagtcttcttaaagattttgagggcattgatagtacaaatcaaatgcacaatttaaaactgagatggttttcttatttactgaagatctgaacttggatattaaaatctctcctttgccatattctgcatgaaattatttcagtctcttaaccttactttttccatgtgtaaaatgatattattaatgtctaatttgtagattttagtttttaaaaaaggttaatatgtaaaagtgcttgatacatactgtttgcttaataaatatattaaacatacattcttttttacttgggttgtacaaaatcataatatcttaggtatgtaaaacactttttgagttctggcctaattcaatatttctggtgaaaatatgggaaactccttctccctccctccatcttggccttgcccaccacagaagaagaaaatatgtattgaagaacagtagcatttaattttcataactttttcgtaaatgaggataccggaagtcacacaaagtaaatgacttactcaagatcacatagacaggaaggacaaaggtaggattcacacccggatctgtctgaatccaaaggtgaattatgtttcatcatattatgctttttatcatagcttagagatttttctagcatggaacattatttagcaatatctgtgtgattaggcatctgcttcctaattcaacgttttcatcttcaactaaggtttattattaaatataaaacatttaataaaagtcaaaacatttgcttgttcaatttattttaatttatatttttgccttgccataaaaaatattaaagaaggcttaaatttgaatatacttgctatactaccttttaattggtgatatttcaaatttaataagcaaactgcactatgaagacaggatataagaagatttaggcaattggaaagattctttatcttgttacactttcggcatttttttttttttttttttttgccaattctcaatgtgaataaatttacaacatgtgaagcatcaaaagacttataaaatcttgagtcttgtctgaaattagcaaattaaaataaatatatgtgttgaaagaaaagtcctgtcttgcagatgttttggattagaatgaaaatggacacacacatacacatgcataattgttaactttcatttgaaataaaatttaacttagcaaaactaacaagaaaaaataaaataattgaatatctatattctattaaggaatgtaaatttaaacaaaaacattccacaaagaaaactccaggcacggaaagattggcaggttaattctatcaagcatttggggaaaaaacgaaaaagtaaaagcaacattacacactcagaaattaaggaaggaaacactttccaatgtgtttcatgaggcagcatatctctgatacataaacctgataaagacataacaaagaagaaattgcaggttttttaccactacaaacatagttaaaatccttaaaaaaattccaaagttgtattcagaaatacataataataaatcataatggagcagagtttgctataggattgaaaagttggtttaacatttgaaaatcaactcactaattcaccatattaatagaataaaggagaaataacttaataggcattaaaaaaaagcctgacatgacactcatttatgttttaaaaaggtaagactggaagagaacttccacacttttctgaagggcatttatgaaaaccttacagctagctaatttattgttacagatgaatcactgaatacttattcccagcagttgggaacaggcaagatctcttcctactcctgtactcaacattgcattagaattcttatggtagtgtaatttagcagaaaaaaaataaatatgatacataaatattgggatacatgaagtagaatgataatcatttgcagattacgtaagtgtgtttttaaaatcactaagaaattacaaaacaactacccaaggctacaagatagaagatacacacacacacacacacacagcattcggaatagatctagagtaaccaaaataacctggataaaaaaaaaaaagtttgaatacttaatatgatttgattattttttataatgctactgcttctagtaataaagtcatgtgttattgccgtaagaatatttcagcaaaacataatgagtagagatatttatccacacacgtgcagtcaattgttttttgacaaaaacactcaggcaactcaatggaaaaaagaaggcctttttaatagaaaattctcaaattactagatatttgcataaaatatgtaaaccatatgctttcattttatttcacacataaaattaatttgggataaatcaccaacctaacctaaaaactggaactgtaaatcttctcaatttggaagtaggcaacgatttcattggcaaaaaataagaagcatcaagcatgaaaaaattgatgacatttcttctcaataaaattgcaattaagcatatgaatagataagaaaaagagtcgggaaaagtaatcgatatttaataactgtcaaagaatttttatccaaaatatttaaacaacttttatgagtaaatatgaaaaaaacaacacattaaaaaatggtcaaaagacttgggtcgtcaccttaatgtgagtatgaaaaatatgctcaatgctaatatcattagacaaatgcaaattaaaaccacaagataaggttttgcacaactacaatggcttttagacacacacacatacatgcacacatgcacacacattaacaataccaaaatttggcaaggatgtgaaacaattgtaaactatagctcccatacaccacgttttgtggtaggaaaaatgtatgtgaaatagtacaacaattttagagaagtgtatttaatatctgtcaatcctaaaatcaagcaaccccattcccagatatttgcccaagagaaatgaaatcatatgtccaccaaaatacttacacaaaactattcatatagcacatttaattcatattagccagtacctgcaacagctcaagtggcccaaaatagaatggataaatacattatcttatattcatacaatgaaatactacactgaaaggcaaagcaacaaaaacgaatgcaggcaaaatgtggatgaatctaaaaaagtctttattgagctaaaaaagtcagatataaaaagtatatatcatatatatggtatattctgtatgtatgtgatctgatttatacggaatttgtaaagtaggcaaactattgtgataattgaaattagactgttgttgcttttgggtagaagtgggaatgattgaaaaggagtgtatgggaaatttgggaaataatgggaaaagtcagtatcttgatttgagtagtggttacataggcttataatacaattagcaaaacctatcaaatactatacttaaaaacctctccattttattttatatacattataattcaaatacaactgataagaattatagaaaatgtggacaatatgtacaattttatacattatatatatatacacatatatatatgtaatgtttcccttaaattttacctcttaatcggattactgtggaaatatattcttaaaagtattatttgtatgtatcagttgcaaatctgacttacattattttaagtggtgtaagatattaggagaagtttgttatctaatgtaccttgatcactaatttatattacaaaaagtaatatgttccaatccatatttcttattggttaaatcagttctactgaaaaaattttaaattctatgcttcacaaacaaaacagagagaaatgtatttgaatactgaaggctacactgtgtctatttccaaggggctaataagatttaagacttcaaagattcagtcttgtggtcaagaataagtgatgtggatgcctaagaaatgataagccatgccaggagactggaacataaatttgaggctgaatgactgcaattttccaaacatattttctgtttatcacaaagtttcatagtagttccataacttttccctccactcggtctctttaaaattctactgaacttctgagtaaaattgagaataatttggtccactgaatactatggcaaccctcccaccaaaataaataaaatgaaaaatttttctttcttttccttgctgttttctaattattttatctttgattatgcttcaaaagccccctattttctcggaaatggaatgttgtatatcttcttagattcactttgtttgtaaaagggaggaatatctgaaagtagaaggtaattatttacattagaagcagtgttttttactctctatgaaacttcctgcaaatataatacttaaacactctataaaagattgcaagtatacacagcaagtttgtaaatttttattttaatatctctaaagaatgagtagattgtaattttgtatttgataaaaattattgaggcctgaaatgcttttttcctactttagaaatttaaatgccattttcataatattgattcttcctacccatgagcgtggaatgttcttccatttctttgtatcctcttttatttcattgagcagtggtttctagttctccttgaagagatccttcacgtcccttgtaagttggattcctaggtattttattctctttgaagcaattgggaatgggagttcactcatggtttggctctctgtctgttattggtgtataagaatgcttgtggtttttgtacattgattttgtatcctgagactttgctgaagctgcttatcagcttaaggagattttgggctgagacaatggggttttctagatatacaatcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaacagaacagaacagagccctcagaaataacactgcatgtctacaactatctgatctttgacaaacctgagaaaaacaagcagtggggaaaggattccctatttaataaatggtgctgggaaaactgactagccatatgtagaaagctgaaactggatcccttccttacaccttataccaaaattaattcaagatggattaaagacttaaacgttcgacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactagcatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaaggctcactatcactggccatcagagaaatgcaaatcaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgcttcctcagggatctagaactagaaataccatttgacccagccatcccattactgggtatatacccaaaggactataaatcatgctgctataaaaacacacacacacgtatgtttattgcggcactattcacaacagcaaagacttggaacccacccaaatgtccaacaatgatagactggattaagaaaatgtggcacatatacaccatggaatactatgcagccataaaaaatgatgagttcatgtcctttgtagggacatggatgaaattggaaattatcattctgagtaaactatcgcaaggacaaaaaaccaaacactgcatgttctcactcataggtgggaattgaataatgagaacacatggacacaggaaggggaacatcacactctggggactgttgtggggtgggggctggggggagggatagcattaagagatatacctaatgctaaatgaggagttaatgggtgcagcacaccagcatggcacgtgtatacatatgtaactaacctgcacattgtgcacatgtaccctaaaacttaaagtataataataataaaataaaaaaaagaaatttaaatgctgtctacttgaagaaaatgtttatattgaaatgttaaacaaaagaaatgcacttttaaaattataaagtatattttgttatctctttaattttctttcaattgttacatttatattgtgatcttcacaaacgaatcattatgaaacacttttgacaccaatttgatctgttgactaatagttcaattaattaatagctaaataggctttgtttcctttcaaattgattaaatgtttgcatagtttaaaaatagaaaaaaattacactaaggcattatctgagattcgtttgtaaatataaatcacgccattaattatactgcctaattcatgataatagagttaaggggtctgttttatttaaataattttctgtggttttcaacatgatttaataaaaatattcctgaaaaagatcaacacatttcccattgtgaaaattttttcatgaaattattatctagtatttaatcatgtaatattagtagattgtggtttccagttgctttgagataattacttccttttaccagaaaacttcaacatcaaatttgtaggcctgttgtcatttataaggtctgttcaatcaaggtcacaattctgtcttaatttcatagtattgctgtaacttcaattaagagatttttggaagtttgcctcatcaatttttctgcctctggccatgataatacataaaattgtgaggatataatatttttaattacttacttctgagaatcctcagtcctcaaagaaacttagccaaatatatgtatgttttgtttgtttgaattttgttttttattatagcccccatagttggtatgaagtgatatgttcttttaatttgcatttccctaatgactaattatgttgagcatcttttcatgtgcttgtaaataatttgtatttcttttttggagaaatgtctcttcaagtccttggtccactttttaaaataactgtttttctctgttgttgacttgtgaaagttctttatactttctgcatactaggcggttatcagatataagatttgcaaatatctcccattatgtggcttgtctttctctttccctttctctcgctgtcttgatagtgtccttagatacacaaaatattttaactttgctagagtccaatttatttttctttcattgctcatactttcggtgtcagatctgagatattattaccaaatccaaggtcatagagattttccgcattctttcttctaagaattttatagttttagcacttatatttaagtctttgatccattataagttaattatttatatgatgtgaggtaggagtccaacttcattcttctgtgtgtggatttccagttgttccagcaacatttgttgaagagactgctcttgccttcaaaaaatggtcttggcacccatgtcaacaaccagttgaccataggcccctgggtttacttctgaacttccaattgatcagtatgtttatccttatgccaatgatccatatatttatatttatgtcagtatcaaattatctggattactggtgctttgcaataagatttgaagggcaaattaccctgttatattatttttcataattgttttagctttggggctccttgccttccactggattttaggatcagctttctttaacatttacattttagcaaaaaaagaaaaaaatcattgggatttctatacggattgcattgagcctgtagattgcttttggtagtattttcatcttaatagtattaattcttccagtgtagtttattttggctgattactctgactagaactttcagtaccaatgttaaagcacaagggcaaatgtggaaatgcttgtcttcttccttatctaagtagataggtttcaatctttcacctttaaatatgatggtagctgtgggttttccacaaatgccctttattatgttgaggaagcttcttttaattttcagacttcccattgtttttaagatgaaataatgttagatttttttaaatgctctttatgcatgaactgagaagaatttctgtttatttctctttgttttatcaatatggtatagtacattgattgagttttgtatgttgaaccaccctggtattgctgaaataaatcacacaaaatcatgatataggatccttttaatatgctgctggatttggtctgttagtaatttgtgataaattatcagttcttatttttagttgggattcttttcttatcaatagcataaatcttctttatggcccatctttctggttttgtttcacaagaatttcaaaaaaactattataaaccatctttcttttccatgcagtcaattgaaattccctgataattatttttcataagagaaataactattttccaagtatggcctactacttctatttctaaatctctttaaattgagatggttaaagtacagtatagtaacaaccctagctatgtaatattaagattagtgggaggattaatgtcaatatttctttttttttattatactttaagttttagggtacatgtgcacaatgtgcaggtttgttacatatgtatacatgtaccatgttggcgtgctgaatccattaactcctcatttagccttaggtatatctcttaatgctatccctccccccagcccccaccccacaacagtccccagagtgtgatgttccccttcctgtgtccatgtgttctcattattcaattcccacctatgagtgagaccatgcagtgtttggttttttgtccttgcgatagtttgctaagaatgatggtttccagcttcaaccatgtccctacaaaggacatgaactcatcattttttatggctgcatagtattccatggtgtatatgtgccacattgtcttaatccagtctatcattgttggacatttgggtgggttccaagtctttgctattgtgaatagtgccgcaataaacatacatgtgtgggtgtctttatagcagcatgatttataatcttttggggatatacccagtaatgggatggctgggtcaaatggtatttctagttctagatccatgaggaactgctacactgacttccacaatggttgaactagtttacagtcccaccaacagtgtaaaagtgttcctatttctccacatcctctccagcacctgttgtttcctgacattttaatgattgccattctaactggtgggagatgatatctcattgtggttttgatttgcatttctctgatggccagcgatgatgaacattttttcatgtgtctgttggctgcataaatgtcttcctttgagaattgtctgtttatgtccttcacccactttttgatggggttgtttgtttttttcttgtaaatttgtttgagttcattgtagattctggatattagccctttgtcagatgagtagattgcaaaaattttctcccattctgtaggttccctgttcactctgatagtagtttctgttgctgtgcagaagctctttagtttaatgagatcccatttgtcaattttggcttttgttgccattgcttttggtgttttagacatgaagtccttgcccatgcctatgtcctgaatggtattgcctaggtttttgtctagggtttttatggttttaggtctaacatttaagtctttaatccatcatgaattaattttggtataaggtgtaaggaagggatccagtttcagctttctacatatggctagccagttttcccagcaccattaattaaatagggaatcctttcctcatttcttgtttttgtcaggtttgtcaaagatcagatagttgtagatatgcagcattatttctgagggctctcttctgttccattggtgtatatctctgttttggtaccagtaccatgctgttttggttactgtagccttgtagtatagtttgaagtcaggtagcgtgatgcctctagctttgttcttttggcttagaattgacttggcgatgcaggctcttttttggttccatatgaaatttaaagtagttttttccaattctgtgaagaaagtcattggtagcttaatggggatggcattgaaactataaattaccttgagcagtttggccattttcacaatattgattcttcctacccatgagcatggaatgttcttccatttgtttgtatcctcttttatttcattgagcagtgatttgtagtttttcttgaagaggtccttcacatcccttgtaaattggattcctaggtattttattctctttgaagcaattgtgaatgggagttcactcataatttggctctctgtttgtctgttattggtgtgtaagaatgcttgtgattttttgtacattgagtttgtatcctgagactttgctgaagttgcttatcagcttaaggagattttgggctgagacgatggggttttctagatatacaatcctgtcatctgcaaacagggacaatctgacttcctcatttcctaattgaatgccctttatttccttcccctgcctaattgccctggccagaacttccaacactattttgaataggagtggtgagagagggcatccctgtcttgtgccagttttcaaagggaatgcttccaggttttgcccattcagtatgatattggctgtgggtttgtcatagatagctcttattattttgagatacatcccatcaatacctaatttattgagagtttttagcatgaagggttgttgaattttgtcaaaggccttttgtgcatctattgagataatcatgtggtttttgtctttggttctgtttatatgctggattacatttattgatttgcatatgttgaaccagccttgcatcccacggatgaagccctcttgatcatggtggataagatttttgatgtgctgctggattcggtttgccagtattttattgaggatttttgcattgatgttcatgagggatattggtttaaaattctcttttattgttgtgtctgtgccagactttggtatcaggatgatgctggcctcataaaatgagttagggaggattccatctttttctaatgattggaatagtttcagaaggaatggtaccagctcctccttgtacctctggtagaattcggctgtgaatccctctggtcctggactttttttggttggtaagctattaattattgcctcaatttcagatcctgtaactggtctattcagagattcaacttcttcctggtttagtcttgggagggtgtatgtgtcaaggaatttatccatttcttgtagattttctagtttatttgcatagaggtgtttatagtattctctgatggtagtctgtatttctttgggattggtggtgatatcccctttatcattttttattgtgtctatttgattcttctgtcttctcttctttattagtcttgctagtgttctatcaattttgttgatcttttcaaaaaaccagctcctggattcattgattttttgaagggttatttgtgtctctatttccttcagttctgctctgatcttaattatttcttgtcttctgctagcttttgaatgtgtttgctcttgcttctccagttcttttaattgtgatgttggggtgtcaattttagatctttcctgctttctcttgtgggcattgagtgctgcaaatttccctctacacactgctttgaatgtgtcccagagattctcgtatgttgtgtctttgttctcattggtttcaaagaacatctttatttctgcgttcatttttttgtgtacccagtagtcattcaggagcaggttgctcaatttccatgtagttgagtggttttgagtgactttcttcatcctgagttctagtttgattgcactgtggtctgagagacagtttgttataatttctgttcttttacatttgctgaggaatgctttacttccaagtatgtggtcaattttggaataggtgtggtgtggtcctgagaagaatgtctattctgttaatttggggtggagcgttctgtagatgtatattaggtctacttggtgcagagctgagttcaattcctggatatccttgttaactttctgtcttgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaattgatccctttaccattatgtaatggccttctttgtctcttctgatatttgttggtttaaagtctgttttatcagagactaggattgcaactcctgcctttttttgttttccatttgcttggcagatcttcctccatccctttattttgagcctgtgtgtgtctctgcatgtgaggtgggtttcctgaatacagcacactgatgggtcttgactctttatccaatttgccagactgtgtcttttaattggagcatttatcccatttacatttaaggttcctattgttatgtgtgaatttgatcctgtcattatgatgttagctggttattttgctcattagttgatgcagttgcttcctagccttgacggtctttacaattgtgtatgtttttgcagtggctggtaccggttgttcctttccacgtttagtgcttccttcaggagctcttttagggcaggcctggtgttgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccgagagatctgctgttattctgatgggcttcccgttgtgggtaacccgacctttctctctggctgcccttaactttatttccttcatttcagctttggtgaatctgacaattatgtgtcttggagttgctcttctcgaggagtatctttgtggtgttctctgtacttcctgaatttgaatgttggcctgccttgctagattgaggaagttctcctggataatatcctgcagggtgttttccagctgggttccattctccctgtcactttcaggtacaccaatcagacatagatttggtcttttcacataggcccatatttcttgggggctttgttcttttctttttattcttttttctctgaacttctcttctcacttcatttcattcatttcattcatttcatcttccatcactgataccctttcttccagttgatcgcgtcggctactgaggcttgtgcattcatcacatagttctcatgccatggttttcagctccatcaggtcgtttaaagacttctctgcattggttattttatttagccattcatctaattttttttcaaggtttttaacttctttgccatgggttcgaacttcctcctttagctcggagtagtttgatcgtctgaagccttcttctctcaactcgtcaaagtcattctccatccagctttgttccattgctggtgaggagctgcattcctttggaggaggagaggtgctctgactttcagagtttccagtttttctgctctgttttttccccatctttgtggttttgtctacttttggtctttgatgatggtgacgtacagatggggttttggtgtggatgtcatttttgtttgttagtgttccttctaacagtcaggaccctcagctgcaggtctgttggagtttgctggaggtccactccaggccctgtttgcctgagtatcagcagcggaggctgcagagcagaacagcggctactggtgaacagcaaatgttgctgcctgattgttcctctggaagttttgtctcagaggggtaccaggccatgtgaggtatcagtctgcccctactggggggtgcctcccagttaggctactcaggggtcagggacccacttgaggaggcaatctgtccattctcagatctccaactgcatgctgggaaccactactctcttcaaagctgtcagacaggtacatttaagtctgcagagttttctgctgccttttgtatggctatgccctgcccccagatgtggagtctacagaggcaggcaggcctccttgagctgtggtgggctccacccaattttggccgctttgtttacctactcaagcctgggcaattgtgggtgcccctcccccagccttgctgccaccttgcagtttgatctcagactgctgtgctagcaatgagtgaggctccgtgggcataggaccctctgagccaggtgctggatataatctcctggtgtcctgtttgctaagacagttggaaaagcacagtattagggtgggagtgacccgattttccaggtgccgtctgtcacccctttctttgactaggaaagggaattccctgaccccttacacttcccggttgaggcgatgcctcgccttgcttcagctcatgctcagtgcgctgcacccactgtctgacactccccagggagatgaacctggtatctcagttggaaaagtagaaatcacctctcttgtgcattgctcactgggagctgtagactggagctgttcctatttggccatcttcaatatttctaacatattagaatctatttgattttttaaatctacataaactcgtgtactaacagttattttatttgtaaaacacttttttttcctatagtatgttggacttatcaatattttgaatatgtaagtcttaccctttggagtttactgtccaaagggcaaaccttatatattttaaatgtatagcttctaatgttctgattatagaacagttatgcatgggatataagcaacaatttgtcttccaaatatgtcatatttgccactgttttcatggattatatgaaacctgtgaataattgcttttgtgtatattgattcttcagttacattcagtggtggtaactacttgaaaatatttctgataactaagtttgaaattagattttaactgttcctgtaagtccctcattcagtgacttattgtgtaatgctattttattgcttctatacatcctatttcttatgtaatcatgcatgtaagatttaatcttgaatctttgaatatgtgaacctcactttattctactctcttgattgatagtttactgtagaataaatttgattggttgaaagtaattttctctcagagttttaaagtcattgttctattattttatggaatccaacattacttatgagaataataccaaccatttcaatgtgtctttgtaaataagctgtttttttttcccaatgggagaaacttaggatcaactcaatgtttttgctgctctagaaagtctagaaaaatgtggctaggttttttacaacatactattcattgagataccaagacaattaatactgtaagtcttcatctctaggaaattatgtttgattcttacaattgtgataattgttatccttcgttttctctattccagtgaacgaagtaccagtgatggtcactggggagggagttttaatcaacagcactaaggttcatggtagctgcttcagtttttcccaaatgattacttgaaaaataacttttgttttgttttgaaagtgggaagtttaaattggatgttagtgattttattgaggatgatggaagagtgcagttgatgagaatattttcatttgatcatcttattttcagcctttttactgtctgtaatttttgatttttcaggtctgcctcccaaccctctaagtgtattttaggaaagatctatgcccccttaacttcagtcctcttcataaatatttctggctgcaactacttgcactgtgttttattagcgcatgcctttttacatgccttccagaaatatgttggaatctctagtctgctaatgactaccaattgttcttttaattttaatagcttatagctcttaaaactgcctttaatctcaccgtttaggtctcatatgaggagaaaatttaaaaaattatattttctagtccatattcttcaaccgctgtttccttaaaatgattcattgacacaaaaaatggcatttggatatgcgaatggattccatcaaagccttcaaaatgggaggtctggcaaacaatttattttttcttacaatatatacctattcccaaaagttatttgactactttgtttatatattttgtgcttatttgactattctattccttagcctactttttctttacccactcttctcttgcctatctcatagcctatttcagaaatatgtttatgcagatttttcatctaaatcttttttcctgtcttttccagagtatttcttcagaatttcactttcttctgaagtagcttattcacatatttcctaaataccttttcttcccccccaaaattatattaataacttttatttaagttgtttgttttaaacctgttccattaaaaattccaaggctttgtttgtactactatgcaaactctactgcatattactcagcaatattggctttagctgattatatccagcaatgaatgcttcttcacctctaagacataaactgttttctgcagaaaggccttacatcagatggacagaaagtctcacaactttctgtaccttacagttatggttctccaaatgcagcatcgttcaaagtcacctgaagaacttggtaaagcactggtttttaggtccaatcttgtaatttctgattcaataggcctgcatgaaagccaagaatttccattcctattaagttcctaggtaattctgatactgctgatctgagagctgtagtattagaaccattgcctggagaaccactattccattggtaaaagggtaactcacatgtccttactctgaaagatggaaagatttatagaaagtccaaacaagtcaatagtttctgaaagcactaccttgtataattatgacatgctaataattttgtaggtagtcaacataaaagaaagatgtttgaggaggatataacagaaaactgggtttatttatatgtctgttggctttaccaatatctcacagtcttgggtaaactgatcaaagcacacataagttctaactctaatttttgcaaatactatagattctaaagagaaaaacaatgaaatgattatgaatctcatcctctttgtcagcatgcgtgtgtattgtctacctgtatgcccaatatttatgagttattatgtgctaatatgaaagaaatatttattaaatgtgctatgtttaacaaaataatgcagttcttccctaagcaatcacaaagtatgtatcattggctgaaatacaatcagatttgtcaattttccattttgtatagtagtgacatatgtgctacttatggaagaataaagataaattataaagggatttttattagtaaagaataaacttgcaaagtttcagatttatatttttttttcaaaaactgactatatcttatgctttaacttttaagaaatgttagatagcattgacaaatgtctacttcctgaaagtttgaattaatgaaaactgtttcttgaccatatatagccttcaaatagtcttcagaggtgtatatgggttgtgtgtgtgcgtgtatatgtgtgtgtttgtaatgatgtagtgaatacagaacactttttaaagtattagaaacaataaaagggtgcattagaatggatggcatctgcatcatatatatcacaagcttttaatatctgataatcagtatttttattatgtccagtgtgataataaaatgaatcctatgttgtttgttaattaccttttgtaaaatatcattttacattatactatcagcatttttatgccatcaaatatgcttctgaaaaattatttttattgtgtcatatgaaggtggcacaaatttagcttgtccctcaattaatgggaatttaaaaaaatttgttttctaagagggaaattgccaagttaaagtgtataaatatatttatggctcctaataatttttttataaagccattatactcctacctgaggtttcattttacattttaaagtatgcttgttacataaatagtctatggttatttatatttttaccaatttggtaggtaaaattataatatgttatatagttttaatcggcatttttgtaactttgtttggaatagaagtttttaacatccttttttgctacttgtatttgaaagtgaagaataaagcatttatggctttagtgggtataatctatcctgtcaaagcagaaaaataattactaaaattttgtaaaggttatttttatactattttcctattttaaatctaaagatatggggtaaatacatgcattattgttatagttacttttagtattttagatttacagacatttctctttctctttccttttttctcttctactttgtatgcccttaagaatgacttatttaaactcatttgtcaaaatcagaattagtgcataaatagttctatggataagaaaaactctgttttatatgtgatccaaaatgcaatatatgaatgttatattgcctagaataaacgttcttaattttttagggaatggaactcattatgaaacatacaaacatgtttacctgtttgacagtttaccataccagaatcgtttcttttgcaaattgaagtataatgaattagtacaatctctgagaacacagagatatcacatgagaatgaaatctacagcatttaactttcagatttattctttcacttattctaggtgtatatatatcatttgtaaagtgagtgactcttcactttttaaatctaggaataatatcagtttttttttcaggaagaaacttcctccagtcaactcattactaaatatttgtgtgagtgtgtgtgggctcgtgtgggtttgtgtgggcttgatgtgcttttctcttagttgaataacagtatcagtcctataagcatgtaatgatacaagaagacaaccaaaaaagatctggaggcatccttgttatacaattagacaaagaaaatgtgtgtgtgtgtgtgtgtctgtgtgtgtgtgtgagagagagagagaaggagggagtatttaacgagtagcttctaaaattttgagatgggatagattaaatggagctaaatgttgaatttataattactaaatatctatgtaattattaaagataaaatttaaaataaaaatagggcatagtctttttttattatacttcaagttttagggtacatgtgcacaacgtgcaggttagttacatatgtatacatgtgccatgttggtgtgctgcacccagtaactcatcgtttaacattaggcatatctccaaaatggaaagctaaaataacctttacattttaagaagtgactgaattttagtttatgattgactgtcttctagcggtagaattgacatagttcagaaagggagctaaatgtgcctccactgtgataagaaatgggaagaaaatagaaaaagtaattgctttagcaatgatctagtatgaaagtgatggattctttcaggtagaatttggtaggctttcagtggctggcacattcttcggagcactcaatgaggtcaaatatctcagtgtaggaaggtgtaaactgtttagaaacctgctaccatccaacaaattgaaactgaactgatgttagtgtagctgtgcactaaggcatgtttttctgtgtccatgagtatgagatgaagagggactatctcttaaagatttttctatctgatactcttcaggatctaatgagatcagccagctacagataaacaaactgatgctgaacctgcaattggccatctcctctcagctaacccatttgtctttagctgttctcacagagggaatgacagtgcatttatttagggcaaaagaaatacctatttttatataactatttgagaaaagaatcaagatgagtcaataaagatgtagcaaagtttggcttttggatccgtcctgttttgcttctctggccagctacacacgtttggggaactaatcatttactttgacagagtttcctgcatcacaccttctactgaattttctaaaaaagcaaaaagtattttgtcctccagcattcaaacaccaggtggtctaatttttgcctgttggctcaaaatatgtgtttggagattttctccctgacctgaatcgatcctctaactgacagagcaatgtaaatcttggacataaacaacaaagagtgtgtttctactggcaaagacagtgtaaattatggaggatttatgtactatggtaataaattaagttcctacaagtgcttttgtttgaatagaaatatcaaaatcccaaggcctgttgctttagacatatacgtgatttttttagtccaactttgattattagcttatatccctttactcccctgatgcttcattcatttcagaattagtacttggggaatctcctacttcagtcccagaagaaactgggttagtcacagatagttcttcatagcatgcttcttctcacagtggtaccaacgaagcatggcaatgcaatacattttgtcctccaaatcatcagccatgaaaattggtccttaattttgtctttactttccattatttatataaacctataagaaaagtacttgttttataagcttgatgtcatttcgtgtagtgtgtactagaaaagtattgccttccaggtaaaagagaagaagagtttgtttcttttttatagtagtacctaattgtatttcagttctggagtgcccacatattctgtagctttgaaaattacttggcaaatccattttcagattatgtatactgattatgatttttacaaggtttggttcttatttactttcagtaatttcctttcctgttagaaaaatctaaatattgctttgttcttctaaaggaaactctttaaccaattttctctggaggattcttagttttctgacatctttttgaaattaaggactagaaccacactatctattagaagtacatatattctatgtatgtagagataatgttttctgatgttttcactactgtttattatttccatggttgtcatcactacaacagaatcatccattttaaatgagccttaagttttctacttattaaatatcttgttttttgaataaaaggaacttaacaatagattttatgttgttctatataaaattgttctccaaaaattcgcaaaattttttatttatttatttatttatttatttatttattttgagacaggatctcactttttcacccaggctgtgcagtggcgcagtcacacctcgctgcagcctggaccttaagcaattctctcatctcagcctcctgaggagcttggactacaggtacactccaccacaactggctaatttttttgtattttttgctgagacagggtttcaacatgttgcccaggctggtctcaagcgatgcaccctgcttagcctcccaaagtgtgtgactaaagttatgggccactgtgcccatccaaatttttacttttacataggtaataccaccataagttcaaatattaaaaagcataaattcatgccaagccattagttttgcaccaaactgtgtgacccaaacacccaattcctcttccaaaattggtatagattcatatgcaaatactaattttctatcctttctaaattgaaattatatatgcattgtattgcacctttcttcaagtgtttaatatgttttggataacaatcttttattaatcttttattcctaaagagttccatattctttttatggctgtgtattatttcattacatggatatgctatctcacctaagtcttattgattgatagataaggctttcctaatatttttatattaaaaacaatgattcagtgaaacactgtgtacatgtcccttcacatatgtgcaagtataagaaaaaaataaaatctcaaaagttaaattgtttgatcaaagggtaaatgcattcatattttgccaaattgccctccaaaggatttgtaccaatgtggacttagcccggtgatatttgagagcacctgatttctacatactcattaagtgccctaacaaatttgtaaatctttattattctgataggtaaacatgttttctctcttaaataatttgtagcatccatacatgttattttctttgaactgtttacatatttttatcataatatttcattgtgttctttttatcaatcgtagacgacctttattcattgaggataatagatctctatgagattgctttattctgctttcttaaacacattcagaaattatgatcaaaacatgaatggtttgaaattattacaataactcagattgtttttgcagaaatatttcatattttgtgcttctcctcatgttttttaaatctcatttctgtttctacacaaaaggttcatagtctagtacaattatattaagaggtggtatttggtagctatatgaagaaagttgtgggtgatgaaatcagtgatagcatagtgactaaacataactgaattgcctaactcaaagtttaatccaatttttgaataagtcaagtagtagtatctttctcacctgcacatttggaattcccatgtttcaggcttcttttgtcattgtattttatttcctaattcagtaaaacctgtaattgaatgtattcgtttcctacgactgccataacacaatatcacaaatggagtggcttaaaacaacaaaaatgtactgtctcacagctcttagagcgagaagtgaaaaatcacggagtcagcagaggtatgctgccactgaaacatgtaagagagaaatctttgccacttcctagcttctggtgatggtcatcaactggcatttttttttactttcagctacattactccaatctctgccactgtcctcataaggcattctccctgtgtgtgtgtccacatttccctcttcttagtacaccaacagtcgtattggatttgggcccactctaatgatctcacctttatttgatcacgtatacagagaacttctttacaaataaggtcacattcagagggactgggagttaggcttcaatatattttgagtttggggaagccaattcaacctataacattgagtaatagcaggtaaccacaatgctttagtgatcttataaaaatgatgtcgaaaagtaagctctgtgttctagagtttgttttcattataaagattacattcactgaaagctctatgcatataatgtatctttagatgatagtctactataaatgttgatgctcttagctttagaaaaattcagtaaattctaaaaactttcttcaaattgagctgaactcatctgtgatctcactatttctgtgtcacaatcaatttgggaaataaacatattttaatattatattttctctttgttcatgacgggcatagtcaagtgatgattagtttatgtgattcattttattgcatttaatagaaattactaaccagaattacagctcaagtctctcgacagggaacaaatcacagcaaatgaatccaacaggaatcaatatgatgattcattagcaatgagctctcactgagagtcccaacaagctgaagacttcataccatatttttttatgaaccaaatgtcaatagcgaaattaactactaaaaagtatcacagaaatgtgctttattttaatatcatatttcacaattttttaaacaactgaaacaagtttatgtatttcacttttgcttctacaaattattttaaaatagtttccacatctcaaatatcatattggaataattattagaattttataaagtctgtttcccaaaatatttactaaatattttgtcctcataatctcactagaagattacattccattatatgatattttaacagttttctcattggtttaactgtggcatgtatgcacaaatacacatgcacatgaatccatgtgcagacacacacatatatgcacagcacaaggtcgaaagcacattaaaagatttctcaaatatagatatatcaatatataaatatgaaaaaagcatactatgtgtgtgtgtgtatatatgtatacacacaaacatatacacacacatatatatatacaaacacatacacacatatatatacaaacacaaatatgcacacatcaactttttggatatgacatctaattcaactccaaatttccccagttatactgtcatgaccttagaaatgaagtaggtagactgggggatcttgggataaggagtataacactgtttctgcagttttattttattttattttattttattttttgagacggagtctcactctgtcgcccagactggagtgcagtggagcgatctcgactcactgcaagctccacctcccaggttcgcgccattctcctgcctcagcctcccaagtagctgggactacaggtgccagccaccatgcccggctaatttttttttttaattttcttttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaagagtccccagagtgtgatgttcccctttctgtgtccatgtgatctcattgttcaattcccacctatgagtgagaatatgcggtgtttggttttttgttcttgcgatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgggagatggtatctcattgtggatttgatttgcatttctctgatggccagtgatgatgagcattttttcatgtgtctgttggctgcataaatgtcttcttttgagaagtgtctgttcatgtcctttgcccactttttgatggcgttgtttgtttttttcttgtaaatttgtttgagttcattgtagattctggatattagccctttgtcagatgagtaggttgtgaaaattttctcccattttgtaggttgcctgttctctctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccattttgaattgatttttgtataaggtgtaaggaagggatccagtttcagctttctacatatggctagccagttttcccagcaccatttattaaatagggaatcctttccccattgcttgtttttctcagtagagataggatttcaccgtgttagccaggatgttctctatctcctgacctcgtgatctgcccacttcggcctcacaaagtgctgggatcacaggcatgagccactgcgcctggactttctggagctcttaaaaaataaactttatttagaaagaaaacaaaaaacaaaaacaatttttggaacagttgtaggttcacagcaaaactgagcagaagttacagagatttcctatatacttcctgttcccatattaatataccatctgtcattaacaacatcttcctagagaacagtgcacttgctacaattgatgaagataacttgacacatcattaccaacccgggttcacagttaaagttagaactcacttttggtcttattgagtctatgggcttggacacatttttaatgacatatatgcacaattatggtattatgcagaatagtttcaccactcaaaatcctctggattctccttatgtatccctccctatccctaacccttgaaacgactagccttactgtatccacagtttcacctcttccagaatgtgatatactcatttatgtttcttccatgtcttttcatggcttgatagctcatttttttagtgctaaataatattccactctctagatgtgccataatttatcaattctccaacatctgtttcttccaagttttggcaattataaataaagctactataagcatcaattttcaggtttttgtctgaacataagttttcatctcctttggataaatagcaatgagcagtatggctggatcctacggtacgagtatgtttcattttctaagaagctgcctgtttttcatagcagctgtaacaatttgcattcccagtggtaatgaatgaaagttcttgttggttcacatcctccccagcatttggtattatcagcgttctggatttggctattctaataggtttgtagaaatatctaattgttgttttaattttaatttgcatttccctaatgacatatgatgtggagcatattttatgtgcttgtttgccatctgtatatcttctttggtgaggtatcttttaatgtatttggctcattttttgtttgttttctttttgttgaattttaagcattccttgtaaattttgtataatagccctctatcagatatgtcttttgcacgtattttctctcagtctgttgcttgttttatcattctcttgacagtatctttcacagagcagaaattcttaattttaattaagtccaagttatcaaatttttctttcatgaatcatgcctttgttgtagtatctgaaacgttaccatcaaacccaaggtcatatgatttttttttctatgttatgttgtaggagtttaatatttttgcattttgcatttaggcctgtgattcacttcaagttaatttttgtaaaaggtgtaaggtttatgtttagattcatttttctccaggtggttgtctagttgttccagcactgttttttgaaaaaatttccttttctccactgtattgtcttttcgcctttgtcaaagattggtatactgtacttatgtaggtctctttctggactcttttctgttccattgatctatttgtctgttctcttaccaataccacactctcttgaccactgtagctttataacaaacttttgagtcaggtagtatcagtcttccattttttttttcttcaactttaacattgtgctagctatactgaatattttgccacttcataaaaacttccgaatcatttagtagatatctacaaaataacttcctgtaattttgattggggttgtatattatttatagatcaaattgggaagaattgacatattgaaaatattgaatctttttgtccataaacataaaatatttatccatttattcagtcctttttatatctttcattagagatttgtagttttcctcatatagattctgtgcatattttgttacatttatatttaaatatttccttttggggatgctaatgtaaatagtgtgtgttcttggtttcagattcctcttgttcattcatggcatataggaaagtgattaacttgtgtatattaactttgcattctgccacactgctataatcacttgttagtttcaggaacttttgttgttgttgtcgattgttttggatttcctacataatgatatcacctgtgtacaaagacacttttaattcttctacaccagtaagtatacctttatttctctttgtataattgtgctaggactttcagtaaaatcttgaaaaaagagtggtgagagttaaccttgcctacttcctgatcttagttagaaagcttccagttttccacaatcaagcatgatgttggccatcagttcctttgtagatgtctttatcagtttgagcaagttctattcttagttgactgagagattttatgatgaatgactgagagattttatgatgattttatgatgaatttttggattttgtcagatgctttttctacatctattgatacagttttgtgatctttcttatttagcttgttgatatgatggaccatattaattgattctggaatattgaaccagccttgtatatccgggataaatcccacttggtcatggcatacaattctttttatacattgttggatttgatttgctaatattttgttgaagatatttgcatctatgtccacaacatatattggtgtgtagtttccttttcttataatgtctttatctgattttagtattcaggtaatgctgacttcatagaatgagttagaaagtattcactctgtttccaccctcagaaagacattatagaaaattggtataatttcttccttgaatgtgtggtagaattcatgagtgaacccatctgggccttgtactttctgtttggaaagttattcatttttgattcaatttgtttggtaaatattcacctattcagattgccatttcttcttgggtgagatttagcagattgtgtctttcaaggagtaggtctgtttcaactaggttatcaaatttgtggtcatggagttgtttacaatattcctttattatcatttgcatgtccattagatctgtagtgatgtgtcttctttcatttctgatgttagtaatttgagtccactcttcttttttttttttttttttccttagcctggctaaaggcatacagattttattgattttttttttttttcccaaaagactgacttttgatttcactgaatttctctattggcttcctgttttctactccattgatttctactctggtttttagtactactattattacttccagttactttttatttaatttcctctccttttcctagtttcctaagatgaaaacttagattattaatgttagatctttcttcgtctctatacaatcaatgttataaatatccctgtaagcactgctttcattacatcttacaaattgttatgttgtgttttcatttttatgtagttcaattttttttttaattttctgttaagatgtcttctttgacctgtatgctatttaaaagtgtgtttgtaatgccccgtaaccttcagcaatcccactgttgggtataaacccaaaggattataaaccattctactataaagacacattcacatttatgtttattgcagcactattcacaatagcaaagacttggaaccaacccaaatgcccatcaattatagactggataaataaaatctggcatatatacaccatggaatacaatgcagccataaaaaaggattagtccatgtcctttgcagggacatggatgaagctggaagccatcattctcagcaaactatgcaggaacagaaaatcaaacaccacatgttctcattcataagtgggagatgaacaatgagaacacatggacacagggaggggaacatctcacactggggcctattgggggatagggtagctagggtagagatagcattaggagaaatacctaatgtagatgatgggttgatgagtgcatcaaaccaccatggcacatgtgtacctatgtaacaaacctgcatgttctgcacatgtatcccagaacttaaagtataatttaaaaaaaaaggagagaagagaaaaaaaggggtgtatttgtttaatttctatctattttgaaaattttcagctatctttctgttatggatttctggtttaattttattgtggtctgagaacaaacattgtttgattcctattctttcaaatttgttaaaatatgttttatggcccagaatgtggtttaccttggtgaattttccatgttagcttgagaggcatgcttttctgatgttgaatgaagtacccaatagaggtcaattatattcagttcattgatggtgctgtagagttcaaatatatccttacttatttcctgcctgttggacctgtccatttctgatagaggggtgctgaagtttccaaatataatagcaggtttatctatttcttctttcagttatattagttgttccctgatgtattccgatgcaatgctgttaagtatgtacatattaaggactgtcatgtcttcttaaaggattcatccctttatcatgtaatgctcctccttatctctgatactatccttgctctgacgtcggctctgtctgaaatttgttttgatgattgttagcataatatatatttccccattcatttactgttaacttatatgtatttatatttagggtaagtttcttgcagacaaaatatagtcttgcttattgatccactctgtcaatcttatcttttaattgatatatttataccatgatgtttaaaataagtattgatatagttgggttaatatttatcttatttatgactatcttctatttgttgcctgtgatcctggttcctttttttgtcttctactctttccgcattttatgaatttaattgatcactttatattattccatttcatcttctttttatcttagcatatcagttatatatttttccttggtttcttataagttatttttagtggttgctctgaagtttgcaatataaatttacaactaatccaagtccaccttcaagtaacactatgctgcttcataggtagtgcaggtaccttacaataactccctaaaaataatacttaatatttctaacttcttaaaaaataataattaccccctccattctttgtatcattgctgttattcatttcacatatacgtaagcatacacatatatatgcatttttaataaaaacattgtttctgttattaatttgaacaaattattgtccatttgataaattaagaaaaaggtatttattttactttcacttactcattttctgatgctctttctttatgttgatacaagtttctgatctatttcagttttcttttctctgaagttcttcttttggggtttcttgcagggagggtctgctgacaacacatcccctcaaatttttttttttttttggtctaagaaaattcttatttctctttcacattttaaggataatttcacaggttacagaattttaggttgatgatattttcctcttaatattaaatatttcatttaattcttttcttgctttcatagtttctgataagtcagatataattttatcttagtgagtgctttttttctttctctctagtttctctcaggatttttgtttctttattttgattttcttcaatttaaatatgatttgtctaggtgtaggttttcttagcatttatcttgcttgctgttctctgaggttcctgaatctttggtttggtgtcagacataacttgaagaaattcttggtcgtgggtgattcaaatatttcttctctttttttttaattcttcttctgatagtctcattacatatatgttacactatttgcagttttctcacaattcttggatattctgtgttgttgatggtttttttaatctttttttatttttcttttttggcaataacaattgaaatatccttaagctcaggtagtcttctctcaaccatgaccgatctactaatatgcccaagaaaggcattctttattacttttacagtgtttttgagctctagaatttctttttgtttctgtctgagaatttccgtctctctgcctacattgcccatctgttcttacatgctgtctcctttatacattaaagttcttagcatataaactgtagctttaaaaattcccagtctgataattctaacatccctgccttatctgagtatggttctgacacttactgtgtctcttcaaactgtgtgtgtgtgtttctttttttagtatgccttgtttttttaatatatatctgaacatgatgtagtgggtaagtagaactgttgtaaatagacctttagtaatgtggtggtaaggtgtggtccttaatcataggtctggtcctatgattgagactcggtcttttagtgagcctgtgcctctggactgcaaccttcacaagtgcttctctgttccccctcccaccctcttttacctttaataggatagctagaatgggctgacgttgagtattttccttctcccagttggaaggctagagcctgctggagttgggcatttccctttcccaggtcatgtagactcgaattaacccccagtaggttaggttcaagttaaacagtttccccagggacagacattgtgaagaagaaaagaatagtgtatttcaaaatggttactttctcccttcccctgctggaagcatgaagggatttttttttcctctaatattcactgtgggaatctagttcctcaaggcaaaactcacataagtatgggcacccgcctatgactagatccccctagagtttttgactctcagaattttccacactgagtctccagcaagtcatcaaatacagttcaggttttcctatagcccagcaatagttcccacagaggtttctggtccagtaagttgcaattctccttacaggcgtatcttgccttagagacattgaaggttcagttccagatcacagccacaaagtgaatactgcaataaagcaagccacacatttttttgtttcccagtacatatcaaagttatgtttccactgtgctatagtctcttaagtatgcaatagcactatgtctaaaaaaacaacatgaataccttaatttaaaatacttcatttctaaaaatgctaacaatcttctgggccttcagcgtgtcataatccttttgctggtggagagtcttgcctgggtattgatggttggtgcctgattagggtggtggttgctaactgaggcaatttcttaaagtaaaacaacaatgcagtttgccttatcaattgcctctttgtttcacaaaagatttctctatagcatgccatgctgtttaatagaattttacccatggtagaacttctttcaaaattggagtaaatcctcttatccctgctgctgatatatcaactaggtttatgtaatattcgaaatcctttgttgtcatttcaacaaggtccatagcatcttcaaaaggagattccatctcaagaaaccactgtctttgttcctccataagaagcaactcctcattattttcattctcattttattgtcagattgtagcaatttggtcacatcttcaggctctacttctaatactatttctcttgttatttttaccacaactgcagttacttcttccactgaagtattgaactcctcacggtcattcatgaaagttggcattaaattctttcagacttctgctcatgttgattatgttgatcacctcccatgaatcacaaatgttctaaatttcatctagattggtgaatcctttccagaatattttcaatttactttacccagacccattggaaaaattgctatctatgacagctgtagccttacaacatgcatttcttagataatatgacttgagagttgaaactactctttgacccataggctgcagaatggatgttgtgttcacaggcataaaatcaatattaatttccttgtgaatctcgatcagagctcttgggtaaccaggtgcattgtcaataagcagtcataatttcaaagtaatattgttttctgagcaccagttcgcagcagtggccttaaaatattcaggaaaccatgctgtaaacagatgtgctgtcatccaagctttgttgttccattaataggacacagggaggatagatttaacagaattcttaagagctctaggatttttggaaaagtaaatgagcattggcttcaacttaaagtcagcagctgcattagcccctaacaagagagtcagtctgtcctttgaagctttaaagctaggccttgttttgtcctctctagctatgaaagtcccagggggcatcttcttccaatataaggctgctttatcttcactaaaaatatgttgtttaaatgagaacacatggacaagggaggggaacatcacacaccgggccctgtcaggcataggggacaagaggagggagagcattagaacaaatgtacatgggggttaaagcctagatgacaggttgatgggtgccacaaaccaccatggcacatgtatacctatgtaacaaaacagcaccttctacacatatatcccagaacttaaagtaaattaaaaaataaaaatctgttgtttagggcagccccctttgtcaatgctttcagctagatcttctgaataacttgttgtagcttctacatcagcacttgctgcttcctcttgtacttttacattatggagaagacttttctccttaagcctcatgaacaaacctctgctggcttctattttttcatctgaagctttctgacctctctcagacttcagagaattgaaaagacttagggcctttccttagattttgctttggcttaaagaaagatagtggctggtttgatctattcagaccactgaaactttctccatatcagcaaaaaagacttctttgttttctcaccatccgtgtgttcactataatagtacatttaatttctttcatgaacttttcttttacatttacaacttgctcaactcctcgatgcaagaggcctagctttcagcttatctttgctttcaacctgtgttcctcatcaagcctaatattttctaaattttgatttaaagtgagagaggtgggacgcttcctttcacttgagcatgtagagaccatttgcagagttattaattggcttaatttcaatattgttgcatctcagggaatactgggaggggggaattggggatgaagcaatcagaacacatgtggtgtttattgattaagatcgattcattttgccatcttttatgggcatgatttgtgtcccctccaaacagtaacatcaaaaatcactgactatagatcaccataagagatataacaacaatgaaaaagtttgaaatatattgagaattaccaaagtgtgacacagagacataaaaagtaagcacttgctgttggaaaaattgtgcaaatagacttgtttgatacagggttgccataaacattcaatttgtaaaaaaaaaaaaaaaaaaaaaaaaaaaaaaaaaaaaaaacacacaacatctgggaaatgcaacaaagatgaagtgtaataaaatgaggtatggctatatctgctcctgtctccaaaattttgagagtagatgtttaccttgcaatctcacttctattatgggtctaagaagagttgctggccttctgtgtgttcagctttttacttattgttgcaatggagtgatgatttccaagttcttacatttggggcaggaaattggaagtccaaatatagtattttcaaatgacagaagagcatattttcttcaaaaatatagccagtatcaatttaaaactcaaatgtttaaattcccagatgacgaaattttgtatattttctcttattctgatttgctgacttattcttttacaatatttatactgacaaccaagccctcctccaagtatagccaggagaatttagtcttctgaccaaattcttgttcattgattgaaatttataaagttcataccttttgccaaaaaccaggctcattcttagaaacagaaagacttacaggacaataaacttgccagattatgtggcagattcaggaggaaactctcacaatgtcttttgtgatatgaatctgtatctgaagaagtattcatggacttccacgctatgcaagacattctgacaggtactatggaagttaacagaaaacaaagggcaaggcctctgccctcaaaagtccattatttagttggggagaaaagcctgaaactgaaacatcaagtcatgacataagaaaaatgcaggatgttaaggagtagttgccttataaggtataaaagtggtatgataatacttgccaggagttcatgtgaggggtcgacccttcggccaaaaaggataaggtggaccacaaaaaggacaaagcccttgacctactttttggaagaaatataatttggatacaatgttatgctcatgattcacattatgctatctcacatccagatttcagtgggctctgatatagcttggctgtgtccccacccaaatctcaccttgaattgtaataatccccacgtgtcaagggcagggccaggtggaaataattgaaccatgggtgcagtttcccctatactgttctcatggtggtgaataagtctcacaagatctgatgttttcataaataggagttcccctgcacaaactctcttgcctgccactgtgtaagacatgtctttttctttcttcaccttttgccatgattgtgaggcctccccagacatgtggaactgagtcattaaacctctttttctgcataaattactcagtctcgggtatgtccttattagcagtgtgaaaatgaaccaataaaggctctgtgtgtctttctcttttgaaagtatagaaaataattagagctaactttaattagtaacttactatattaggtattatcctaaacaatacaatgattatgaggttgatctgatataggcaccgttgtcatgatcattttcggatgagaaattgagatactgagagattatgcaattctccttgattcacacaggtcagaagggatgagcataatcaaacctaggcagcctaattacaagtgtacccactttatatgtactctccacttaaggcaacaaactgataagggaggtcagtatgttccaattagcatttaaaatcagcatctccctctaataaatgtctaaattatattaaatctgggagccttgtgaattgtagtggattcattgagcaaactaattaagcatggttcaccatttgctggattgattttatatcacagaaatcaacctttcaaataattatgaaacaccaaattgaatataaactaaaccaggtaataaaaacacactccgatgcttcacagtaaaattcaattattattgctttttgaaactaaaataaattgggcaaagtgtttttgtatttagtctataggaaaatttcttgtttattattcatttgtttatcttagctctgtagcttttatttatttatatgtgtcatttttttaaaaaaatattttttaccagtaaaggaagaatcattaattctaggaaattgctggaaagcaagctctttattgtattctgtactacctgattttatgacttcagatctctcctgaagcatttcgtgagttctaatataaattcaaattcaactgtgatgtattttagttctataatgaaaataaagatgagctgtctttcaatttctggagttaattatctttgttgagttcaggattatgaaaatatattgtagaatgtggagggacaagactgtgcacaagcgagggtatagctattggatagctccaacaaaacatctttcagtgagcagcaataattctccttgaaatcttcactggccctccactccgaagtaatctctcctttctctgaatgtggaaagcggtgcaggatgtatctctattagcattctatcactacttaggttatttgcttacctcttattcataatgaatgtaagcatgagtgcaggaaccttgtgcgtctattttctagaacaccattaggcctgatgtctagagcatcaggctacaaaaacattttggagtataatttatcagtgcccaccttgcatagaaaagttttgatttatcaacatagaagcagagctaagtaataaaactatcacctatgttcatgaggctcagctagtgtgatgaactctggtgatagtcattattcccctaattttcacaacctctaaggtagatacaatctccattttacagattaacaaacataagttattaattttattaattaaatttgttggttaaaactcaggctttatttaaaaaaatagtatcactatttgttgagagacacagttcccaagtcatcaattttactattctggattgcatgtctggcctttgaatttgttcagtaataattagtgttgaacctcaaagccaagctattaggctacctaaatctagcaaaaaccacctctttttaaaatataaatatatgcagaacacatttatttactttaagaggatcacaaagtctagtttcattgatacatctcatgtttctcagtattttttatttattccttaatttatggaggtaatttagaaaacttaaaaaatacatcattcaatggctttaatagattcacatagttgtacaaacattgccacattgtaattttagaacagtttttctttttttactgcaaaggaacttcatgcccattaatagtcactcttcatttactccacccacgtcccctagccctaggcaaccactaatctactttctgtctctattatgtatttgtggtctttttgactggctgttttcacttactataatcaaaaacttgtgaagtttatttaaaaacatgtatttctatacagacacacacattcattctaatgatattacccaaagaaaaccattgttgtttattgtttggccatttcatattgtggtccatttccatgtgttcaaaaataaggctgtatttgatataacagagtttttacttaattacactgaacttgagattattcaagctaatataaggcaatagtagcataggttatgatcaagtcacttacatttacctttgggatatactatgtgtagttttgacagcgtgtttgcttaaataattatgttcagctagagtaaagtcaaattatttttgaattcccctagcacatgtcaactaggactagatagagatggatgtaaagtgtcatgtcaagcagaagtcaccataagattaaagtcttattataaataatccacaatgtgaacaatccaactatagataaagaattttgactgcatgttgtataactgccttattagatgctgaaaaatgtggacattaatacttggatggaaattgttatcatgattaataacaatgagttgtggcaattttacaattaagagaatgttttggggatccatgttatataatgagggtctttgtggaactttgataaaattcattcttctagatggaattacaactgataatcataatatagctaacatgtattgagtaattacattcccaggcactgctgtaatggttttacatgcactcagtaatttaatcttcctcataacgctatgagactcagattaaagaaagtaaatttcctatagaccaccagcaagcattggtggatgtgcaaaatttcttaattccatactttcgttttcaatgtgtttttgacataggataattagattattaaaaattgttttctctagtgaagaaatgctactattcctagtaccaatagaaacccttgtttccctttgaaagaaatatggagcgcctgaggactagataaccaaggttgcctgaggaaaggatcacaataacagtaggcaattctgtcccaagaatgagtgcttcttaaaacataaaatagttttaaaaatttcttaagatagaaaatgtattctcagtcagattttttaattttgactttggttaatcctaaaatttccgggctaacaatggaaaaatgtttcttaaaattctagccaaatgttttcatttattcaacagagttagttagtttgaaattcttcttgaatgtctcagtattgctcaatcaaatggaatctaggttagactaacaaatattgttgacattgagtaagaatgccatagagtgcagagatgtggtaggagctcagattccactaatccacaatattatgagtcatttaacacaaattatcgtcatttcagcagaaagtgtttgtacttaattgaagtaagtggtcccattcaaaatctttctttattcagtctcttcaatcaccaaagcaaaacaggatatatgcatctttgaataaatatctgatttattgtgtatctgttaatttatatagaatatattaatgttaaatggcaaaaactgcaattacttttgcgtcaacctaataatagattgtttaataaataatagtgcacatatttgtgataactataaagacaaaatagctaaaactaaatcgatgatatttgacctatgtagctaaattaagcctgtgtctttcatgtttcatacataaattctgagagcacatatctagaatatgatatcataaacatcaaaaatttgaaaatcactttcgtgttagtctttagaaatagtgagaaactgtgttttagaaataattttgttaaattccattagtgcactgatataaagctaactgatagaattatttccaaatatttatgtttagtcaggatctgagctacaattcagtaatggaaaaggaatcgttggtaatatgaaaatatttatcagtgtgtatttcataatattacagtgcttttgacattgataaagtaccccttgctttactacatgttgcttatcactggtaagtagtgtgttaattagcattgcatatatatatatatacacacacattgcatatatatgtatatatacatcgtgcgtgtatgtgtgtctgtgtgtgtattgttaaagctttttttaaaaaaaaaaatttgtacagaagaagactcagacttggctcatactcctgggctcaaatgatattctcgctttggcccctcaaaatgttgggattacaggcatgagccactgtgcccagatcatcttaaagctttaaactaaataagtagcaatgataggataagctttagaaataaatctctgtagggagcattctcataatgtgttctgtcttgattaaccactaaagaattttcttaatgcatattttaagcaggaagagcagggacataggcactttatacaaaaataaattacatatatttagtacagatttttatgttgcaatcaaatcctagatagttacacagaagtaataagggtgcagttgtcagttaaaattgctagtttttttccttttatttttagttgacatgtaataattgtacatacacagttatattttaatatatgtgtatatgtgtaatgatcaaatcagagtaattacatagccatcaactcaaacatttatcatttctctgtgtgtgaacatttaaaatcctcttttctagcttttcaaaaatatacactaaattattgttaatcgtattcatgctgcagtgctacagaacacttgaatttattccttccatttagctgtaagtttgtattcattaattcacctctccctacccccactcctcccattcttcccagtctataataaccacaattctgctccctgcttccatgagctcaattttctttagctcccacataggagtgagaatttgtggtattatctttctgtgcctgacttatttcacttatataatgtcctccagcctcatccacattgctacaaataatgggatttcattttttcaggcagaatagtattctattgtgtatatgtaccacattctctttattcattcatctgctgattaacacttaggttgactccacatcttggctattgagaataatgctgcaattaaaaggggggtactgtttctcttttatatgctgatttccattcctttggataaatacccaatagtagtggagttactggactgtaggatagtcctacttttagtttttttttctcagaaacttccatactgttctccatagcagctgtactaatttacattcttgtcaacagtgtataagatttctcttttcgcttcacctttgctagcatttttttttttttgtctttctgataacagctatcctaactggggtgagatgatatctcattatggttttgatttgcattttcctgatgattagtgatgaacagcatttttccctatacttgttggccatttctttaaatagattaagaagacaaaattttaagaagatatttagagaaaatgtagaaatatagagtaaaatatttgactgtgggggacatgaataaacgtaaaatataaaaacatggtttatgaataacagataatgtaacacaatttggtgctcttttcagtaaaatatatgtctgtatccaatataatttaagtgtactatgatcctagtaaaaatatttaaagatcttatttatctcagttttctagctctctcaggaaaataatttttttttttatttttaattttaagttcaggggtgcaagttcaggtttgttacataggtaatcgtgtcatgggggtttgttgtacagattatctcatcacccaggtattaagcctagtacccactggttacttttcctgatcctctccctcctcccaccttccaccctctgaaaggccctagtgtgtgttgttttcctctatgtgtttatgtgttctcatcatttagcccccacttataagtgataacatgcaatatttggttttgctgttcctgtgttagttggctaagataatgacctccagctctatctatgtccctgcaaaggaaatgatctcagtcttttttatggctgcatagtattccatggtgtaagtgtaacacaatttttttaatccagtctatcgttgatgggaatttgggttgattccatgtctttgttactgtgaatagtgttgcaatgaacatatgcgtggatgtgtctttataatagaatgatttatattcctttgcacatgtgccaagtaatgggattgctgggtcaaatggtatttctgtttttaagggtgtaaattaattcagccattgtggaagacagtgtggtgattcctcaaagacctaaggagaaataatattcaatttcttggaaagagggagacactctgctcttcccatctatattttcccaccttgatgtttaaatagaagagggataatgaaattatataaggaagcaggtgagtttggatcccatactctcataagaacagagaaatagttacaataggtggcatttatggaatggtatctatataaacatagtatgctctttgttttacatgccttaactcataagtcagtattgctaaagagaattcagtttcatagctgttgtgtaaatgagaaaatactattctacctctattatttattaattcataaaggggaagcaattagtttatatgccagtgaattaggtttcgactggaacaagtgtaggaagattaagagcaccagaacctgaaaactaaaatggaagtagccataccaatgtgagatgtgaaagtggagataatttattttataaggtaaactgtgataattagttacttctttatatttagcaaatattaaatgatacttattagtaattatttagaatactaaatcttatttttaaatgactgggaattgtaatacaccttctagacactttgcttttatcatgtgttgattaatgggatcttattaaactaaagagcttctgcacagcaaaagaaactatcatcagagtgaacaggcaacctacagaatgggagaaaatttttgcaatctatctatctgacaaaaggcaaaatccaaaatctacaaaacttaaacaaatttaccagaaagatacaaacaaccccatcaaaaaataggcaaaggctatgaacgacacttttcaaaagaagacatttatgcaaccaacagacataggaaaaaatgctcatcatcactggtcattggagaaatgcaaatcaaaaccacaataagataccatctcacgccagttagaatggcgatcattaagaagtcaggaaacaacagatgctggagaggttgtggaaaaataggaacgcttttacactgttggtgggagtgtaaattagttcaaccattgtggaagacagtgtggcaattcctcaaggatctagaactagaaataccatttgacccagcaatcccattactaggcatatacccaaaggattataaatcattctacgataaagacacatgtacatgtatctttattgtggcactgttcacaatagcaaagacttggaatcaacccaaatgtccatcaatgatagactggattaagaaaagatggcacatatacaccatggaatactttgcagccataaaaaaggatgagttaatgtccattgcagggacatggatgaagctggaaaccatcattctcagcaaactatcacaagatcagaaaaccatctgcatgttctcactcataggtgggaggtgaacaatgagaacacatggacacaggaagggaaacatcacacaccagaacgtgtcgcgggggtaggggggtaggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggcggctcacgcctgtaatcccagcactttgggaggccgaggcgggcggatcacaaggtcaggagatctacaccatcctggctaacacggtgaaaccccgtctctactaaaaatacaaaaaattagccgggcatggtggcaggtgcctgcagtcccagctcctagggaggctgaggcaggagaatggcgtgaacccggggtgtggagcttgcagtgagcagagatcgcaccactgcactccagcctgggcgacagagtgagattccgcctcaaaaaaaaaaaaaaaaaaaaaggtgttgattaacatctagcttattatttatatatgtgcatatatataatatgttgagcaagtagaataaaacatttctgtaagacgtgaaactgattttatattaatacttttttttctttaaaactgtttttcaaaactctgttataatgggatacttctagtaggcaatcttcaattccttaagatacttggttagaccattgtcatcatggatggaacaggcttgaagagagagttgcaatttgccttcctaacctataatggccacaacattagtatcattacttatatgtatcagtacttatcaatgaaaaatacatctatgtcatttattgtatcatatgatgtataccacatcagaatcattacttgaattaaactagtggtgattcaaccttctctgtcacctcactttttctttttatcgtgagaaatttccatgaacttattttgcaaattaagtgctttttacaatcaatgattagactattattagtaacaacttgcttgtcataagttttacaacttatcatagcacagcagcatatcaagaaatttgagcactgcaactctaggttacaaattattatcaacaaatgtagataatgtcaagagaatacgaatttaatatttaacaatgaaacatggagtgttttgatagcaaagaaactaacattctcttctgctcctaaggtgtaggcagtctacttacaagcagagaagaagcaaatttacatgactatatgtgtatatacacagacacatatacatatatgatatttgtgtctttgttgtactcattgaactgcatacaagtgctttttcttaagccaagttttcattaattaatatactagattaaattagtgaacattaccatatataagcagagaatatccagttttcaattacttgtttttattcttctactcaatcatagactgttgattatttagaagacactataaatatttcaccttggtcataataaataatgatctggtcaagtaaaaataaaaattaactgatagctaatcttgttatagtaataaacaatggacatagataaaatacatatgtgaaaaaatgaataaacaaatgatgcagtgtgtagaaatacccactacaaatttaaatcattttcgtagtgaatatatgatatatatctcatgcatgtctgttgtacctatcaattcatgaatagtgagatacagagacagatacacatgtacatttatgcagttgtagcaattgaacctgtgctgtgtgtgttctataacaatattatattaagtgaatatagtcaactcttgattttatatatatatacccttttatgatcaattttaattttaattctgggatattttgccctaagtatataatacatttctggcacactattcccacttcccaacttgcctattgtcagtcagagactacaaggcaatttagtatcaccaaagcaaaacaagattacaaaaatgaaaaatctgccatttggtattatctctatacttctccctatattagcagagaaaattgacttgatgtctattgctgactcttccagaattgtggcttcagcatagctgagtgatttcatggatatattagccagttggcttgaatattttacagcaaataagcaaaaactctcagtattagctttttcattattcattatctttatgaaatcatacactcttacattaaagtaggaacccatgttacgacacttactttactcatgaagaaactgagactcacagattagcatccatgactgactaaagtacaatttataatagcagatctgagagtagaactcatttttttcatctctatgcaattcattcaacaatcaatcagtaaatatttatagaaagtaatatgtattgggctctgggaaactcatctattattacaagaatcagaaagctaaaatgtaagcaaatatatttggaagataattacgtattaaaatatgtactatgcaggaagctaacaaggtaatttgtaaaaagtgcgattaacaggagaagttgtggtgatgcagacctactgaataatgggagacattttccctaaggagatgacatttgatgggagaaccgaaaagcaaaaagtagtcaaccacaaaaatttctgggagaggtacattctacatcaaaggaacaggaaatacaagggttcaaggttaagaaagaacatggggacttcaagaaacagaagagaaattaatataactggcatattgtgatgggggcatagtagaagatgaaaatggagaagcaggcatgagccagatctttgaagcccttcatgccctggtaaaaaatatagattttattcagtgtgaaatgggaatcctctaaagatctttaagcatacattatctgatttgaattttatagagaatgttctgactacaatttgaagaatcaattgtaggaagcaggagtgaaaaccattgctgtaatgtggatgtgaaattaagacttggactatggggttgacaatagagttggagagaagtcaagatatatgtttggatttaaaatcaataggatttcctggtcaggtggatatggagagcaagataaaaggaaatcaagggtgatttccatatttctagtctgagcaattagatagctacaatgtcagttattgagaaggaaaagactaggagaaaaacagaaatgggagagttattgatacagaattattttcacagtatgtgaagatgctaggtcaagagaaaatgtcaagtagtcagctggaagctcagagacagggaaatcttgcacaagttatacatttggtagtattgctagacaaagtcctcattaagatcaccaagggatagtctatataagtaagagaaggtgattcacgaccaatccataggtattttgtaattaaagaattagagtgtgcctatggaaagggcacacatgaaaggaaaataagaaaggatagccaaaggtgttggaggaaaccaagacgcactgaatgtttctcttcattccttttccctttattgtcctagaacaattattaaataattactgaaacatttttccacagtttgatttcagtaattattaaataattactgaaacatttttccacagtttgatttctaactctcattcctttattcctgtttattctctttaagaacctctataagaggaagttcattattcttgtccattattgtagtctcaccttcagtgcagtatctggaacatagcagacactcaagaactatttggtcaagaaacttatttccatttttgctgctgttgtttttattcctactttgtttcttttctcaggttatcctgtttcaagacctctaatggtctgatctaggtctcaggggtcccctctggcttgttttctttccctagcaggtataaaacaaattatggatgttgttagttaagagctacacttaaacagattaaaaatgaaggagaaatttagaaaagagcacaattcatgatttcactagtaaaatattattttgtttctttctaaattatgtaaattatatctaaggctgtgtacagttgctcatgcctgtaatcctggcactttgggaggccgagataggagaatcacctggggcccgagaccagttgggctgcaacatagtgagaccctgtctctacaaataaaaaattagccagacatggtggtgcatacctatagtcccagctacttgggaggctgaggtgggaggatcacttgagctcaggagtttgaggctgaagacctatgattgcacccctgcactccagccctggtggctgagagagaccttgtctctaaaaaataaaaataaaaatgaaaataaaaataaattatactcgtgctgtccgacattataaccactaggcatatgtagctattggtcacttgatatgtggctagtacaaattgtgatgggtcattgtacaaaatattccagatttgaaggcattactaacaaaaaaacctaaaatatgtcattattaattgaatattatatgctgaaaaggtaatattctggatacatttaacaattactaaaattaattgcaacttctaaaatttgtttaatgtggatactagatatttaaaatcaaatatgtagctccctttataatttattataattataataaacagtatttggatagtactgttctatacttttgatacacagagcaaggaccttagatgatttaggtacgactcagtgtattggtaggcatgtaaaatctcaggtcgtttttcaggcctatgaataaaattctgtgttttaagaagatccccacataatttgaatgcatgctgaagtttgcaaaatgctgctgtatatattgttgctgtctccaaagagcaaggtgtgattttgccttcgaacaatgacatatccaacctcatttccgatgtaattcagactaaaatctaaaaactgcaaatcctacagtgatgcacagaaaggttaatatcaagtgtgaacccagcttacaagccatagttctgcattttcaactacaagggttcatgtgccatactttggaattagtgcaagcaaaagccagctcacattgcttgtgcattttgttacctagagagatttgcatttagcaaatttagctcagctggcacttataaaaaagccattgccagaatgcctgagaaatttagtctcttgtatggtacttagagtggtcagcaggaatgttagcagacaacatctcatttttgcaattaatctgctttatcactacagtgtaatttaaaagaattttgtctagcaggagtctttttatttgctgggttgtgattttttccaggttatatgttattcccatgctaatatttgccttaataataatgtgtggactttaatataaatatgattttgcagcagcatattaattacaaatatgttgcaataacttcaagaacccaatttttgactattttatctttacatttgatttattagttttgtagattcttgatttgtttagatagggttgggagagtagagttcctttttaaaaatattaagtctatgtaaacatagtcatgccatctacttatttgcacttgaggttcagaaaaaaaatgttatgagaatttaaaattttgacttaattaatttatttgtataatattttaccttaaaaataattgaagataattgtgatatatcatatagatcacatttcaccatttaatatgattcagtacttaggcaatggaagcagaatttagaaacctctctttattggaattgaattatattaaaagaaatgaaaaataagttattaacacatttcctagaatatgcatcccttatatatttgttgttatgtagtagaggctgtcatttatcaattaccctctgtagtagacagaactaggttttaggagtcataatttttatcatttgttttgtttttcacaatacaaatgtgcaaatgtcaaactcctagaaaaatacattattcttcatatatattatatcaatgatataaaaactgagaattattagacctatgtgcaatgtagaaaagcattgaaactcatttcaaacatagcataaatgtattcaaagcattattgaggaagaatgaataatatgggtttgaaaatgtggcaaattatcccaaaaatatgtagctacttacccagctggcatcatggccacacaaacaaaacactgttcccacattgtttcacttactttccatggcaagtctcaagggcagtcatatcttcattcttatattaaagctgaatttcagaaaagccaagcaaattacccaagggcaaataggtaactgaaataaaaaatataattcatttctgtctcatttcaatgttgataatttgctcattacccatgcctcaataccagtcaaaactcaatatttctgtatctttggtgtcattttaaaatacttccagtatgtatgtataatttagtaggaaagtttgctgaattatacctatatatatgtgtgtgtgtgcatacgtcttaagatattgacagtcccaatagaataataattatttagttcatttttcataaaacattaaaatcactgccaaagtcactgatgtaaacactttgtgacataataaccactctgttccttagatgtagcagttaatgcgtgcgtattattgatcattatctagttgtaacagtaaaagtaattgtacacttgagtaattcttgtaattattattagatgtattccatgtctacacttgtaaatgtggaaagcatcaatagttcaaaagttttaatcaagggcagagagattatatctgcggctaaccctcatttccaaggcctccatctctttatattgtatctttatggattaaaagttaatgcagtttctcagtgcctgcatcaccaacaaatcacatacagtgagttgaagctggatttgtgggaacaattactgttggttgtatttattatataaatacatttgatgattcccaacagttctggagagacatggtcttaataattcaggaaaatattgggaatgcattctctaaaaacacagctaatcaatacaatatagagactaataacaaaatgaataactttttaaaaattatttccattttaattctttgttaaactgggaaaacgcacatctatgcagatcaacaactgtaaatgattttaaattgtgcaatgtggaagtgaacgttgctgagtttgcccaggacaaactgtgctgacatatgggaaatttagtttatttcagtttttacagaaaagtatcttcacagtctaaagtactggtaaaaaaaaaaaaaaaaaaaaaaagaaaaagaaaaaagaaaaaggtgactcaggaatcaacacctatatgtgataagtaggagtctcatttttactcccctactcaactttctctctgttagatgtgataatgaactgtgaaatggtcaaaatgagaggaagaaaaaaggatgcggctaatttccaaactagatagtgtcaaattcagagttgtctacagtaacattagctcttgatatttgtgataaacatgtgatgttgcaaagtatataatattaccagttgaatagatgtagttatatgaatattacatgtaaatttcttttaatcattttagatttaaaaagttgaggtacgttcagattaatttatgaaaatgtcattttagcaatgacatattatttgagtgattaaaaattactcaaattcaattgaataacctacataagttctaaaatcatcagaataattcttcacacttcccattttatcagtttacacacctgatttggtcccaaattctgattcttctgctctgccctttcatcctcaccatcaatgccttagttcattttctcatcatctttcaccaggatttttgcaatagtcttctgcctcctctcaaacattctttactcatttgattccccacattgcctccatggacattcagattccacttattgtaaagtctgctttttcatagttctttggctaaggtgttgtgtagggtaataaagagagaaataaaataataatagatgttaagcagagccatgtattaaaagttgcagattattttaagaaataatttctacttttttaatttaacaaacactcattaagactcattaaccgttctcattaacctttagaggatacataaattatactatatatcctattctgaagacctccaagtagagaggaagcatgtattattgccaatgccaaaaaatagaaactatgtatcaaactgggtcagctctgattataggaagccaagtatctaccgtcaatcagagataggaaggaaaatctccctcatgtgaaaactaatggtggttttaggaatattcctatctgggagtggatggagaagagtgtatcaattaaataaagtgatttggcacacaaaatacaacaatattgatatataacagaatacaagaggatgggtaattaatcatgaacagaaatttatttcctacgtttgctcttggaaaatccaagagcaagttcccagcacctggagaggaactttttactgtgtcattacatggctgaaggtgaaagggcatgcaggagtcagttccatttttaagtgcctttttaaggttacctaagcccattcacaagaaaggaaccctcatgatctattcagctcttaatggccccacctcttaatgtcatcacattagcaatacctgaattttggtgaggacatattcaaaccacagcagtaatctcatgatgcatttacatcatttgacatatctcatttttttgtcttcaaattatcaaatattcttttataaacatatagtatatgattatgaaattttcataatttctaattcattttagtctcataagcaagaaggaataattcattattataatttcttatatatttcagttagaaccctttaagatggaaaacacctatagttagtgcctacatagataaattaagtagaaataagtcaagttttacagatttgccttatttgcctcctcttctaactccaactgtccaattagtctctactataagggcacactgaaataaaggtaggaaggctttactgtcagaactctgtatatgtttattttatgtcaatgctaagggggttcttttaggtctagtgaactaatagaaaacaaaactaaacttgaagaaagaagcaatagcctgtaataggacagagactgggattttgtgccgataactcaacatgtaactttggacagggtacataacctctttggccctcagtgtttttgattgataaaataagaaacttcaatttgatcatctgtgatgtttcttctaattcaaataaagtacagctataaatatttttcataatgaaccaaaattgactttcacaattagccagtttacatgatatataaaaacattgtcatccttctatttttctcatatgtacttgtctcttttttctaaattactggaaactcatactattcctctactacatttttcctctgccaccatagagttacatcagtctttgaacagaaacagaaagtgcagaaagcctgtcactaacgtgacctcctcacagattttgaattattacctcaagaagagggaaagttggaacagcttatatcattgcagaaagatattttacctgtctacatacaatttttctgtgatatagcttgtttactctttgttagagaaagactggcttgtatctttgtgtcttggacacagtacagttgctccatcatttgcagtacagctaatactcatttgggtaccatgcatggatacatctattatctcactttgttttcaccataaacctccgaggtagagatgaccattttcctcatttcgagtaaggaatccatggccaagagaagtgaatagcctactgattccattagctaaactaaagactatttgaatttcaccagatgtccttttctgttctagaatctgacattgcacattgtgtttggtctctggagtctcctccaatattcaacttctttttttttttttcccagtcttgacaattttaatgagtagtagtcagctagcttctttgttgagtctttttcaatattagctttaaaattaaatttggattatacagtatgggcaataaaatatcatagaaatgatattttttctctcactgcttcttggtaggactacataatattaacaagtcttattactgattgtattaaccttgactaactacgtttaacagtttttctttactgtaacactgtgattctcctctttgtattggaaaaacatatgagggggaagtttttgagactgtaacaacagcctgataccttgtttctcctcaaatgtttgctcactgatttcagcatccaatgatagtctcatctgcaacaattattaccgtggtttttgccaaatgatattttatttttataatttcttatatatttaatccaaaataagggtaattttttttttttttttgagacggagtctcgctctgtctcccaggctggactgcagtggcgcgatctcagctcactgcaagctccgcctcccgggttcccgccattcttctgcctcagcctcagctgaggactggcctcagctgcgactacaggcgcccgccaccatgccgggctaaatttttttgtattttttagtagagacggggtttcaccgtgttagccaggatggtctcgatctcctgacgtcgtgatctgcccgcctcagccttccaaagtgctgggattacaggcgtaagccaccgcgtccggccggtaaaaatattttttatatggtctcctttatctctagtcaacgttcttctctcccctcttctctcctgaaagcatgacaaaaaaatgatttactgcatgatttttatttccagaatgaatgaaggtaacatttttgatgactttgtcctttaaaggggttaagatattacactcttttcaatacccaaaggcgaactgtaacattcccacaaatttgagaaatattccgcttatgattgagtcagatgttgtcactcagccacaagttatcttccagagtttgaacttcctattgaagttatacatcaattatagaagctgactgaaatattgccatagattatatatgtgataggttctacatctgaggaggaaagcatctataatacattttcattaaagcagctctcaattcaccgtctgcttaattcctacattctcatgcatataacttatgagcagttttcaaaaaatgaaagaaaattgaaaatgtagcacagccaaggcatgcattggtggaacaggtaaaattgatttttatatttgcttggggacatggatcacttccctgaatctggtttgcattgatcagtgttgatggactatagattaaatgtcatacataagcccccattttcaaattcattatcctcaagggaaaagtatctgaagaaggatggactatatttataatccatgccaatatcaagatgaaatttgatacatctgaaagtgagaaactctaggaagaatactatttgtattaataagaggtaaaatattttcaataaagagtctattttttgattaaatcagccaataagtcaagaaaaagtgaaaaatatatgtgttgagggtctactttatacctctctgcacaatgagatatagggtttaaccacagaaattctttctatttaaatgttggtcatggtaggcacaggaaaacaaggaaagtggcaaatactgaaagtcagggttacttcctcccaaccctagaaaactactttggtagcacaccactggcgaatagtgtagcaatgttaactttctggtttccatgattgtgctaaggttgtgtaatttattaatataaaggaatgctgcctagggggtatatatgaactgtgcactgtatttgcaactttcctgtaagtctaaaattatttcaaaatacagacttttttaaaaagctgtaacagaacaggactaaatattataaatactgtataacaataaaataatttatatttttaagttcttatgttctgaagataacgtaaagataaataaagtccttgtcctcaaagattcattgcttaacatagttgagagctcttagaaaatgtggacagcttggtgagttgacagaaactgagtggtatagggtctttccttccttctttttgtcccccaaaagcctcaaacctgaaatattccaggagttaatagaaaaataatgtatacccttgaacaaagttttatgtgtgaaatttcagagtagattcttaacaaaggatggaaactgtgcaaatattattgtgtctatttataactgatttacattaattttcatttatcaagtactgattttttgccagctctcctggttcagaaaggaaattactgttatactaaacttacgagtaagaaatcagaatctctaaaatacggtgactgataaaatttttttttagtaatgggaaatggaactaagatttgaacttcctcaccattaaagaaggtacaggcaatgttgatagccacagcacaagacagaagggtaactcttcatgtaatggcttcactgagaaattgtagtgcagcctaaatggtgtacactcagtgaaattgccagaacagtgaggttcctttgtttcaacaactattatttataatgttgtgggggtgggaggaggggagagggatagcattagggagatatacctaatgttaaatgatgagttaatgggtgcagcacaccaacatggcacatgtatatatatgtaacaaacctgcacgttgtgcacatgtaccctaaaacttaaagtataattaaaaaaaaataaaaataagaaataaataaatgaaaagaaaaaataaatcctattgatgctagaaaaagtaattatagttttttcttctaatgagatgatatggtttttgaaatattttattgaatgaatttagacttagagattgtcatttttttcagaatattaaaacaaaaaatatatacttgtagaacttggcaaatgccaactctctctaattataactgttaaaatacaaatactatatggtaccgagaatgggagtaataaggcaatatttaattagatatctgctaatatcacatagatgttatgttttgtgcttcctcatgagatgtttgagggatttcagtgatatgacattttttcttcagtgcatattgtgttacagacttaaaatttacattaattgatcaattcaattatttatttattcaattcatttattcaataactattcatattggttatctatggctgtgtcacacattattccaaaattcagcaacttaaaaccacaaacatattaccttatagtttttttgagttaaaaatccaggaatggctcagctgggtgcttctggctcagggttcattacagaagctataatccagatatcagtaagggcttcagccatctcaaggctcaactggggaagcatcaactcttaagctcaaacaggtggtaggcagggttttgctcttcaaggactgttgtactaaggcttcagttccttgctgcttggtggctgaaaaccagtgtgaatcgctctctaaggcagttcactacatagcaactgatttccttgagtgtgggcaagtcagacagcaagaaaaaggaagcaagacaaaagccagactcttcttgtaatctaatcttggaagtggcatcccttatttctgctatattttatccattagaaacaggtcactagatccagatctcacttgaagagagaggattgcacaaccatgaatcagagatcattggggacaatcctacaggctgcttatcatggtatttattacattttaactggattacccaatttatagacacgaaaaagattgatcatggttttatggaatggcttaacttatggtccctatcctagaagtaattaaaatccctggaagaatatagaaaaataaatggataaattctaacaataatatgataaatagcataattgtggaataaacaaactgacaaaggaaaacatgtggtgtgttattcactctatttgggaactgtaaggtctaaagagaaaatggcataactgatacatgaagagaaacagcctcataattagtatcaaggtattctgtgtttcctataatattttaggtcaacttcaatttctaaacatataaacaatgatctttaagtatatataaaaatccctggccaggtgcagtggctcaagcctgtaatcccaggcatgggaagccgaagcgggcagatcacgaggtccggagatggagaccatcctgactaacacggtgaaaccccatctctactaaaaatacaaaaaattagccgggtgtggtggcacacgcctgtagtcccagctactcgggaggctgaggcagaagaatggcgtgaacccgggaggcggaggttgcagtgagccaagaccatgccactgcactccagcctgggtgacagagcgagactccatctcaaaaaaaaaaaaaaaaaaaaaaaaaataataataataatcccatagctattttatatgtgtgtgcatgtttatgtgtgtgtatatatgtatatgtacacatatgtatgtatatgtaaacatgcaaaatattccacaaaatagaatgagagggacatgaagttaatgcagcttttatgaaggaggtggtgactccttcaccgagatggcttatcatataagttagattttctcaaggtttgcatcccaataaaaaaaaggtacgataggttttaagctgtataagtgaatgtataactagtatttgatgtcattttactaattatcaacacagctgctctggtctgaaatttttaatgtcatgacagagctaattttaataaaaggtaacattttatgaccccaaataaattacacaccaatatatgcatctgctgcactaaagtaccataatattaacctgttaacaattgagccaaaatctttcacacaattcatcataatttatctgggtgacatatgactttcagatgctacatctctttactgaatgttttgaaaattgagctaagacaaaaacatccgtttatatgaaagaaagaaaaaacatacagaaatattgtaagattctaagaacatttatttaaaatgttcactttattaagaactaggcatcaggaattgaaagaaaaacctagatgggaggaatttactgaaatctccgtgttaaaaaagagagcatagcacttgtctggctttggaaaatactttcacagtaatcaaacaaaataaagacatttgatagcaaacacttggaagtggaaataggctaagttctttaattttttatgtaaccttctttatgttggtgtatagcaaaaatacatgggtccaaaatagagtggcattcatcttaacattttctgtgtgtgtgtgtgtgtgtgtgtgtgtgtgtgtgtgtgtgtgtgtgtgtgtgatatatgtatatatatatgtacgtagatatgtgtgtgtatatatatatatatatatgtgtgtgtgtgtgtgtgtgtgtataattttttttgagatagagtcttgatctgtcacccaggttggctcactgccacctgggttcaagtgattctcctgggttcaagagattctcctgtcagcctcctgagtagctgggattacaggtgcacgccaccacatcctactaatttttgtatttttagtagagacggtgcggggattcatcacgttagccaggctggtgttgaactcctgactacaggtgatctacccgcctcagcttcccaaagtgctgggatgacaggggtgagccaccacacccatcacattttctggccatttttaatgtgttagtaaatgctacgtatatttacattgcaaatattataccctgtatcatgataatttgaaatgactgaagaaaaaaaaatgaagtccaatactttcacagacacagagacctaaatgaaagaacaaaagatgacagccctagaaacggatttgatggtgactactgaaaatatacaaacacaatttccattgccctctagaaaagtaaaaacataagcatgatagctctaaaaaagacaagtctgaatgtactttagttcaaattattctagcacacatattgtagtattgttactaaagaatactataacaaaattactattatgaaaagtgggcaataatgatgataatggtagccatcttgaatgtcagctcaatatgccaagaattacactaaactctttatatattttctgcattacggacaatgactctgtgaatagggtattattgtttcattattttttatgaatttaaattacctgagatttatgaatattaagcattaacccaagtcacacagagaattggtgtgaaaccctgactttgtttaaattttaaagctcagaatcttgcagggctgtaataatcatggtttgcaatactcttgaagattcaataaaagggatttataaaggacatatacagactatcaggacactcttggcaaaacataaaagtaggccaaaaaaattactgtagtctttgtttttgaatctcagagtaaagcatagtaagctatcaaactgacgataagtgtgaaatcatgaattggaataaatgtggtgtaaatgagatatcattatctgacgaagtccacaccatagaaattaataaaccatctccgtgcaaataattaatgctgtttaaccacccaaagggtaaatagaatgtgaatcgaatgtctcaagttggttttatttataagcagtaaacaaagttaaagaatgttgctaagtataggataggcaacaattaaaaagcaaggaaaatgcttttctgagatctgctacacatttgtagatctgagtttcttaaaaaggattttatcgcttgccaaacgttgtagaaaattaatgaataaaaactaaatttaaaacaactaaaaagtatcaggagactgacagctgcacctgcgagtaatttaggcctgagtacaaatacacaaaagttaggaattaaatccaaatgacattttgaaatttactcttaaaccaaaacaaacaaacaaaacacattaccacattacaggatacataggagtgatatttttgaagtttttttaaatacaaaaatgtattttccaatactttatatcaacgtatgtgaggggaataagaggtacattggcaaaggtaaattgcactgtctcgtagccctgcacctttgtaacatttcaggaaagtcagtggggatacccagtaacgatgactccttttctgtacaaagttgcatcaggtagaagaaggcaaacccagtttaaagaactgggttgcctgtaagaccatgtatctttacattttcactatttatctcagaggatgagccattctcataaggtaaatacgggacttttccaaaccacttttatgagtgggtcaaaggttaaccacaaaatttaggtcagaggggggcattatagtgatgtctctgagaatggatgataaatattgtttcatggcaacttcagatttatttaccacaactcctcatcatttctaggtgcacaaataatgcaacaattctatgacccctggagcctcaaatgtgttgaattattttatataatagctaggcactgatagtatagttttgtagttttaaagtattatctggagttattttatttggggtattatctttataaaatgcaatgtatcttttccattttcctttatcttcagtattatattttgcaatttcatattgtgacttctatataataaggaataattagtgcacattagtgaaactcatctttatttgtgagaatttccatttaagcttggatcaaacatgctggcacatgactgcctttgattttacctgtaaaacaatagatttttgtagtccagtgagcaataaatgcttcctgcctctcctctatatttaccagtagataataatgaaatgtcacagacttgaacattattaaacttatatttgagatgcctttcagaatttttcacgtttcctgctgctgtctgccttttctcctctttgttgtgtctcataaatttttatgacctctttgcgttggaaatctgtaatttttcccagagctctgctaggtaccttctagcagtaataaaactcttgtcactttccattgcagctactttcagagtgaggcttactggcttcactctgcagcatattagataaaataatcaatatgctcaggttgaaaaattaaatgcagcatttgtgtatccatcgaattacagtgctttgagcttggaacagatggccttgcgagacatttgctagcttacttgagagtggctatttttttttcttctttttgtttgtacttgattttgcatttacaataataataataaaagaattgcccaagatgattggtataaaattcatttggctattcttgaaaaacaaagcattgtaagtaccaaaaataatagtagcattaaaaaaaaaaaacaaaaaactttctgttgaatgcagttactttctgagtaaatttacagtattctcttcccttacatttgtgaactttatgtgtgcttgtccctacttacctcacctctgtttcttacccaatgtgaacttatgtgtggatgtaatatttctattataaaactattaaataatagggaatacaaaatttttcaatattgtggagttatgcctatatttctttttacccaaaataaattaatgttaaaattaatctccatctcttctcccatatttctctttcaatctagtcatgatactgtgttctttacataggcaatttggagaggatggttaggtgtttaagaaaatgactgacccattgtttccacatagatctcaggtcactgattattctgtgaaatttggacaacctcaaagactacagagcattgaattaacttacttgttcaacactatttgttaagtatctattatgagtcaggtagacatttgttggagggtcctagatataaagcagtttataagacttgtgatcttaagagtgtggctataatttaaatatgatataagtcacatttatgttttcttgtatccttgttcccaggattgtttcagtaaagatctttaaattataaacattactgaatagaactgatttgtttttccagtcagcatatcatttcaggggccagtagaagcaaacccctgttctgttcctcatcttttatccagtgtctgaggatacaatgagattgtctttgaaggttgcaggtgtttgaagatatgtcctttgcagtttgaaggacatggaaaccaatccagaattgcatttaaataaggaaattagaatagatgcagaaatggaggaaggaaaaaagcaaactgaaacatagcaatgaggcccaaaagatgtagggctacataaatagatttaaaaccttatattccaatttgtttgttttataaactcagtgatcttaatattagacaacaaatccttagaatcatgtaacatgtttcgcactttaagttattgtttttgtttgtttgtttgtttgtttgttttgagacggagttttgctcttgttacccaggctggagtgcaacggcgggatcttggctcactgcaacctctgcctcctgggttcaggtgattctcctacctcagcctcccaagtaggggaatttttttgtatttttagtagtgatgggatttcaccatgttggccaggctgctcttgaactgctggtctcaagtgatctgcctgcctcggcctcccaaagtgctgagattacaggcatgagccaccatgcccaccctatcattgttcttaattcttatattttacaagaaaagctggctctcaattgatgttcaacacatgcaacatatagaactgggaccccaaattgatcaataactcaagttgatgaaaggccatgttttaaaggcaaacaccacacagtctttcacattggtgccaacgaaggcattttggtatattccctggatgcaaccaaatcctgtggtgagaacctggtgaatgagaacctatgctacagtgtatgttggagccagctcacacaggcatatttcccaactctgtttggtgacttcacatcgatagccagccacagtgggagtatttacactacagaaatcaataaattctgcaaacatgtattttttttttctaagaaagctggttgttaaacagccaacacacaactgtccttggaggaataaaaggtttgcctttgcctttctcacaagttctatttcagaattgcagccaaagcatatcatctcagcccttagctctagagacctccctcctctagtgggcagagacatttcttccttctcagtgtatacaaattttatgcttatcagtagaggtgagattattggctcacttttcctcacaagtggatacatctctcttctttattctctctctccctcctctaattctctcctttcatatgtgtcattaaaaatgtgtttgtgcatttgagtggcattgtgggaagatggagtgaggagggagaaaactcaaattatattgcacattggccactggcacacactgtgttagatgctttatatattctctttttaattatttttactatttgaaacccaaaaggatcataccattgtgagaagagctagttttctagaaaaagagatatggaattttaatatatcttgaaaagctaaagaggtgattttaactgaagtgaagtaataaggtagggccttgtataagtaagagtttcacaataccaaaatttatattgtaataataacattgtaatagtaaaaatgtaatagtattaatgtattcagttttttattctctgaactatatatggcattactttgatatcatttcatgtcatctggaaatgactactattgctacagtatgccaaaatatctgggcacaataaacaattatagcattttctctatcttttagacttctcagataatgctacaatatgttaaagtatctgggcttgattaaaaatgcaagcatttctcctatctttttgatttcttggttttggaagacttgatattctactgatcattgctattccatactgtaatgacacctgtcatgattttaaacagtttttttttttctattctaaacatggtaacatagagttatgtcattaaaacattaatcttggccaggcacagtggctcatgcctgtaatcccagcactttgggaggctgaagtgggtggatcacctgaggtcaggagtttgaaatcagcctggccaatgtggtgaaaccctgtctctactagaaatacaaaaattagccaggcatggtagcaggagcctataatcccagcaacttgggaggctgaggcaggggaatggcttgaacctgggaagcagaggttgcagtgagccaagattatgccactgcactacagcctcgttgacagaacaagactctctctctttctaaaaaaaaaaataaaaaaaataaaaaataataatcttatttcgatgtttgctactaaaaggtttttaattatttatttttatcatatcatattatacatatgtttgcccaagcactcacgtgtgtgtatatgcatgtatgtttctttaactcatggctgaaacagtaacacagaagacataaacctcaaatctgtgtctgggtctgtaacatggggaaacaggtcaaccttaacactacagtgtacatttgcattgcattgtacattactgatgtcttcaggagattgatgtgctgaaaatcctcattctacatgttggagatggggaatgagaagtcaggagccggaaaattctaaactcttttagatcactcagattccatctagtaaattacctttctctgagatattttcaaggtctgaaatgatagtgtacttacaagaggtcattatgacttctggcacccgttggagcaggcctaatgtcttgtagcaaatataagagtctaaatgcattgctataagtgtcaggctggcagcaaatgcattatgcttctccagttgaccctttctgctcctgtctctcacactcttaccagatagacagttagcaagcagcctgtcctatccagaggattatctcataacaaatatggctatttaaaagtgaaccatgttgctaaaactctgaaagccttgaaagaggtttatccatcatacgttaggtaccaactgctgtcttgatgattatcaaaaagcatcatcatgtttgacatcttatatctttaaaataatatttctatattcacttcaggtgttttgcctattaataattgagatgtagtaggtgatacagtaggagttatgtggcaacatttaggcttaacactaccacaacaaaatcattatgtgtcaaggctgtgaaagagctagtgtgttaggaagcattatccttgagtgaaaggagttcatgtctactcataatgtgtgagctgaaagtttgatatagtcagaagagtaagatacaggaacccaaggaacctgagctctgatcctaagactctctctaagtctgtgtaaccctatgtgataaaataacttggagtgggagagggttcctcataagatcagagaccctagtgcagcagtccttggagatataaattattaactcatgaaaagcaaggagacacacattattttgttttgatagtgttagaaagaaacagtttcttggaagaaattgttatagcacatccttaacctcaggtagctgagggaagttgaagaggatatggattgtgtctctgctgactgaaatgaaggcagtggtctggcctcacagcagtgaaggcctaatggttttaggaaacactgagaaaataattttatcgctctgattctcagtttcttcttttataaaataatggttttcaagtaatcctataggcttcagagtttgaagtcctgcattgaaattttagctttgtcacttactagttgtgtgataccagcacagcagttaagacccttcatgttgaaaaatatcagaaaatctaactcttagtggctcatggaaaaaattaaaagaacagcaaaacataatgaaatgtatttattactcacatatcgtgaattccaggaaaatttgtcaaatcacatatcagacatatcttatggagtccttcttggtggctcctaaaagctatggctttattttcccttaagttcaaatactttggaataattagactaacttgattcatatactcccctgaaccaatcctatggttatgtagacatttgggttgacagttcatactctactctaaaaactccagaacttgctcccttgaaattaatgaaactaggcaaacattgaaatcatttcttaatttctcataatcaattatttggaatatacattacattgaaatcatttcattattaaaataactatctttccttggttaccttttattggcttacagtattatttatttatgtattttgaactattttcactgatcttaatcaaagaaaattatattctctacatcataatgaaatagaagttctgaacatgttctttctgtgttttcctggattttcaaattaaagtatgagttgcttcgaaatttaattgaggctattgggactacagagttcttgcctttaagaaagttaagtttccaaatgtgtgtggtttcagttaattgcagtgtagtaccacatgcatgagattttatattcagaagggaggaaattgattttctttggcatgtttatagcaaatatattcagtattattgttcaaacaagctgaaattatttacagaatgttatatgtgtatgtgttttctgggaagagggtccatagctcttgtcagatttttttttttcaagagggtccatgactatagaatcattaagaattaatgtatgggataatttctttttcttctaaaacccaataagctcactttttaaaaatttgatggcgttttatttatgttaaagaggatcatttaaaaaaatattatttaactaatattcacattaattgcaatcatttcatggtaaagctatgcttagatttaaaatttcccttctagaatttatttttttggactcagagactgctatggtgatcaataatgatttgtagaaaattatgatatagcttgaggtcttttattttaaaatgttctttgtgacaatattcttggctggtccttattgtattggtgtctcaaactgttgctcaaaatttaagtgtgtttttaatgtactatttttttccataggaaatgaaagctcattgtataaaacttttaatacatagaaaggtaggaaaatagaaaatcatccttaattcttagcctagccactgtcaaaatttgcatgcgttattcttgtgtacttttctatgcagtgcaaacatgtatgacatttgtaattgcaccatgtatagaactttgtcttcatttattaattaatttatcaaacatttgtcagaggcttacaaagtaaagtaaccaattttcccagtttgcctggaactttcctgcttttaacagatttttaacaggatactcaccttctgggaaacctgttagtccttggcaaactgggatagttggtcaccctctgataaagataaagatgaataaaaacagactatagactatcaaggttagtgtgggagtaatatatattctaaagttgctatatcttatattttttacttattagtatttttcaggttactgcataattttattagtccttttataaaagtaaacttcaacaggttgaatgcaaaatgagttataaatctattcctttagcatagattttttgaatcatttcctagttttgctatcataaacaacaaagaaataaaatctctgatcacagcttcttttgaccgttatatatttttttcaagacagccataagatatataattgctgggattaagagcataaatttgttagattgctgatacatgctgtcgaattgctctccaaaaagattttactagtttatattttcattagagatatatttaaaatatgacaggattttattattctcagctagatacgaactttattcatcaggaacagtttgtcctatattggtcaaataatattctcccaggtattctgaaagagaattctaaagaataataaaaaggaaacttgtttgcatttttatatgagaatttcagttaaatgtaacaatctcattggagaaaaataaaaatattttgtatcctcagggctttaagaaaggtgcttccattggccgagatgcttaatgtatagtcttttgtgaaaaattctcgtacttagaagagttaataactcagtaactatttaatttactaacttgggaaataatatatgtattagtgagaatagtaacagtgttttgtttgtttgtttgttttgtcatcaaagacactattagccagggtctttacataattcttaacataataattatatttaaaataatctgacatcagattttcaaaataaatttaagacatgctgagaattattgaataccatgattggagctattagatgaagtttctgatataccttttttgttgttgctgccctcttgccctttctggcagaacttttattttactagaagaaaaatctatagcttattaaaaataatctaaccccaatatgatcaaataaaggtatcatcctttgattcaaagaagcatagtaacttataaaaaattaaaatgttattttgttaatagtgctctagcacagcagaataaccttgtaactattttatatattaaaaactaataatttgatttaatagcaatttacctataatatttttctatatatgtttcatactttgttaaaccataataagtatgtcaagtagtttttattttttatcaattaaatattccattaagggtacacatggacataaagatggaaataatagacactggggactctaaaattggggagggtgggtgggagaagggggttgaaaaactatctattggatgctaagttcactatttgggtgaagtccaaacctcagtaatacacaatacacccatgtaacaaaccatgtaactaaatataccctgtgaatctaaaataaaataaaataattttgagagaagcaaaaaagtaataagtagataaataaaataaatagcagtatttcattaaattagaaaatacaagagtaaaatgattttgctagtaattaaacatctagctcctgatgaaaacatatttatttggcttaataatgttatgtcagcaaatacatgtttaatattacacaatgattacaatttttcctccctatattcagcatacactttaatttcaaattaatatttacatatcatgaaactataatttatttaaaaaataaaaatgttatgtgtaaacacacaagtatataagctgtcttttttgttttatgaaatacaatcacagtaaacttcatttcaacacacgccctccaatttcattagtgatgattatataagcttatgatagaacaaggagagaggaaccaagtgtcacagttaggctacggaattttggttggattaatatgtaaatgaataatatgaattattataggagtcaaagctattgtactatctgctagaacttgctacttataggaataaataagatatcaaatactttgcataatagtgagtgttttacttgttaaatctgcataaaagcaaaattaaaattttcctgtatttagctggtactgtgaaaactatacaaagtatttagagatatttatagtatttgtattgaaacatttaatatccaaatgaatgatggtcatgggttaaaggaaagagagggaagcaaatgtttacagagaatctgccattatcagctgtgtgctgggtcagtaaattcattcaacatttcaatgaactattactagtctcaatgcattaacaagaaaactaaaattcacaggagctaagcaaaattttcaattttccatgctagtgaatggcatgtctgtctcatgagttcatattttattttgtatatcacaaaattataaaggatagacaccagggtaattattttaggccaattctacatttttcaattttttttcaagcagtgatcaaacaaaaaattttacacacttttttgtgcaggtatctaagtaattctgtaagctagtttctaagaaataaaatttttagaacaaggtgaatgttttaacttttcatatacgtggtacagctacattgtttttcccatggtcttaccaatgtacattcacatagtatggaagagtgactattttcctcaatcttacaaataataaataaaaattatgataattttatcctttttttctgctatatgtgaaaaatgacacctcataatttaacattttatggaaaaaattaattttagtatacaaaacaaatccaatattcgatttttattatagctggccaaattaaaattaaccatgatgttctactgtaatacaaaatatacttgctaggccaaattaataatgtagagacaaagaccttgtttaccgtagccaaaaaaaacatagttgatgggccgatgacttcattctggtcatgttttccatctttgttttaagtattgttgacactaaatatttacaggtctaaaccttctcggtgtcatacattcctggaaattagaaaataatttatcccatctgcaaagagtaaatttggtcaaaagagaaaatatcaaattaagtagatgaaaaatgattttctgctttgttttctatttttccccccggtacttgaaagtagtcaaataaaaaatagattcagagttgatttgttcatataaacagagccaatataaaattatgatgattagactatttcctatgatggctgtaacaaattaccacaggctctgtggcataaaacagtgctttattttcttacatttctggagatcagaattccaacatttatgtcaacagggctggcttcttttggaggctgtaggggagaatccatttcttcatcttttctaacttctagaggtcacctgccttccttgtttgctgacacctttcacacacgactacatccttttccttccatcttcacgtctcctaattgtttttatgttgtcagatctctctctgcctctctcttattagaacacttgtgattacattttggatccacctggataatcaaagacaatctccacatcccaagaatcttaatcacattggcagtgtcttttgctatataaaataacatccataggtccaagatgttagcatttaaatatctttgtggttattcagcctaccaaaatgatacaaactgccagtctatagaattatttatttaatctttttattcagtaaagttattctcaaagggcagattttacagggcaattttttgaaaaataaaacttgtaaaaggtttaattgattaattactgtttacagccatgaattcagacatgcatagtcatttaaacattttgatttctttaacatattttacaactggaaacctgtctaacacaaatggtcctactgctttatatctttttctgcctacatctatctaaattgagaaatatatggcatgaataagtatattcagtttccatggctatggctaaacaattactggaagcattttatatgggaataatttacatacatttgtgatattacttttcttatctctcctcactattttgagcaatctttgacttgctcttcaatcctagtttatggaaaaattagtctggccatgttaatagcggtgctggtgtcagggtaccttgaagaaatgtttgtttaggagttagagataaacagctgtgtctttatagaatgcttatgctaatgtgcatcagaaatctccaggaatatgacttagtatgtggtgtttctaaaactctatttaatcagagacacttttgtacttggagtttcaacatcttcagcaactagtgggccaaggaaatactgaacattaaacatccacaggactttacaattgtgaaatttgaaagtttctgaaaactaaaagtgtgttgactttttaaaaataaaagccaaaccaaaatgtaaggcttgtgtgtgggtggatttgtgtgtatttacaatacttagtgtgactattgatatctttgctaaggaaacataagaaaatatgcttgattatgggatgctgccccaagactttcctggtagtgttatataaaatgtggtatatgcaaaatattgccaggatttcaaatattagacatatcacattttaggagaggctgataaaagattatgaacctgtattacaagaagcacctgtattctttccacagtgaccaaaaaaagtcttttttttttcacctttagatttgatcatggtctaatgaccattatctcaagtgggtccacaaccctaatcaacaacgtgcctatagtttcttagagttcttcattttatttggaaaatagaagcaactggtagagtcctgcctccttttcccatcaccagcaccatcagcctagctatatctgtgcctatgcactttatttaccacctatggcaaagcctaaactatcttcatgtacttaaagccttgctgccatttgtacactgttcctgcaattatccccctacaagtgtgtgtgcacacacttatgaatcccgagtttctccttttctacagcatccttcccaatagcaggcaaaagtgttgttctacctcttattttatatcacgacactcttatatcaatgaagaccatgtactcttctaatgagtgtcacatcttccactccccctcagagcagaactcctaaatgagctgtcctgactcatattctctactccttcacttgtgtttctctcttcagccaactctagtccactgaaattgtacttatcaaggttgctaataatctccattgtgacaaattcaatggccagttctctgtccttatattatattagaatttggcccaagcaattcattagtcaatcatgaaagtatttttttcactttgcttcccattttagtttcagtttttggttttgtttctttgtctttgttttttctgtctacctcaaggcctatctcttgcatctctttcttacttctacatgatctagggacctagcctttagggcactcactgcttatgtgattccatctgttccagtgatttgtaaatttaccagtgtttctactgtgctccagattcactcattcaacacccatctcatggggatgtctaacaagaatagacagaatagacagtttcaaaataggaactgttgactttcctttataaacctgttcctctcttaattttttaaattttttatctcaatagataacatggtcattcatcaaaatgttcagtccacaaatttaggagttattcttgaatgataatttatcatatattctcactaactcactcaataagtgctgctggtgctgcctacagactttataccaaattctctgactttccactgtgaatcctgctactgtcctagtccacatctttgtagtatgtcacttagagtactgcaataacctcctgcttccccgtttcccagctttcattctttcagcagcagcaagcatgatcttttcaaaatggatactttcctcggaactctcaaataacttatcactttcaaatagaaacttatactcaaaataattgaaaacaggtatgcaaataaatacttttacatgaatgttcatagtagcactattcaaaatgaccaataaataaaaagaaccccaagtctttcaactgattaatcattaaaaagtcatagtatatacatgcaatggaatagtatttgaccattaaaaggaatgatacactgatacctgctacaatgtggatgaacatcgaaaactaagtgaaagaagtcagccacaaaaggttgcacgttgtacgtttctttttatatgaaatatccagaatggttaaatccatagatacagaaaacaagcctcctacctagcttataaatttcattatctaccactctccatttacatctcccattttaaccacgctggtctctttgcttatttttagtctcagcatattctaacttagtttatttatgattgcttttctatttgcttggatttctcctaaatcaaatcctagagtggcctattctagcatttctttaaagtagcgtcttaaaatatcacctctcacaaacaccttcccttccactctatccaagtctacacagacatctctaaaaaccatgtagattataagcagcataactacccacaaaaacatttttagcataactaaaatacattcaatacaacaaatttaaaattacctcagcaaagtatataaatgacacctgtaacaatagttctggctctggagcccacactgaattagaaagacagacagagactgtgcatcaggaggagagggggagacctagcagcggctgagagtggataaaatcagacccacaaatgagaatcccatagtgatactgagaataggtctaaggaaatattgagcacagatataagaacagatgaaatagaaaagaaggtgtttgaaattatgtgagactaaatataacagtcttgggaagatatggtttctggggcaaattagaagtgtatggaaaattctttggtggctctgtggctaaaggaaaaataaaagaatgaaaaggttaaaattaaaggccctactgaaaaaaaaaagagagtcactatatcagaaaaccgtataatatcaaaatataaaaacacccccaattaaataagtttttttttcattaactacacaagacaatgttcatgaagaagaaatctataaaggcaataaaattttctctgaccttccaccggtggttgcttgtttaggaaaaccttagtacctcaaaatgaacagaaaatcattggcaatacctatacaaatttatagaaagaaaaaaaaacagacagcaaaaattttcaactgatgaaatttctcttccttccaaaagtaagtaaaaaaacagcaaccaagaaacaacaacaacaaaaataaacaaaaaaccctgtcttaaatatatttttaaagaattacctggaaatattaaaaaattatatttctaatcagtgaaacaaaaaatagcaatggagaaagcatacaaagatgtgaaatgaaatctaaaaaggtcagaaaagagaagaaaaagaaaaacaaactcagcagcaaagcatcagccattaggtagctacagaagaatagattctaatgagtattttataaatggcatataagtgccactggggaaggaaatgaagaaaattcaaacaacacaacagaaaaaattataaaggttataactgaagaaagttttttagaaataaggatcttcagccacatgttgaaaagtcacattttggtaattcttaaatatgttctagaaaaatttttagttcttaaggatattttaaaaaaaaacctctggactttcaggcaaacagatcaaattacttacaaaggaaaaaagaaaattaggttgtcgtgagaaatcttcacagcaatagtcaaaataaagcagcagtaaagccttttttaaaaaatgcaaggaaagactatatgagctaaggtacctttctggcatcaagattataaagacatagttttaaacttaaaattattttgtgaatactatactcacaagagaatgagtatatctaacttagggattattaaataaacttgacaaaggaagatagtgaacactgaatatatttaatcgtagatcccaggctaaaacaaaggtgttaaaaggggtagaatgataaatatgttctgacaaattagaattttgcagttcaaactaatggataaagaaaataaaatgaccaggcacagtggctcatgcctgtaatcccagcactttgggaggctgggcccagtggatcacttgaggtcaggagttggagaccatcctggccaacatggtgaaaccccatctctactaaaaatacaaaaattagctggccatcatggtgggcacctataatcccagctactcaggagactgaggcaggagaactgcccaggaagtggaggttgcagtgagccaagatcgtgccattacacttcagcctgggcaacagggtgagactgtcacaaaaaaaaaaaaaaaaaaaaatccttgattttcatgtaggtaatagatggcagtcaatttaaagctcaattagtagcctaaataacggaaacaatggactaaatggactaagagctttgtaaaatcttaactttctctcaaagagctgatggtactctctgcaaaattcttctaaagtggcgtaaaaaatgagggtgactaaattcttgggaggatttctatattaaaatattgaaaattttaccataaatttaggaatctgttgaaattctgagcaagaaaacctatactgtatgtgcaagaactctgctgaaacagtatggtagagttgtaaaatgtatagaaacttgtatatgcctttgcaaatgaagtaacagcctttgaagtctccttagttcaaatcccaatctatatagttgaattttctttctttctgactttctcttcctttccttttctttttcttttcaaaatgaatgtgttttttaaactgttcctgcaagttgtgtctgtttgtaaatatgtggggttttcttcagtttttttgttgttgcttgcgtgttttgatggaagtggtgtttgtgtgttttgatggtagtagacatggcagtattgctggagatagttgatgtaaatcatctacttccaaatgcattttacaatgtggtatatatcaatttttgcttttgtgatcttttgcatcggccatagatagctgtttttcattttttttgcttaatgaagtaaaaagcaatataaataaaatttctccttccaaatgaatctcattcagctgcgttcaactatgaaagagctctcaaaaaagactactcattaattttcatttcaaaaatattttgtaaagtggttcataggcctttgttaatggcttgcctaatgtccttggatcaccatatgttctcttcacaaagtataggcccatagagaaataaatttccctcttagttttttaggttagattgttggaaaaatatcaataattcaaatcagatgattgtatttctaatcaaaattttttgggatttttgatggcatgaaaacaaagaaatgtttttaacttttttactgcattggcaatatatgaataaaagaatggagatgaggaaatgaaggaatctactgaattaactgcatgatcctctctatactttccctactgcaagagaaaacaatatacacatggccttctaatcacttggttggttccccttgaaagcagccctcagtagtttcttactacactgctatcactctgaacataagctggagacaaagggctgctttgtacggagtgaaaaataatcagggtctggtgagaggatagatagaaggatgctcaacaccaacctcaccatcaggaggagaccacagtcattccttttgtaataaaacatacaaagccagaacctgaatggaacgcaaggactctctttggagaaaaatcttccttattctctttaatgtatgacattttcataatcttcttgattttcatttttccttgtggggccaaaatcagtaatttgaattaaatctcctatttattctaacatatgtagttgaagtccattttatcccctctcccacaatatctgaattcaggaattttttattgttgtttgtttgtttgtttgtggtctttttgcccttagcagctagaagtggagaccttggtttctctgattctatttccaagtatttctggaagatcagcattctactctctcttctaagacagtgttgtcttatattaaaatttatgattttggtgagatgcttaagcctttaccccaattcaaggtggtgccctgattcttcaaagtcctcctgcctttactaagatagatcttctcaagtgctttacctttagttttccctagggctccctgctcattattttggcctctttctgtccataagtaatgttaattatgataatactgctaagatattagtaggaagtatcaaggtcctgtcaactaacctttattctacagtatttgaagcagtcagatggaaaggagaagagtcaagccattaagtgccacttttgatatgcgtagtaggaggttattcactttggtttatttgacagtaacttacttaaaaaaattttttttatcattttagatttctgttactggctactaaagagtcgatgatagatgattatatgatacagtttcattccaccatctttacctacatttttcttttaaatatttatatcaatcattaatatttttgagagagatgtgtgtatacatacacatatatatgcatatgtgtatgtgtacacaatcatttgctggaatggctcacagaacttaggaaaaccgtttgcttactagattacgggtttattgcaaaaggatacaactcaggaacagcggaatggaagagctgcactggggaaggtacatggaaaggggagctgagcctccatgttctctccaggcatcccatcctcccagcacttgcacttataatcttgacgccagaaaggtaccttagcacatatagactttccttgcattttttaaaaaaggctttactgctgccttattttgactattgctgtgaagatttctcacaacaacctaattttcttttttcctttgtaagtaattgatctgtttgcctgaaactccagaggattttttttaaaatatccttaagaactaaaaatttttctagaacatatttaagaattaccaaaatgtgacttttcaacatgtggctgaagatccttatttctgaaaaactttcttcagttataacctttataattttttctgttgtgttgtttgagttttcttcatttccttcttcaatggcacttatatgccatttataaaatactcattagaatctattcttctgtagccacctaatggctgatgctttgctgctgagtttgtttttctttttcttctcttttctgacctttttagatttcatttcacatctttgtatgctttctccattgctattttttgtttcactgattagaaatataattttttaatatgtccaggtaattttttaaaaatatatttaagacaggttttttttttgtttcttttttgttgttgtttcttggttgctgttttttttaattacttttggaaggaagagaattttcatcagttgaaaatttttgctgtctgtgttttttctttctataaatttgtataggtattgccaatgattttctgttcattttgaggtactaaggttttcctaaacaagcagaagctctcagaaactcatcttttgggggttttagagaggcctcaatacacaggcctgattcattatatcacctgccagtagtgataaaaaaattcaggccatttcttctccccagaggtgttgtgtgggacactggggtgtctgaaattggtaaagttctaatcacttggttggttcccctggaaaccagcccccatgcttgggctttccaggagcccccagcccccagcaatctcattagcatatgaaaatacttaccatttcagagattgcaagaatttaaaagctgtgtgtcaggaaatgggaaaagagaccaaacatatttcttaccatgtcacattgacaattattttgtatatttaagtttctcaggcatcacatcgagatgtatcatgttccaaacaagaaaacggaacacaataggagctttgagactgggagatggcttagtttttatccacctaaagttaattataacttctggagctgcttctggagttagacatatattgctatccaatagaaagaacagcactggaattctcactagcttgttttgtcatttaagcttcctaaatcggatctgcttctagcttcggttttataatgtacaatgatatgtactatagaacatagacaatacttaagtaccttccctttaccccatccctaaatgagacctgagccataggaatgatgactagcactgaaatagttggtcacctggaaactctgtgaactctgaaatttccccatattgtattatcaggctgaaaaaaaaaaaaaaaaacatgtatagtgacacctgtaagtgtacttcagataagaagagattaaggagtaatagttccctggtgcaggttttaccattattcttccaattttttcattctagatgaaggtaaaccaattggaacaccacttatttttgcacttccctctttgccctctcttcgttttgtctctccttcaaatcagcagaggcagaaatgtgtttttagtcaaaactgcagattcacatacacactcacacacagacatccatttattccttagcatcacccccatatactatacctaaggtctctctttgtctacattttgattatccacaccaaaataaaatctatgaaaacacctgtacaacagaattagtctactgaggcctagggcaacgtggtgtaaatctactgtgcatttgataggtggtggtagcttattgccacatcatgatggatgatgtgtatcatccagagctggactctggagttgtcccttgtgaacattaattagtaaggcaaaatggcttgagtttttggatcaaaagagactgtactaataaaaagagcaaaggatactataaggataaaaaaaaacctgtgctattaaaatctctacaagttatgcaaaaacataagaactgaatgaaattgcctttaaatagttgggttctttgaattgcttacctaaagttattcttactatggagaaataaaaacttactctgcagaaatgagaaatttattatagctgagccagattatacatatgcatgtgtatacgtgggaatatatatgacatatatctatgaatatatatgacatatatatataaaacatttatcattgaacatgacattgaaataattagaatctaaaactcctttaatatttaatatactgatggctttgctaaaattcatatgggatattttatgcataattacttaccaggcaggattaatatgaggattactatttatgtgacagaaacatttgtaaaccaccttgaccttctcaaagaaaggttgcactagtgattacagagtaatgtctgctttccttttaatcacaatctaagatcaggtcttcatttcacagtggtagaggaagttgacataacgaaaaacatctaaataagtaggtggatgatctcgagagatggtatggatgattatttaagagttttatagccttcttttgttggttgagtttttttaatctgtatttattgaggataactttatgtttattgacaccatatgttaatactatgtaaacacaggatgtcttcatatttagttaatattccatgtgcggaacttcttaaagatttcaaataagcctacatacactatccatatgttgctttttagcaagggtgctaaaaattgtaaagattttaacttagcatggggatttatgtatttatatatatatacccacacacacatacatattttagggggttatgtattaaatactattcctgtattagaggttcgtgcttgtcatcagtcagtatttttagtatacatgtatgtattgcctttactgtcaccactaattcatactttgtgactcccccttgcatatatcctacctatgtaaatctgtatttgcacaaagaagttactagaaattttgattacttcttaatcattcttaatcagaattatttaactaatccacttttaatgtttaaaattaaaggatatatatatatctcacatattcatttattttaataaacattatttgaggggcaattatgaactagtattttataaagcatattgtaggattagggaaagaagtggaagggagaaataaaagatgataaaatattgaataatatttacctggttctccagaagatcaaatttcatggtaaagactgaatccaagagatgtacctataaaacaatttatatgataattgaacaagcataaagtaagatatttgagcactttgtggagagaaagggaataaattaattctgctcatgtgtcagttgaaaggcttatagaaatatgggtgttctacatgctaaagtgttttagtttgttcaggctgctatgacaaaataccacagacttggtggcttataaaccaaagaaatttatttctcaagtttctggaaactgcatgcctgatcaccacccagaagccctacctctaatgccatcatcttcaggaatactatttcaaaatatgaatttaagaggaaaacaaacattcagcccacagcacagagataagtgggcattcttagcagagggaaatgtacacagataataatatgaataacacagagttatcttaaggaaaaatcacgtagtttgctggggctggaactacagcataaagaaccagggtggtaaattgaggctggtatatgaagaattattacatagagacaatccaggcccccacagaaaatttcagctggagtagacacatgagaaatttttgtttcagaaaggtcacttttgatgacaatactgaagacatgctgtgagattagcaaggaagataatttatgtagtggccaatataatattaatgagatttccatgacaaatggcttatggtcaaatgtaattgtgaaattctcagtcaatagaagcattttataaaagattgactaatgggtcacttggaattttaatatgttaatatgcactgcgatacacacacgtgcattaatagtgtctacatcattatcctaacttgttttgctgtaagaacaaagaactgtacgttgctcaaggctaatgaaatagtggatctggggggtctattccatatctatttaatacaaaagtgttattcactactctagattcatttcactggaaaaataaaaagatggtgagtgatattcttagtcagtggcagagggatgggaagaaagagaaaacttcaagaggtgattaaaataaatgaccaacagaatttgttaaatgcttaatgtaaggttcttaacagagaggcttcatgaggtaaacgaatctccctatgttgggtgtgaaaccatgcttccatacacattggtgcttcattctgaaaaaaaggtattttaacttttggcagctgtctgtaaccactaaaagattaaaacccattggtaatgggccaaaaatggaactctggcatagactagatagatctaaagaaggggaaaatggaaatgagagagacaatcttgagaaagcaatgttctgaagtcaaagcaacaaggaagctactatacagcaagggaatgaagagcacagatgctggagccacattgtgtgggcacaagtcttggtcctacccatagctaagattttgtttgggaaatttagctcttttatgaaagctatccacatttataatgcaaataaaaatagcagacaacctcatagggttgtagtgatcatcaaatggttttatacatgctaattgcttagataagtgctcaacacataggaaatgaaaatcatgaacaaggaccttcctggtgatttatatatgctattaatcctcacagcaacatcaggtggtgctattatgaattttcatcatggaacacaaaaactgtcatgaaaacttagtagacccacaattctgttttactcctaaactcaagctcctttaagtacactacatggacgtgacagactttcaaaacagggagtttggaacctggataatcttggcaaatcctacagaggaaaaatacaaaaagtagctactagatcagtgtttcttatagcaggcaaacctcaaccccccaaacaaaacaaaacaatttcataagaatggacttgttgatggcagattgcaatacaagataagcacatgtaaataacaaatacaaaccaaagttggatgaattatcacaataaaggggaagaagcagataggtagtatctacaaagagttaagataatgtgtttttttttggggagggggaagtgtgtgtgtgagtgtgtgtgtgtgtgtgtgtgtttaaatgtttacctttatgtgtgtttggaagatgagaggcttgagcatactagcatgttcagggaaaggaaccattgaaaagaaaaaaggtaataatactaaagaaagagggaataatactaacggatgtatcaaaaattggaatagaaaatatcattaaatagggaaggatgtctagcttcctaaaacaggagggaagttaaggaatgaagtgacctctattcacctctgaacccagggattcggtaacatagatcagtaactcttcctgagtgcttacaatgcactgtgcactattttaagcgctttctgtaaattaatttatgttgctttgaggtagctagtataaccaagaggatagtagagtaaagagaggtcctccagtggctgttctgggccatgaatttgacagttagtctttagaatccatgtactttactccatgcactgcctctctgcccatcccctctctgggcagttggaagtgggaggctggatcagcgtctttgaatgtggtggaatgtagaggtgtccaaagaaggagcaagggaaagaatctaacacatacagataggacaaagtgaaaatgggagcagcaagaaacaaaatagaagacagaaaactagcaaaagattatagaaagaggggaggcttagaaaaagaaaagataaatgaagacaaatgcaagccatattagatatcaagtcaagtgcattattaaaattcaactactttagtcattttgagcacacttgtttttagaataagttatcacattattaggtttgaaattttgtctattttttttaaatgactttcttgagtagctaaaaccgttgcttaaaaaaattctcttctatgatgcttctgtcacgttttggggtaattgcacagaaaagatgaattcatgttgagacagaattgggtggaaatgtctagttgaagggataaaaactgaaaattatcaataatgaaatttggaagtcttgtcaataattctttaatcccctaaacagattgtatcttttaaaacttatctacatttcaaaggtaatattttgtttcccatggggattttttaaaaaatttgggcaaaaccaagaataggaatgttattatacaaattactcaatagcaattttgctcatggacattgttaactatgtatgtaggttaaataatttttttcctataagaaaataaaatacagttttagattctaaatagccaatttgttgtatgtagttgacagggtagccttttttagtatagctactttattttcagcctaacctatatttaagtatgaaatttattggagaatgaaaagttaacttttgctgctgctactttcaaaaaaattttgtagaaaagagtattagtgataaaatacttaataatctttttctttctttctccgtacttcacctgagttctatatatatatggccacgcgcagtggctcacacctataaccccagcacttttgggagcccgattctagtggatcacttgaggtcaggagttcgagaccaacacaatgaagccctgtgtctactagaaatacaaaaattaaccaggcatggtgttaggcgcttgtgatcccagctattcaggaggctgaggcttgaacccagaaggtggaggttgcagtgagccaagattgcaccactgcactccagccaggactccagccaggacagagcaaggctccttttcaagaaaaaaaaaaaaaaaagaaaagaaaagaaaaaataaattgcaaataatatgtgcaccaagacataagacagtaagctttttttttttttttttttactcctatgtcagttcctgaacagtttggtagaacatctccttaatcatcaattaaccaacaggttacagaaattgagtgagagaggacttcttggaggattacaatctaattacgtaacaggaagaaaacacaaactgatttttattatgtcctacagtttttcactgttcagtataaattatactttttctcaaggaaagagagatagatataatggataggctatgaaatgttgggagatactgagaacaaaattttgctgcaatttatgaagaataattgttttattttaattttaagttcccagtgtattttgttgaaaaaaaaaaaaaaaacctacaaggaagtttcagttactcagggactaatcagttagctggccacttttttatataaaatggcattttcttctaggtttgcctttagttttcaccataacagtgtcattacttattacaacttcatcctgagtagaaagagaaacagaactagctaatatcagcttgtttggctttatgcttggtgagagatgttggcattgtggtttaaagtggaggttttatttattttgagtcgttattcatccatcactggttttcactaacgaaaagttagctgtgcttatctactgagagatcaattccattttaagagcaatttataaagcttgaagacagccatgaatataaaatagcacaattcaccaggtcttcacaaagaatactcaaaattgagtatatcaatttcaaaattgagtatatcaataatcaaaatctaattttaccactggtgtaaagagaaagtaagttaaaaaatcccaaatcctttctttgttggattaggttcctgcctttcttattattctttgctttcatctattgtatccagcaaagtggtatcatatcaatgaaaagctaaaactcctagtaacttgtaggagcacattgacataggtgtaaaaaagagagacttcaactcaaaacaaaacttttacattaaaagtaaaaggcctactcagaagtggaaataatctagatccacttcccttaaataccagtccttatcagaaaatgcatatttagtagtattttatttcacaatatgtgagttatctagctcaagaaggaataaagggagtctttagttaaatcagaggatgttgtgaaatagcactgcagtgttcataatgaaattctttatattcatcaatgtttttcagactgagttccaatatatattctctaggatctaaaagtctccatgatatttcatttataaattatgtcagtgttcctacacattcatatacacacacatacatgtacacatatacatactagaagaattagatgacagtcttacagccaaataccacaattttttttattacttacatttgcttctatcttggagccaaatgaagaataaatgtttttgttttcttgtcagtttgagtttttcaagctgtcttctaagaccatattcttggggcctgaagtttttcaagtttaagaaaccctgagataggtgactcttatttaaccaattgctgtgatcagttctatgaccttggcattaagacctgggtgaaatgatcaaaaatgatctacattttggttattaacatatcttccatgttcacatccttttcctttcagaattcgtagccttaaaaataataaaaaagggcagaagatagtcagactagtaggactcttgaggaggctctcctaccctcactcacatcacagctgctgctttcctaatggtcaggattacatgcccaaagccttagaaaattatcttaaaaggatgccttcccttcacctttttcctcttattggctccagatgctctcttttttgtataaaattcaaaacttggtcatcgttttaagagagatattaaagggtaacacattgtatgatcgtatcaaagtatcacatgtacctcatgtacagccattatacatccataaaaattacaaattaaaaaaacttttaaaacaatactttaaagaatagtaaatgatagcatagaggtaagagaatgcattgtggaatccgattgcctgtgttcagattcttcattctactacttattaattctgtgacactggacatgatatttgacttcttagtgccacagttcacaatttataaaacgggaatgaaaatagcacttactttgtgtgtattgttgatgaattcacaaaccagtaattaatcatatttgatatttacaagtaacaatctgaaactaaaattaaagttttattgaggtaatatttgagtgcaatgtcatattacaattagtatcatgtcttcatgaaaaaagtaatggtctatgaatttaccaaggataaatggctggtctgttccgacatccctatgaatttttcttttcagcctaatagatgacttttattttaatatttttagctgtaataaaattttaaaattctatgaaaaaatgcaaagaaatcctgctgttcatatacagttattaattaataacatgattgtatcactagattattaaaagttcacatacatatgccactgtggcaaaaggattctcattattgaaaagaacaccaataaatggtaaaaaaacatagttttgcataactttgctgatcatgaatagtcaaagactaatgtgggtttaaaatgtgggtttaaaatggaattatttttagtaatatcaaagaaaatctgaaatcatatggcattcagtctttcatattctggggaaaccttaagaaataaaagacttgtgacaacttttctttattacccaatgtctatatttaaaatgtttgtgtttctttaaaagaaatatatgggctgggtgcggtggcacatgcctgtaatcccagcactttggaaggccgaggcgggcagatcacctgagttcaggagttcgagaccagcccgaccaacatggcaaaaccccgtctctactaaaaatacaaaattagccgggcatggtggcgggcacctgtaatcccagctactccgtagggtgaggcaggagaatcgcttgcactgcaggcagaggttgcagtgagccaagatcatcgtgccattgcattccagcctgggtgacagagcgagaatttgtctcaaaaaaaaaaaaagagaaagaaaaatattttaaaaatcagtaattaataatcctgtcattaagggcaggcccattaataattgataattgatatttcagttatttttccaggtttatggaaattttacatataaaatataaatgcctgaaaaaataagttttgtattattcatgaaaataactggagcatttttagaatgcatcttatatactctttgtaagcattccagaaagcaatcttactggataatttatagataactgtctaaaactactttgctaaacaatggaaaaattaataacttagaagaaaatgaaattctacttcaaagaacatattaagagatctatattataaatgttaatagagttatttaacatatttctattataaaaatgatagatatttaattttaaaaattattaaaggactcagatttacttttgaaatccatctgctaaatataaaaaaataggaaattttgggcttatttttgtaaataaaaaatgaatgaaaacaaattttaaataataaataatatatattatataatttttatcttaatcttatatattatttatatattgtatatattatcactatattataaatataattatttataatatgtatactataaatataattatttataatatgtatattatgaatattataattatttataatatgtatattatgaatattataattatttataatatgaatattataatatttacaatatgtatattatatattatttttataataaattttaatatacttatataataaatattatttttaaataataaatattataacaatattattttgtaaatgataaaatttttaaaaaccaaagcttttatagcttcaactctggagagaggaattttatttacataaacttcatattacattggtgcaaacataattgcagtttttgccattactttcattggcaaaaccagaatacaaaattggcaagccagaaatacagaaaatatattattcaattaaatgaatgccctccaaactcttattcttgaatctaagatatttacaaaaatctttccatagatattctttcataaatacatgtttgtgtatatgtatatgcagatgtatctatctttgattatgtcctttttcatacatacgcatatacacacacacacaaacacacacatatatatatgtttataagtttgcataaatatttatatgtgggcatatataatgagggaaagaatcagctctttttttttaggataccaaaaatgctattttaaaactttctttaataccaactcaaacagattctttccttctatgcattctaattcgttgtgtggaatactgtaatttatttttttagtcatgtattggtatacatttaaattttttcacattgtcttgcaagctcgctattatgaacaatgttgtaatgaatgttttagatcataaatctttgcaatattttctaggaatacatttttagtcaagaaattcctagttaaagaaactacattttgaattttaacaggtattgctgaattatcctctaaaacttttaatcaaaatgttttcacaaaattgcatcttaatttaccctttgtcaacataatagattttaaaattttaatttgtattaatctacctttctttaattataagtatctatttagtcatttatttcctgtttgtgaactactaaagtattatgctcattttttcttattttgttcaacttttacttactaatggtaaaaacttgatataatagtaaatgttttctttgcctgctgcatgttttgtaaatatttccctcatgttcatttaaaaaaaattcacttgtgtcgtttttcaattcagaatttaacatttttaaaacatatattcaatactcttgttattatttcatcccaaatctacagtgatacacaaaggccagtaaagaatgttgacattgtttatgtataaatagtgaaccagtgccattgattttaggacatttaatgagaagattaaattgggtggccacagagaacatttgtgtgtgtgtgtgtgtgtgtgtgtgtgtgtgtatgtatgtgtgtgtgtgtgtgtgtctgtattgggcatgtatctttggataataactattagttaatggtagaaatagctgattttaccatttttaattaatgacatattgctggctgtattttcctgaatgatatgtatgtatgatagaatttctctagatgttaataattattccaagaaaaaaaatctgtagtgaaatatttcaagaaaaaaatatcataagatattcttctgttaaagatacacaatagatcatggaagatttgaagaagctctgcaataaggaaacctgtgtaactttgtttaatcacaatgtttctcaaatcatttacacatatgtccgttttctgtaaaacactttttgacagcacacaggaaattctaaaacagctaatagtgtggtattttctcacaaaggaattaaaatatgtaatttttaaaagagaaataagcaatacctgaaatgaactataatattttacagattatagtgaagcttaaaagtggggtctatgccttgaggacagggctaagacatatatatcacatataacctcaaatatcttaaactgaagctacttttacttttccttaaataagctaaaaacacgtcggaatatgatgggtgttacattttgtttcttgaatatagagaaataaagggtaaaatatttttaagactaaataatgttcacattattctaaacaaagaaataatagagcacctgtagctgtgtttcagcagcacctagaaacacttaactacacagaactttatatagttcactgaagtaggataaaatgttttacaaaacattactctagtgtttttccttggagtatcttccacctagcccattgttgagcaggaaaaagataaaagaaaatctctataaaaacaatttacaagtcatttcaaataagtctcttactttaactatctggtaggtgcaaaataaaaagccagatacggaattatattctgagtcttgttaattcaaaacctggcatttatttttgtaaatgtcataatttcaagtcttactaagatcatttttgctcccttagccctctttaatgaaactccaaaatgtattatgcaaacaggttccaatcaaatgaggcttaaatctttctcggagacaaatgcagagaaatttctgtttatgagtatgcaatagattttaatgttaggaataatattgattctcagaagttgtaggaatagcttatggggcataaattacatatttataccatagaatttattatgagaacttaaaaatttcaatttacttagctgtaaatttattgacttctagagatttaaaattttcttctgaagttaagcaaatttgcctgtaaaatgtgtacaaattttaaaatctttatagtttagcagaaagcatgaagactttcaaaaagacaggttttaaacattgcaaaacctcatgtattttacattattttatatattttaaaggttacattagttctacagtttggtgtgatggtttcactggcaaatgcacttgtcaaaattaatgactgaatacttaagattttcatatattgttgtatgtaaactaaatgtcaattttaaaaagtacttaggtagtattaattccttctttctgttcctaatgctcagcctcccacttatccactatcacactgaaacaaaattataaagattacattaacatggcattatttctttgtcagtggagattaaataacctatattttaatgcaacaaggaggaagagaaagaggagaaaaaagagaagaccagctgttttatctctgtgaagcagagaaatgataactaaaatggcaactggctttaattaatccatataagtgcatattagagtacattgcttaatgaaaaagtggcattcagcacaaacctagcacacagtaagccttcattaatatttgttgatggaagaatgaaggaagatagaaagtaaagaaagaggagggagggaagaagggagggagagaggtaaagagagggagagaaagaggaagggggctagaaggagaaaatttgaatccactccaaatgtgtttggaaacatttaagttctcagcatatttctctaaaagaaaagagacttctccataagtttatgccaaacagcatttcagacagatgtatcatgtttatattcttcaggattcaatattaacttggctaaacagatatttattaatcccatgcaatactagaagctcatgttccctattctgaacttagtaagattagccagtaatgtaggaccctataatattctcctcaacctatgatgtgtaggaatttgtttcatctacttttttctcacaacaaaatcaggtcctctagttgtcaattgatgatggtacagatggttgcttaaaatggatttaagccaggcaatatgagagaatttttatgtagattattattttaagtagtccaatttgtaacatttacctataataatatttaaaaattatacttttaatgttcctaccaccggggcaaacttccttccttgcagtaagtagcttaagaagaataaaaacagtgagaaataggctttaaatataaccattttcacttggtaactggctctaacataatagcttcccatgagataatgtagatgaacaagcatttactgaaatttgaaccatgatagatttatcaagtcattctatatttattttttaatgtgtattcctgggctacctccaagctttctagaataaaagagatgattttgaattttagaaatggaaccaagttaatctggaaaatattaatatctagacatcaatcctagtagttgtgtttgaaaactctgtattatattcattacttagaagagaacaaaaagtagggaaagttgataattttctaattcatttaaagatgtattataatttctttcactgagagaagtagtgtaatatcaagaaaatatttttgactaacaaactgtaaaatgaaggttgttttcttctctttttataatcactatcttccctttcagcagttataatcaattaggatttagcttggaattatggtctcagttataacccatttctgctttattcaaatgttttctgagatttgctttgtagcttaattttttatacattgagctcattataaaatatttatagggcatatttggcctcacacaatactcttagcatagagaaacctatgcatcaccagggaacaatttctgtttgaagataaacatatttctcatcagtacagaatgaattatatcggaaacaattttgtatcctgagcttggctttatttcttattactatgatttttaaaaattattttacaatgtgtgaacaaagaagttatgtatactttaatgcttgaaaatcagttccattttttttctcatccataagtattttcagatttactttgatggtacagaaatagaatcatgtagaagaggatatttttaataatttggagtgcatttgtgaggtgtgcgtgtgtgtgtatttttcagcattataattccttgaaaattttcttttagccatcatttgtccttgcctgatcattgcatcttgagtttttaatgctgggtggagtatatttatgaatacctaaatttaagaatgactactcactaagaacaaatgaaatgcaaatatcattcatttataatttaatacttacacagcatacattttaacctgcttactttttaaaaatacaaaaaaatgataatggcctgaaaaactgcccatttatagtaggtaacaccaagaataggcaatctgtgaagatgagaagaatgtttgtacagatgcgaagcatagatgttactcagaagtgagaggaagaaaggggaagagttagaaaattgcttttccaaatacattggcaaatcaactgtggaatgcgatcaacaccatttttttgtttgttttacatataaaatcattttcttcagttgtttttgaactatatgtgtggaagcagtgtttttttggtagtggtgatttatttgcttctctttggctgctatttatataggattacattattagttatttatcagtagttagaacagtcaaatttttagggtcaatatgcctggtgtgatggtttgtttcactgatgcatagcagttggacatactatttttcacactttattactaacttcaacattctcaaaggaagcattgaagagaaaattgaggcgggacagtacaatttcttagcatgcctagaaaacaaaagattaaagcaagtaatatatatatcacatggacaaaggaagagtgtactcctggttgtatactaagaagccttgtattgctggattttacagagtgtatccacagacaagttttattaatctttgcctacctgtcttgcattttcacagtgagaatattcaataattcaaagcacattcatatgttgttatctttggagatgagaggaagattgaataagtgttaaaatgtgcactgatttttacagtgaaattcagaaattgataaacattttttaacttcaaatttaaattgagatttagataacgatatatttaaacatacatgttagctcatattattttgctaaatgaaatacctaaatacaaatttaatatcttaggatacatttgatatttttccatggcaggttgttaatataaaagttatttctaaaagcaccacacatacctattaatatgaatagtaaatacaaatccaaatttaaataatctaaaatattattttattgataacattaaaatagtaatatttacatgtatttttaagtaatctcaatttttcatgtcatatctaagaaattagaagaacataaatccattatagtatctaattcacacttggaaatgttcctgctgcatactttctattcagtctcttcttgatttattcattcaacaaatactcattttgtgcctgtaatttgccaagtactgttttaggcatgagaacaaaatgaataaattagacgcagtccatgagctcttgaagcttataatgcaatgaggaagacaggatacaccaaaaattgtgtaagtagataaaagctagtcaggcactgacaggtgtactgactttgatagagtgataaagaaggtatctagaacagtaacttgaatgaattgatggtgcaagcctttagagggggtggggatgacaagcaccaagacagtagggtgctaggtgtatccatggaactgcaaaaccaacgctgcttgggagagagagagagtgccagggtagtaagaaatgagaccggaaagagttccaaaaggtaaattacctagcgcctttataaggaagagtgaaataataaatcatgcgtgattaggcagatgatgaaaccatggagtaccacgatagtagtgagtatgcagagcaaatctaatttggaatctttttttttatatatacgtacgacattttgatatgtgtatacaatttttccattagatcatgtgtaatgatcaaaccacagtaattagtaagccctacattcgctttgggtctgccattactgtcttaaaattctcaataatttttgagcaagggagcctatactttcattttactccaggcctagaaaattaggcctagaaaatgaggtagctggtcctgctttctgctcccacttagaggatctgtaagaataataacatttgtaaatgatgtactttaaaaagtgtgacttacaatttctgaagcccagaaaaattatgaagtgattacttaaggaaaattttcatgcacataaatacaagcagagcaggagaataatgagttaacacagtgatcttattttgtgaagagattaactgagataagtggaatttcttacaattttagattaacattatgttattaatcttcataaatatcacatcctgagttcccattacatggagagggaagcatttttagattattaaaatgaggcatagagcaaataaattataaactctccaaggaagtccctattcaagggttttaaagtaagaaatggcaaatagaaataaagaaaaactttatttttctttaaactttagtactgaattcttggtttaccatcttcaaaaaaaatctgtaataaaaccctaccctttcatctatgaattataactttttaaaaatatatttctttaccaacattttaatacagtagattcactaatatttgttaattttgaatttgaagacatatcgatctaatgcatttccaaatgtgagcttcttaaataataattgttgttccttttattgacatgatatagcagtattacattgtaacactacatgtaattgtgattttggtaatattaaactgtgtttgttttaagattttcctctgtagctataaatgatgaaatagaaagtaccagtaaaccggagtattttttcacactaaaaatatcatatttttaaaagttacaatatttacatttcaagatgagaaagtagggttaataaaaactgctattattagagtaatagtaacaaaatatacaatagcatcaggttttttttaatatttaatgaagtcttcctccaattatttatatgacaaaaatttaattcacaaaaagcgaattattggaatgattgctttgaaaaattgcctgattagcttcttctgcccagtctctcaaaagaaaatgtttaggtataactaacttactgggagagtgtgataaaaataaacatgctttattcatgtgccaggctgctctttcttagcatgcaaataaaactgcatgagggctaacagctgctcttagagtactgcatgtcccagtctgctaggggaacacagctggagaaatgtacagagcattttcatcattgaatcaaacacaaactagaaagccatttagtactacatatgtaatactattactattgaaaagtagagtttctgttctctccttttttctgacacccattttaagctgtgccccagtggttctttacaggaaagtttataaaaatacataactatttcatggtatttcatcttgaatttttttggaatacagaaaactgtattttttccttcctctttccttttctcccgctctcctttctttcctttctgtcttcctaaaagtgtttcttttctacctaccaaattttaaaccctgcttgaggcagtgaggaccgtatggtgaacagttgaggttgatgctcgtagagctgcatcttttttttttttttttctgagatggagtctcactctagtgctcaggctggagtgccatggctcaatctcagctcactgcaacctctccctcctgggttcagtcaattcttgtgccccagcctctggagtagcagggattacaggcatgcaccaccacgcccagctaatttttgtatttttagtagagacaggattttgccatgttggccaggctggtctcgaactcctgacctcaagcaatccacccactttggcctcccaaagtgcggggattacaggtgtgagacaccacgcccagctagagctgcatctttcaagaccgtaatagcatctacaaacagacctcttcaaatggaagacaaatgaaaatttataaaatgaaaaaactttaaacagaaacaaggagagggagaggaatggagacagaggaaggggatgagacagagagagaggagaagagtggtgagaaaaaaagagaggaaaggaatgggaaagagagaagaggaagagagaaaacaaatctcaaagctatttggggaagatgaaaaagaggatgtgaaatttcttgttatgagcatttattgtcatgaaattttaatgactattaaaaaatcctgcacccaattgctttacatgatccaatctccattttttttttttttttttttttgacatggagtctcgctctgtcgcccagactggagtgcagtggcatggtcttggctcactgcagcctcggcaacctccaccttccaggttctagtgatcctcctgcctctgtctcccgagtagctgggactataggcacctgccaccacgcccagctaatttttatatttttagtagagactgggtttcaccatattggccaggctgttcttgaattcctgacctagtgatctgcctgcctcggcctcccaaagtgctgggataataggtgtgagccaccgtgcccggccgtatcatccactctcctacggatataattaaaaatccacaatctttagaacttcagctgtcaataattcttcccctgctgcctgacaccacaagcattttgtaaatactttggctctaaataggtgatatggtttggctgtgttcccacccaaatctcacgttgaattgtagctcccataattcctatgtgtcgtgggaggaattgaatcatggggtgggtctttctcttcctgttcttgtggtagtgaataaatctcatgagatctgatggttttataagggggaatttccccacacaaattctctctcttgcttgccaccatgtaagatgatgtcctttgctcttctgccaagattgtgaggcctccccagtcatgtggaactgtgggtcaattaaacctttttttttttttaataaattacccagtcttaggtatgtctttattagcagtgtgagaactgactaaaacagtagggtaaggttgtaccaactttggggaagatagtagtgacctcttgtaactctacaattgttttggaccatttatatagttgtgaaatagttcaacctgaaaatttgccagcagattctgtgtatctcaatctagccatacttcaagagtagcaagcattataaacagactaacctaaaggaatgtgagaaatttcaagggcaccagcaacctataatttaataaagaagtaaggaaagcacaatctcagtgagacaggagaactttctagaatacctggggaaaactatactcaatttcaccatagctcacaagtcttgtcatcctgtagtttatgattatgaatgcaggcctattttcagctctaggacagccctgataatttcatctcaattataagttatatttcaaacatgaaaatagaaagattcagaggtcagggccaaaaccaaaggatgattttgagctgatttacaggagtcatcagagaaaaaagaagatagaactgaactatctaggtttattttgggcaggatcacaaaattgaatcttgaaacattaatgtgaggttccttttctgggggtatttatatgaacagcagattttttttaaagaaataaaaatatgatattgaatttttgcagagcaacctaaaagcatctttacacatttttctgaattaacagtctcttacctcttatattctaaggaataaaatagggatttcttaactcttatcttaattagaaagtatttattgatgttttctgtcaggaagcaaataaactaatgtcacttgagaactatgttcctgcaaagcaatccaatgcatttattgtctactttgtttttgcagatacagtcacagatgccttttctcttgttaagcagatgtctaaagaagaaaacaattatcatatttaggctgaaaagatagaatgtatacttcacataaattgaaaataaaaatcacatttcccagaaatgaccccaaacaatcaagcaatgaaagtagcctaacacccatgggatacaggacagctgagctacactctatgaaagaacagtatctgtcacagttcaaaaactcattcaggtctttctatcctgaaagctactataattcttatttttcttataaagtgtgatgttgctgttaattgacatcaagaaaatccttacaacttgtgtcaaatgacataaagtaacacagatttttgtgtcaaaaatgttatctaacattgaaatattttcacccaagtatatatactcaatatcacacacaacgatagacctatgcatattaatttgtccctgtggagagtttagcaatctgtgaagttagagggagcacagttcacacaagaccaccctcacttctgacaccaactacaaattcagggttatcccaaaactaccctcatgtttggtgatttgctagaaggactcacagaactcattgagagctattatacccatggttatggtttactacagaaaaatgatatggattaaaaaccaccgcaggaagaagtacctaaggcagactccaagaaaataccaaacatagagtttcggttgtcctcccctcgtgaagtcagaacaatatgactttcttagcatcagtgtgagactgtacacatggagtattgtgaatcaggaaagcccactagaacctcgttgtgcagaagttttactaaggcttctttgtggaggcatgattgctctcatgactgatcttaggaggtctagctatattaaccaaaatctttgccctacataatactgttggtctttctggcatggtcaacacagaccctgaatattatctcttccccttcctctctatctccattcctctcctctctctccttgtttctgtttcaactttttttcattttatgaattttcatttgttttccatttgaagaggtctgtttgtggatgcttttatggtcttgaaagatgcagctctatgagcaatgacctcaactgttcaccacattgtccccactatctcaagcaggtcatttatttattcattcattttatattaacttaccaaacagtttggggcctatgtgcctcatcttactttgactgacattggtcatagaaaaacacatagtcatagaatgttgtgattagtaggtaatcacaatatgaaaaaatatacatccaagatgaatcgtcagctctccctgaagggggtgacttccaagagggagaaaactttgaactgcctttgagctgatctgtctgtcaagctacctactgggttgatgttatatgagtgagtctgccgggctacccaggcaggtgaacaacatagggaaagaagaataaagcaacatgacatatttccagtaacatttaacaacaaaccacatttagacagatgggaagaaaactcagacaaaaacaaaaccaaacaataccacagtggttctcaaataatagaaggcaataatgtgggcaaggcagacagtctgtcatctgttgttacagagttgtttgtacataaaccttgtacgtcagcaccttattttttctaaaactaggctttggaactgcaaaacctgagggattaaaaacttggaatagtaggaaacaagccgacaatagtaagaatccaatcaccttgcacaatacaacgatatttcactctgcctgggaatgctttctcaggtgttatactgcccattgaacacgacttctacacggcacgtctgttgatcttgaactgttttctgtcccaactatgctttcttatatactcaccaacatgtcccaacaagtgtgtgacctttatttagtgcaggctagacattatattacatttcttatttcttccctgggcaaactctattcccctgaatatcaaggcacataactcactttgtccaatgtttcaacagaaaaaaatcaccagagaattttatacacagtatattaaacccaacttagaacataatgaaaaatgtaactttattctagtctcagagtctctccataaactttactcagtgggggttaacttccgttcttcctccatgaatacatggctggccccgtgcgtgttcagcatattcttggacagtatacattctttcagtcgttttaagaaacaacatagtcaccattcagcaaataaacttccagtacacgactacattaaaaaatagaagtagctataaaagaaaatatttcttctctctgtagctcaggtccgtgtgttaaagaaagcctaagctctctcccttcttttaatccctatcactgtctgcttttttttttttttttctgaggcagagtcttactctgtcacccaggctgcagtgcagtagtgccatctaggctcactgcaacctccgcctcctgggttcaagtgatcctcctatcacagcctcccaagtagctgggactacaggtgtgcactaccacgagcatgcctggctaatttttcgtatttttatatgaaatgggttttcactatttttgcccaggatggtcttgagctccttggctcaagtgacaggccctcctagacctcccgtactgctgggattgcaggtgtgatccactgcatcctgcctttaactagttttatcttgcattggttatttattgtttgagcaatgagttacccccacatttagtaggttactacaagaaagattaattttctcattgtttctgtgggtcgcctgcaaactgagcatggcttccctttatcctctagttctaggtcagggtctctcacaaggccataatgaagatataacctaggctactatcctctcaagtactggattgacaaggggaggattcacttccatactcactttgtggctgttggcaggcctcaaatcctcactggctattggtcagataaatcagttctttgccatatggacctctttacagggcagatcacaatgtgatatctggcttctctcaccacaaacaggtaagagagcagagcctgaaatgtaagcatggactctttaacctaatctcaggagtgacattccactactctgtagtgttttactccttggtagccagttattaagcccagcagaatctcaaggtgaaggaatatgacagcctgaatactaggagatgaggataaccagggaacatcatagaggctgccagccacaatctctgtggaccaggaagcttttaaaagttgattctttgcctagttttgatcctttatgatctttgggaaattcctgttgctggagacgtctcacctctggttaccttaatcaggcaatgagtctatatttcggtggtcatttagatttctcccttagcctttgggccaaaaggtggcaataatcttcttataacctaaaacaacctctctcctcctagtagtgtatacatggtgcactgaaaaaaatctatatcccttacctttacagatggtaggagtacaaactgatgccagcacagcaactctccaacttatatagtattaaaaatgagcatttacatatgatgccatataatttagtgtttggatctcctactcccctgccacccatttgtgcactctgtgctcttatttcttatggtaaaacaatcctgtatttcaagtaaacaaacttaatcagtttaatatagaaacaaatactctaggaaaattaagttttattataaacatattaatgaaaatcaaaataatttaaaatataataatggctttcagagaaaagtgtttttgctttcctttattatttttgctaatagtcataaaaagataaggaagttagccaataatgttatcagaaaacacagcaaagcttttagatgcccttaaactgtcaccaaaatcaagtgtaatttactttcttttatgtattactagcaatacttatgtcacatttttcagtgttcccatactatcagggaatgtgtatattccactgagctctgattatttggtagtggtgttacattttaacatagtatggccataaagttgtactaaaaaatagcgaattttttttattctgtatgaggaaataagctatttctccattcttttatctaaacacttgataacataggataaacattaacccttcaattaactaaatataacaattggcaaagaattcacgttaggaaaggtacaaagcagtaaatctacagattgttggtcctaggatatatagctcttctggtaattacagaagtctgtagtatttcttaatttttcagcacagttgataaagataatatggatagacactcaaattgtttttattttacttcgaagatcagcacatttttgaacatttagaaaataccagatttctctggcatgtaatttctctatttaaggataaaaaatctgatgaactctcaagtccctattaccttaaattccaaaattgttttaaaaatgttgagctagttacttcttgaggaaggagaaagaacaaaataagtatattcataaaccttctctattaaagttacacagactttaaagaaaacgtcaccctttgtcagatggatagagtgctaaaattttatcccattctataagttgcctgctcactatgataatagttccttttgctgtgcagaagctttttagtttaatcagatcccatttatctattttggcttttgttgctattgcttgtggtgttttcatcaggaagtccttgcccatgcctatgtcctgaatggtattgcctaggttttcttctagggtttttaaggttttaggtctttcgtttaagtctttaatctctcttgagttaatttttgtataaagtgtaatgaagtggtccagttttagctttctgcatatggctagccagttttaccaacatcatttattaaatagggaatcctttccccattgcttgtttttgtcaggtttgtcaaagatcagatggttgtagatgtgtggcattatttctgaggcctctgttctgttctattggtctatatctgttttggtaccagtaccgtgctgtttttgttactgtagccttgtagtatagtttgaagttaggtagcgtgatccctccagctttcttcttttttattaggattgtcttggctatgcagactcttttttggttccatatgaaaccaaatttaaagtatgaaatttaaagtagtttgtttccaattctgtgaagaaagtcaatggtaatttgatggggatagcactgaatctataaattattttgggcagtatggccattttcacagtgttgatttttcctatccatgagcatggaatgtttttccatttgtttgtttcctctcttacttccttgagcagtggtttgtagttctccttgaagaggtccttcacatcccttgtaagttgtatttctaagtattttattctctttgtagcatttgtgaatgagagttcactcataatttggctctctgtttgtctgttattggtgtataggaatgcatgtgatttttgcacattgattttgtattctaaaaaaaacaaccccatcaaaaagtgggcaaaggatatgaacagacacttctcaaaagaagacatttatgtagccaacaaacatatgaaaaagagttcatcatcactggtcattagagaaaagcaaatcaaaaccacaatgagataccatcttatgccagttagaatggcgattattaaaaagtcaggaaacaggccaggtgtggtggctcacgcctgtaatctcagcactttgggaggccgaggcgggtggatcatgaagtcaggagatcgagaccatcctggctaacatggtgaaaccctgtctctactaaaaaatacaaaaaattagccaggcgtggtggtgggcacctgtagtcccagctactcgggaggctgaggcaggagaatggcgtgaacccaggaggcggagcttagagtgagctgagattgtgccactgcactccagcctgggtgacagagtgagactctgtctcaaaagaaaaaaaaaaggtcaggaaacaacagatactggagaggatgtggagaaataggaatgctttcacactcttggtgggagtgtaaatttgttcaaccattgtagaagacagtgtggcgattcctcaaggatctagaactagaaataccatttgacccagcaatcccattactgggtatatacccgaaggattataaatcattctatgataaagacacatgcacacatatgtttattgggttactattcacaatagcaaaaacttggaaccaacccaaatgtccatcaatgatagactggataaagaaaatgtggcacatatacaccatggaatactatgcaactgtaaaaaaggatgagttcatgtcctttgcaggaacatggatgaagatggaaaccatcattctctgcaagctaacacaggaacagaaaaccaaacaccgcatgttgtcactcataagtgggagttgaacaatgagaacacatggacacagggaggggaacatcacacagcggggcctgtctgggggtgggtggctaggggagggatagcattaggagaaatacctaatgtagatgatgggttgatgggtgcagcataccaccatggcacatgtatacctatttaacaaacctgcacattctgcacatgtaccttagaacttaaagtataattatatatatagtatatatacatacatacgtatatacatgtatatatattacatatctgtcctcattagttggaatacagcaggctttactagtgtatctgaagtaaggaggaaccaggaagtgagctgttttgtaatggagaccagttatatctaacagagggcaacagtgtctataagactgtagcctattggatgggaagctatcttatgcaaatatgatgaatcttttaaattctgagttcaatgcagtctacagctaaactcaaatcccggctcatactaaccttggtccttgggcatgtttatgcttcagttttctcatctgtacatgggttaataacaatactcagcttgacagtaaccatactgcacagtgcctaacacatgtaagtgctcaattaacgtccatttctactttctgaaaatatatggtattagtgtgcaaaaagttgggctacataactcaaatctcctttgtatcttaggtaagaccgcttctttctctggattgtttcttctagtcaaatgcacaggaatttagttgatctcccaagttattttggaccttaaattctgttttattcttgttcattttctatgtagtttagatttagttcattggactgatttatgttctgtgttcttttaaaattcaggaagatgtgtataggatagatagagcaaatatataaacactcaatttcatttactttaatataaaaactaacaagtttctcattagttataataaccttaaaattgatgtgtttgggaagcaacctgcatagtcattaaaagcaggagttacagaatcacaaaaaaaaaaaaagaaagaaaacatcactaacaatgaaagcagtaactaataaatataagttgtttttaattgtgcaaacaatttgagatttgaaaagtatttctggaccaagatggtgacagaaattttagggcatcagtttggtcttgaagtttaacaagatttaattgtcagaagtatactgtaaagtgtattctttttcttcttcccctcttccaaaccacaataatgtaaagggtatgtggttattatcagtaagaacaattagaccagaattcatcagaatggatatcatattaattctgtcctggttaactgtgataatttaagtctttgtgtattttcacttgttcaatgagtcactgggtattttaacaatgaaaaatcggtcggaacagtgttacactgagaataagcactcttgaaatgcccaatacttttgaaataatgaatacctgttgttaggtaagaaattaataattattaagttcaataactcatctccttttagaaagtcccactgtatctgttataaaattttaagaaattttcgaggtcggcgaatttacaaggagctgtatttatggcatctttctggatcctacttttgcattctatctttctggttaagttcattagggtttccagcagtggttatcttggatctgaaacattgtcagagatcatatgaaaacctgaaactgtaaaataagggtaaaggaatggtagcgattgtaaaattaagaacaaaaatcagatttcacacaacagaatttgaaagcttgaaataatagagaattttcagtgtttcaataaataaataaaatattattagtgaagggaattaagagtttgatattatcttgatgaattcaaggtagctgaaattagcaaatctgattttgtttgcatactgatagtgtatcatctagtgggagaatcaggtgaactaaattctcagagactgatgtataaatcaaagtataaaaatattgtgttggtaacttacagggcactgcttagatttcttttttctcacaattctctcttaatgagatcttgcagaatggcgaacttctcacattttttgactggcatattccttctttaaacttgttaataccattacttaggttagtgtcaactgtcactggtttcaaggagtcttacaatctctgaaagttgacatttcagatttctaacttaattcattgagttgtagttaaactcatatgaggggaactttaattcttaacatgtagttaaacttatatgaggggagctttaattcttaacattaacctctcaaatgtgggtcactatgtacaaatgatgaaaactaactcatgttttaaatgatagcaatatgaatggcaaaagactaccttagcatatttttaataaaaactgctattgtgctcaaaactcctgaaaaaatcacattttacataatcagtaatgaaatagttaatatttctattatgaaatattctgatgtgtgaagaattgtactgagtagagccctaacttctacttggttggtgcaaaagtaactgtggtttttggcattactttagtgacaaaaatatacacacatatatattttgttgttgttgtttgtttgcttgttttttgagacatagtctctctgtgtcacccaggctggagtgcaatggcgtggtctcgactcactgcaacctctgcctcccaggttcacaccattctcctgcctcagcctcctgagtagctgggactacaggtgcccgccaccatgcctggctaatttttttgtatttttagtagagacggggtttcaccgtgttagccaggatggtctcaatcttctgacctcgtgatctgcctgccttagcctcccaaaatgctgggattacaggcatgagccactgcacccggccgaaatatacatcttaaaatatatattttaaataatatattttaaatctctctctctctctctctctctctctttctctctctctctctctctctctctatatatatatatatatatacacctatttaacaaacctgcacattctgcacatgtaccttagaacttaaagtataattttatatatatgtgtatatatacatacatacatatatacatgtatatatattacatatctgtcctcattagttggaatacagcaggctttactagtgtctctgaagtaaggaggaaccaggaagtgagctgttttgtaatggagaccagttatatctaatagagagaatcagtgtctataagactgtagcctattggatgggaagctatcttatgcaaacatgatgaatcttttctctctctctctctctatatatatatatatatttctatctctatatttctatctctctctctatatatctatatatatatgcatatatatatgcatatatatatagatatatagagagagagatagagagataaaatgagaaattacattcctagcaactattttagctcattaagacctatgtgaataaatcattgatatttttacatgaaagagaccataccataactttacttcactagatattaggccaagtagccactcttgaaaaaagagcaggcaggcaacaaagagaccagtattgcttactattgcagtaatacagtcatgagattatgagggcctatactttagctgccaattaggaggacatattttagaggagtgaaaaaagaaacaatagtttgagtgtctgattatagaagataaatatttttcccagcagataattcctttatctttgctaggcaagatatcaaggtctgttaatgaataagattaactagcataagagacttgagtataatgacaaagtttcttttatacctattgactgaaaatgaattatggatttagcaattaagtgtttgttggtaactttcaagatcattcagaaatcaaactgcagtttataaagcccagagttaagtgattttaacaatttgatacttgctgattgaccttctaccaggttttagataccattaacatatagagtaaaagagataatccttgccctcaataaacttatagatcataaggaagagatacagacacataaatggtgcaatacgtcatataaaacattacacaatggtgaaaatgtaggaaagagtagagagcacaaagtcagtctgcaatggcttcacagactatggccaaaccatctctaaaaggagaaatacaaattcatctctagaataaggggtggaagggagtttatttccgaaagtgtgatagtaggttcacagaacacataggtttatgtaaaagagcatggtgtgttttcttgaagatgaagtttaaaatgaggagtgatgtgatcaaatatcaaacatgtaattggaatctgcttatcataggtatgcaagagatagaacaatgagaacagttggacacaggaaggggaacatcaaacaccggggcctgtcgtggggtggggggagcggggagggaatagcattagaagatatacctaatgtaaatgatgagttaatgggtgcagcacaccaacatggcacatgtatacatatgtaacaaacctgcacgttgtgcacatgtaccctagaacttaaagtataattaaaaatatatatatataaaaataaaaaaagacaaatgtctctacccttaagtagtttatagttataagtgaagaaaaccttacatgaaaaagtaatgaagaaagtgatagtacaacaagcagtatagtagaagactactgtcttctaaatttccaaaattatttagataactgcagaaaaccaacaagtatttctcaatcttaacaaacctcactcatcaagactttaatcccaaaatgatcctttgatttagacatggagaaagcttcgtagagtttatacaaattgttagaatttgacatcttcagtttatttctcattaggcattgcacaatcttcaagaacagaaacttagaaacgttgttatatctttggaagatatttagcaatttatatattacatttgaaaagaatgggatctcgatgaggtaagatacttttagtttaaaaagcatcttttttttttccaaaaacacttagctaaaggacactattgtccattacgtttgcaaaagagatatttcagaaccacgttcaaatataggaaagaagaaatcttttttaaagaatgtagaataagcatttataaggaataaatgttcaaattgatctgcagtaaagttaaagtgatattagttttgcatcagtcatctatattaatgttgaaaaatcaaagagaaaataggagattttgttattgttgcttaagcaaccataagcattctggttatttaagtcactgtttcttgtacatactttctgagagtaacttgaaagtttttacaaggtgcataagtgatcatttaaatgtattcaagtaataatcatgtagatgataacctcatggcctggaagagattatggcaaccttgtgtatgcttcaggacatttgtgatcatggcaaggtatcattagtgtcctggacatttaaaatatgcagtgtatatcctaaagattcacattggaagctttctgggcattgattatgttatggctttaggacactcagaaaagattttaattaaataaatgctaatgaagattgagagaaaatagctcataatttaagctagtgcactcccttatagttatcaagaaactgtttcttgcatctagctccctgtgttatatttttgtgtaggccatgaagatagatgaacagtgatatttctgggatgctgctgctcataaggcactatacgcaagctggagaaaatctggcagagtgcagaatcgactatgtctaattctgtttcatgtatatagatatctcataattcaaaggttctacaggcaaccccgcagatagacagtaaactcttgccttttgtctagttggccttggtctatgttccctctttatcttttgtcttcatctctctttttgctcctaatactgctttggcttcctggtgcatctgctcatgtggtatctgcctagtttccctcagttttatggttttactcctttgtattatgacagcttaatatttctatatatgtatctatgtatgtattaatttatttttgagaccaaaataactttgctttcatccagttaacaaaggagctttagatattatagaagtttttcacattcccttttatagtaaagaaagaaatattgccatgaaacagaagacaaacaacaggggacatttaaatgtttgggaaaaatatgggggtaataattcaaatataaatacaggcttaaaacttacttttattaacctcactttgcccttggcatcttgtactttgaactggggcctgtccagcatctttctcatttcccactccagcgttacagaccaaaataccattctgtaaatgatttctgcctaccaattgataatacgaaactttattctctcacacttacttttcccactgtgtgtgtgtttataaacattctgaagaaatgaagatcattaaaatgaactgtatgccatgagtagttattttctaagccaagtatttatgggggctgtataatgttctaatgtttaaaatacagtatgatagcagtaaaatcaataattgagttgagtgggattaatcccccaaagtctttaaaaaaatgttataattgataagaatgtcaaccaaagatagaaacacttgtagaatgcttggaagtctcctagaatataaggtcattaatagaaaatgaactgaatatttgttgtgtatttgaatccaggtaataaacatttattttcaggaactttatatccataaatcacatcttcctataaccatgaaatgctcttctagtgttttcagtttctcacctgctcctctttccctcatgatattacattttttgcacatttaagccatgaccagtgatgaccaataacaatctctgtcggtcgttcttcaggcatctggcatctagcttttggaataaaaatgccaggattcccccactgaatttcttttaaagttcacattcttcttttacctaaagggcaatgtagagaaaaatagtgtaagatttcaagataaaagtgaaagctgaaggaatttcaacagagaagattctcataaccatcttagccaccttgttgtatgtatataaaaagtttagaaagtttacagaaacaaatttaattacatttcaaattctttttagtatctgaaagaatattctcatatattattctgtactcgtattttaatcagagtagttttcagtcaacaatccactgatcctcttttctcttcctgtaaggaaacacttccccatcttgccaactctaccttgtattggcaagtgttgtttctaaatcagattctttttgaatgcactaagcaaccattttcatactaagttgccatttagctttgcttttatgccttatgtcttgtatggaagctattaaaatttagttgacttcataagaaatatatgcccatactgatacaaataaatgaataataaacaggaaagaagagacacatttcccaagcagaagaatcccaaataatttatgtggctactcctatctcaaagaaaaggggcacttgacatcagccatgtaatcaatgtggacattagtagtaataaatcatgttgatagtatggacacttaatatgataatgtgatgtgatgaaaatggcacatctcttatgtggtcttccttctaataacccataactccagtcctgtcatgagaaaaataccagattaataccaaaatgaaacatcctacaaaacagctaaccagtactcctcaaaactgacaaggttataaaaaaataaggaatgtgtgggaaactgccacatccaagaggagcataaagagatattccagctaaatggagtatggtagcctggttggaattctggcacagaaaaaagacattaagtaaaagctatggagaccaaaataaactgtgaactttagttaacaataatgtgtcaatattggttcatcaattataacaaatgtattatactgatataagatgttaataatagcagaaactgactataggatatatgggatttttctactgtcctcttgatttttctataaatctaaactaaatatttagttgctgatgtactgttatatttggactgcagtgccattataccatcctttttttttactgtattcttacaagaaactggcattgctggcaataattcacttaatctctccacacatatatacacatacctcaaaaatcagaattattgtacttatcatagaattgtgaataaatttaatcagttcaaaatgatatttaacaacattagtccagtgttcctggaagcaagcattcacttcttcccacatggccaaatctttgttcattttctctagatggctagagaaactatctcttccattgattcctaacaccaagcacatgttacagttgaccccaggtagatgaatactctaatttctcccctaggtcactctgatgacttaaaaaacaaacaaacaaacaaaaaaaacactcatctaaggaaaaaaataagactctgagacctaagattgttttctaagccagttcaaaggtgaagttctgggtgttgaaggctccagggagagaaatggagtatatttttggaaactggaaattaaaatcacaaagtatattgatggcccataggctaacaggtcaaacagtgtgggttttccagtaaagggtctttgctgaatatgttagttgccccactcaggatgacggtgcccctgttgtcatttttagtaagtcacgtgtgccccactgtcagctggctagcagctcatgtcagatttcagcatctgggtgccagccagtctctattgttctgaatttttggcgcatacaggaagcactcattgtcatttcatgaggaggagtgcagtttttatcctttctctggttttcagctcttttctgctttatagcatacctatgcctttctaatttctttagttttccctccgtttttcagtgagggtcctagtctgcctggagagtcaggtacctgattctcttctcaggataccttctcaggtatctggttccctctctgtgggacttctgaacaaacttccgtctgtggcaaatcactgacttctgaaaatcacagttatttgacctaatgcttaaaagtgaatgaggaacttttcccttttcaaaaatgcttccttcgccccaaacccccataaaaattatttgtgtgaaagtaaagctgcagaaaatgttcctgtccacttattataaaattttcatctggataggtacataggataaaggagatacaaattacagcaagataggctagggaagagaaagcaaatccctaatttttttcttaatggagacttagactctatactttttgttaaagggaaagacagtagttgtaagttttatggtccaggcagccttgacatttccttttccggagcatgattttatctgaatatagttaagaatgtaataggaagaaggtttcaattcactaggacctagtatggcaaggaaaacacagagttattgagacaaatgttaaatatggcccctgggtttattaaaaggctttgatttccttggtggcctctgcttcagagcaagctctagcattctaaagtagaattcatctgggtgaatatgtccatattagaaggacaagttaaacagaataacatctctaataatactaaattattaaagcaataaaataatgggaattaagggctccacaaagcattatagaatgatatgtttcttcagattctgcactcttttattatagcatgtaaattattattctgttttaaaataagttatgaatttcaaaataatacattaacagtatggttttgccacctaacagcattctcatttatttatgtaacaaataaaaatgcaagaccctcataaacataattaaatatcaaattttctaggatatgtgcacgcagattcagttatgtccaaaataatgaaacattataatttttatgtattcacttttgactctctgttttctttgttcttttactaattacaattcaaaatattatttcattgatttgaacttcattagtttaaacttaacaaatgtgagtctgaaattatcccccccccaaaaaaattaatgcattaacacaaactttaggccacaatttttgtccaaagggaaaagtttccagcagaataaaataattaaatatatatttattgctattttaagaaaacagtgtttttttggaagtatatcaagggaacccagggaaatgaaaaatatttgttacttataaatggtataattaaaaatatttttcttccaattttttttgctcactaatataaatatatgtgattatcatagttattttacattttcttagcaaataatgctacacataaccaaaggtagtatttcaaaatgctacagtcttactcaatagagttccatgtttccaacccagagttcttatctttctatttatgctctgttaatcactagtaattactgcactttcttttcctatgttattattggtagaataaatttctgtgcatttaaaaaggccaagtacaagtgacattttatattaaagagcattcttcctgaaggtacaatgcatgatttcaacaaattatactgtagtaaatatttttaagttgttttatcttaatccagtcctagaaatatgtgtttattgttttctgaaagcaaagagaccattactggaaaacaaaaattgtctacatggtcttagtagctaacaatgtatagccctgcaaattgcagaagttcagtttggtagtggcatcttcatttaatattgttgcaatagccagtcaaccattaaataaaagttcctgaaatcctggtatctcctcttattcttttatttttaattaaagctgcagagagtcattgactgaaatgtcttctatcctcgttgcttttttaaaaaaatttacctcagtcttttatactcctccttaatcatgaatgcaaataaaattcaaagtgtaatcagcagctgctgaaagagagcactgagcaaactgggttgccgtggaaaccatgaagtcagtccttgaccagacaaagaataatacctggtgtgtgtgtgtgtgtgtgtgtgtgtgtgtgtgtgtgtgtgtgtggtgtatgtgtgtgcacatgcttaccaacaatttgcaaagaacaactaaaaatgtttcaaggtttattttccccaaactaaattgttcatttttagatatttacattacagatgaatgaatacattcgactattaaatttgtaagcaattgcctctcatttgagactggatagtcctgtcctagatgaagctacaggtatgacaaaagtactatcaaattgaactgagcacaataaatattgaaagccttccactgcaaacaaataaataattaacacaattatttggtctattatagctgtcattatccttgctttcacttctccaacaggcgttgcagcattttaattgtattttctcctgggaaagaattatctcctgctttaagctgctgggggaaagtattgttaagctttttaaatgctgaatataaaggtcataccactgagggattttcagctgtgagtaaacaaattcagaggaaatagtgctccacatcactcttattcaacacaaatgtagttttagactgactgcctcaatgtttgaggatcttaatttggcatgtgtaatgaccattgctagtaatagtatgatcggagcccaaaattattaaaactcattaataggcacatataaaaataaggaatcgttcaattctgcagctgtagttttattctacattgtaaataccttgggggagaaacgcattactgattaagaagaaataaaagcagttgcttttgctggtagagactctgaatttaagtttgggacatatggacagatcatataccaaatgccaaagcactgaaaaagtgtttcatctttccctctgtccccctttgccaagaggcaaagatggtagcattctttttgcacatgtcacctcagacctagacaatggctctttttttgtttcctttttatcagatgctctcttcatcaagtgtgcaagataggtcattgtgattccctcaactttacagctgagaaaaaacataagcattgaaaagttcggtaacttgtctgagatcgctgaagaagctattgatggggaagaatttagaatttaattctgaaaggagtatctttccatggttttacatttttcctgacttaatgaatctggaattatgtggggttgggaagaagatcactaattgattgaagttagcatatagaaatactattcttactgagctgtaacctgaaatgtttcgttaaaactgtacatgctgccacaactaacaaagagcaagagagaatgtggtcagcaatttctttgcctttttttcccgagttttcttttgcttgtttgtccagtttttttttctatctcattattttgtaggtagtgtttttgctttcatatctgtactttattgttatatcagtcactttccctgatctgtcttgaacaatcattgcaaattcattttgttctaatttgctttacttggcaattacgttaaaaatggcaaagtattatttttgtcagtctagaatataatcaacttattttatctgagtttttaaacagattatgaatatttctggagctttattgtttatatcacaagtcaatttctttggacttacatcattataataaaatataaaaatagttaaaaacatgaaaaattactgtgatgatggaacttatatcagattggccaagtttctcatctaagtacacttctactgtattcatcactatctgcttcatggagagggcagctgtttgtagcacacttacgcaactttaattgataggcagtcatgtatcacttaatgatgggatatgttctgagacgtgcatctttaggtgattttgtagttgtaggaacagtataaagtctatttacacaaacctacgtggtatagcccattattgccagggttatatggtggagactattattcctaggctaaaaacctatacagcacattactgtgctgaatactgaataatgtaggcaattgtaacacaatgataagcacttgtgtatctaaacatatctatatgtagaaaagtaaaatacagtaaaaatacagtattacaatgttacgggtcaaccactatcagaaatgtcactggttgagatgttagtggcatgactgtatatggcaatatacaatgacaattcttttaatatttaagttactatgattctgagcctgattctctgaattttaaaaagtttactcttctccttggcagccctcatcagatactccagaggaactccaaggcagtttcttcattccaaagggattagtctcagtttctattctggagtgtcccatcagtcatcctaagcgttttattcttaattttgcagttaatcagtgctgcatagggccacacaaaatttagggctgtcttagcagtgtggcaaagaagtttatttacctttactgtttccactgtcctagcagtgtctcacatatgtcagaggatatagcatcaggtaccatcggtggaagaaatgtactcccctaccaaatttttataggtagtggcacactcgcctcccactctactattactgaagcaagttctacagcaataagcaatcacagtagtcaatatcaatggttcttaaagcgttgtcccagagcagcagcatcacctggagatttgtcgaaactattaataccgggcaccttcccagatatgttatgtgagaaacactagtggtcaacaccaagaatatgtgtattactgagccctttagatgattctgatgcatgccaaagtttgggaatgatttgtctatgttgcattttttgaagtcttgttttgtgattattcataataagtgtgtatgtgtatgcatgtgaatttaagtgtgtgttctcgtgtgcacatgttggtgttcgtaggctgtggtcaccaacagttctgtctagttttttctggatacctaccttttctctccttcgaaggcacagacttatcaaagtctcattgaatactgaagggaataaatgaagacttagcttcccactgtgcactggcatgcattttaaagaaaaggttactttttcttagaaaaattggtgttaagagtcatatttgcatagctaaagagaacctcaaggtgacttaaccaaaacaaagataatgatgacttgacctcaaataacgaaatgccagcaatttaatctgctatagcacattaacttaatgtgagttagagagctatagctgtataaaaaggagtagaggagactggataatactgggaaaggagcaaagtcatggatgcttacacaacaaacacatggatgcttaccaagatcaattaacaatatgttatattccttttttgtgccacactctgcccatgtggatttctttttgaagttttgcatctcaatctattcaaaatatctcataactcttcactgccagataattccacaatttcatcctgcagtataggacctaattgctactactgtccaacagacccccaaggcagtgttagccatatattaaaagcattttttgtttgttttatgttatacagaataaatttttattaatggcctcaaattgttacctgaaagaggcagatggcaaactaaaccattttttcaaaattcctcatagaaatgctaaatgaaacaaacaagcaaagtatggatttttattaaaactatgaaaaaaattttaataactgaattatagcattcgcaaaaattaagatatgttaaaacaatggaaatttgaacttatttgtaattttattttatagaacttttggtagtatttttatattattgtaatattgtttaaagaaaaaaaaaactagcacagtaggaaataagtttaagggattattttgccagtctttctctgttagattgaataataaacttgccattcaggaaagtcattgtatatttgtataccatttgtgtccagcctggtttatatttgctgatttgttgacaaatttggagcatgtggtaaacttttctatcccaagacaaggactgcacacttcaatttaaatctcagattcaaataagtggcactctttatatttaaatgtaagcacatgctataccagttttataatgttaccacctcttccctgctttggtagagtctcttcaatattagctgattttatccattgttaagatggtgttttcaaagaagataaaaatgcattttgaatatggaaatataatttttcacattcctttgaaatctggaagagaaatgtagtaaggaatcaagttgattgaaaaaaaatcaaaagaaaataacaagtttaaaaatccaggatcataagaagaaaaaagacatttaatcttacaactagatattttaaaaatagataaaacaatgccttattttcaccttcattctatcattttcagccttttttacacacatggggacaagtactatgtcactgactattatctaatattgtgataatttttcttatcacaatgccaagttatcatccacatagtgaaaaacagatataaccttcttatggtttgatatgttaatgagttttaatatatactttaatcctttatttacatgtaagatggtaaagatgcagtttcatagtatcttttgttcctctttttcaattatttctgcaaagtaaagtgtaggttttttgaactatacccagaagagtaggctggaatcatgagaccttactgcacaaagttccacccctctctctgtggtctagcagtgatgaggttgctaggttgacaaagcagtgctgggttttccacactattatgtttcattcataggttcttcacttgcccacagaggttaaaaactaactttaaaaatgataatagatatacctaatgctagatgacgagttactgggtgcagtgcaccagcatggcacatgtatacatatgtaactaacctgcacattgtgcacatgtaccctaaaacttaaagtataattaaacaacaacaacaacaacaaaaacatataaaaaatgataataaattggatagcctaccaaatcaaaacttagtatttcttgtaagttttttcctcatgaagaaaaatataatacatttgacttaaaacaacctgaaagccttgaataattcactctaaattccaaattattttattgaacaaattgatttctactgttatatttgtctctggaagtaaaaaaacaaaaagcataaagtgtgttcttttgggtagcatgatcttaggacttttatatttaatttgcttacaaatacaagaatatgtatccgctgaaatttcttgctactatttagctacagtctgtccttgtaactcatttacaaactaaactcctttccaatagtattatgaaagaaccccctttatgctcccctcatctccaaaagtcaccttttgaattcacactcttagtttacgacatgctgcttttctgaattctttgctgccttaatgatgccatcatcttctgaactcattaaggtcccacataggtttctgtgtgttgcagtgacatctttatctcttagagcagtttggaaacctgcaggggtgtagaattgctacatatggactgttatgcaaactgagtatatcaagcctcacccaaactgaaaaggaaaagtattttgaaacataaaagaaacatatgttcgagttatagatgttgtttaatggaggtcagatctgcacattgattgttttctatcagcagcttagaggtagctgaccatggggatttatttatgagcttaagaggtctggaggaagaaccacactgatcattcacttgattataaagctcctgttctcaaaggaaataatagtgatcagaatcagccactgcgtgattgaagtaggaatataaatgaaggaacatggatttcactttaatgctgcatagactagaaaaaaaaataaatgaaagagtagcatatctgaagattccactaagcctgaaacaaggtcttctaatgcaataatctgaactttctaagtaaacaatgaggagaacccagattctaccaccctcaatttctaactaccctttttcaattataattaccttttttatttctaacttattgttcattaataagagtattaatttccagttatattcgtgcatgataaatatatgtttctcattgatttcaaactattgggtaaattacttttctaaggccaaatacagtgacagtgaagaaagcacagaatttcttgccctcaagtttctcacctattgcttagctactgaatcttgctgtgtttgcaatagttttaattcatgcattctacaggtaagataattagaatcaggtcattcctttcttttaaattttgccagattaaacacaagtatctgccacgaggatcattataatagaaaattgttctgagtttaatattctggacagaattttataaatccgaagtaaaaatgtttttcaattttataaaatattggtaatgagaataagcatgcaaataaaaacaagaaggaattaaaggacatacagctctatataattgaagagaaacttgcgaagagaccaaaagaaactggaaaagtgactgaagtgtgtgagtgtgtatgtgtgtctgtgtgtgtgtgtgtgtgtgtgtgttagaaagacagagatttcttagacatcttagtatatttggtcaatgtcaattacgacttcccaatatagaaatgggattacttatgcttgacaggtacatatttcagtgtccctgtttcagttagtaaagcttttaacaaaaagaaacataatgtgacctacagtcacataaaatgtaagagcatgtattatttagaagaaaaagtcgagagacacttggttccagaattctttgaattttttgttgttgttgttcattccctgatggtcacaaaatggctgcagcagcatcataactcacatgctaacatgactatgtttcaaagcaagaagaagatgagggtggccaggaaaaataaaaaagacataaagtaaaacatctctacgtatgcgttattgattttatcaggactgctaaccttgaggagggcttccttaagtctcattgactacaactgtgtcaatgaactcccctagcctcaaactagtctgggaagaagagtatttgtttattttagcctcagaagtgggaaacgggcaagggaaaagaatggaaggggaaaacattataatattcaatgaacagcacccgccagaattcttatctgcatttaatattaagtttatatttcaggtatgcagtgagctcaggtaggattgctaggcaattccgtcaaagtttcatttcttgtcaagatgagtgtgttcaaagatgatttttactcaattcgtcattcccctccatttttaggaagtaaaatgacattaaaagttgatgcaaatagtcatgctgtaaaattcagactttactgactttttttcattgtatatgttataccttcagttttattcttcaattttccccaaaataaagaaggatgttagtgtgcttcagtgaatcttgtgcattgaattgccagattcagtgaagtttacttaaaaccctgtgtggattattaaaatttaataatatgaataactggaataataaactaacaacaaaagctagatttaacttcatcttttctcaagcactcttaatacagtgtgcattaatttaaagaatcttcaagaagccaatttttctgaatatttgctgaccagtatgaataaattactaggggtcatagctatactttacagtaaagtgactatatttattaaactttgctcagcaattgcttttatgagaaattttaaatatttttctattttttcactattttcctactcattcactttagaattgggaatgtctatattcatcaccatttgtttttatttggacttagttcaactactaagaggcaatgagtttgccaaagaaatcgtggcttttttttagttgtccttccacaccattgaaattggtaatcagtaagctctctgctatgtgtgccgttattgcttaaatcactgtttaaggtagaatacttgttctacttcaggaaatagaaaagttctccaaactctcaatttttaagttgaactaacttttcttcctattacatactgaattttcttaaggcatcatatatgtacatttttaatgtttaaaaatatttttaagttatataattctaaaattattttaaatatcctaattaaaagtatctttcatttggctcattccaaataaatgcttttctttacccagtaaatttaatgcaatttcagtatattaaaataactgcattataaaagaaattgttactacttggttgcctttgtatcagaatgctagtaatacttcagcaaaacaggtgtgtattcaatctgttctgacgctgtataaccatttgcattgcacttgatcacatagtagaaagaagccaccttgcaaaatttcaccaaaaagtaaattctatctctagaaacaccaggagctcttagtaatttgagcttgctgaggggcaagtatgtataatgtaaatgtatcaatcaggttaatgcaaggagcactcttccatttgataacatttgaaatgcatggcagaaatacagaaacataattaaggcaaatgagtataaaatgttaatattccaatctggaagagaaaaaggtttcaagatttctccaacttttattgaagtctgaaatgagaaattcaaattatttggacaaatgagttgtttcatttcagacaaagggagagttcctaaattcaacatgactgacattttggactggatgcttctttgttgtgtgggcatcctatgcattgtaagatgtttgacagcaattccatcatgctcactagtggccagtaacatgcttctcagtcctgatgcattaaaaaatgtatgcagatattgtcaagtgtcacctgggggagcaaaattgctcctagttaagagccactggactaattgttgaatcaaattattttcaattttatgatgattgatttggacactttatgtattgttatgaaatatgttaacagtactatgtttttcattctatggatatgccaaatattagtttaacgtttttctgttaagaaagacattctaattaaacatatgttctatgccatatacaaagataaatgaaacataattctattactcaaaaagctttaaactttcctcactgtattttccaaatacagtgatctttaaaaaaaaaaaagtattctgagaagtatgtttttaaactatcaccttattactggataaaacaaggtcattaaatatataatcctgataccaattatattgatagtttctttttcaaattatctagaccactatcatctttactattttttacctgagttcattgtgcccacagactattttttttaatgtactcctttctcagagattttttttgtctgcttatagtttaaattaagatcaacaaaaagtttatgtttagtcaaagctcagctagatattttcatggagagagtttgctttggcatgaaatgctgtcgtttactggaaaacctccctgcgtgtgtaatttgacagcattttagactccccagttaatgaggttagcagcagcctctatcctctgggtctagtcaaactgaagctgtctcaatgtagattgtcatagctatgttgattcatttgcttttttggaaaaataaaaaattggacttttcaaatggtaaggaaatattctcctccgggtcctcccacatgtgcagatagtaggtttctgactgcctgctatattctgataaagtatttgtgtttccatggaaggaaatgctaattagtatttccttgtcaattttctagatatttggaatgatatgtttttccaaaagtcacatattttaaatgctagtatcagcttctgtaggaaaacataattatataatgaaatggaatagcatttatgttaacttgatgataattgtaatttcacggggccataagtgctcatagaaatagccaaagaaggcaggaaggattagatcattcttaattctacaatatgtgacttttcaacacatatatttttacttttgctaacttttttcctaatgactttgttttagtttgtttttcaaaaataaatttacaaaattttgcagaagccaatttggctagttaatttaaatgcaagtttgaaagtatgttatgcaacaggtgaaataaaatgctattaaaggctgggtgtggtggctcccacctataatcccattactctgggaggccaaggcaggtggatcacctgaggtcaggagttcgagaccagactggccaaaatggtgaaaccccacttcacttagaaatataaaaatcagccagacgtggtggcatgtgcctgtaatcccagctactcaggaggctgaggcaggagaattgcttgaccctgagaggcggacgttgcagtgagccaaaattgcaccactgcactccaaccagggcaacagagcaagactccatctcaaaataaataaataaataaataaataaataaataaataaatagccattgtagaaatatctcttttaattttatatattcatcaggtttttcttgttttttttttttttttaatgcctaacaaataccttgaaatttcagggggttacaataaaattatttttcttatctgtgagtgggctgggatttttctgattcaggctatgaagggccagctcagatgggcttcacatgtctcttatttggggaccagcggctagatagaacatgcttttctgatagatagtagacgtaccagagacaaggccaaatcctggctactagcattccattgactatagtaagtcatatggccaagcttaaaatcaatggatagaaaaataaactccaacaattctagtgatgggcattgcaacataatatgccaaagggtattgacgtacaattctatgaaagaagaaagtgaaggctgggaactgcttgtaccataaagggctgaattatcaaagcagactagcaactcacaatactaaacagtggcatttagtaatgatgggtaaaaggcacaagtgaaaactaagcagagatacagcagtcttctctagaatattccccatcctgtctggtgcagctaccaaaagtatctttttccacactagaacacattttgctttttaaatgacagctaagcacccagaaagtgtatgacttcttagacacttggctaccacattgaggtagacactacctgacagcttctattctccagtcaagtgctttcgaggaatccgtaaatgccaggttaattcacaaatagggcttacttacactaagcaatctagttagactaagaatagcctcaacctcaaaaacattcttagataagagcacctgtcctgtggctcagctaggtaatacattagaatatttataagaggtctgattaaggtggacattgacccctcccaggaggaaatgaggcagttacagacttgctgttaattcttttattcccaggagctatataattcattctaacaaatatcacttttaaagggatttgagcttaaggttttctcatttacataacctctaaatcttatacatctaaatataaaatatgctgtatctttaacttgggaatataatttgataatatatttttagtggtaagaatttcagttattattttcttttcacattttatatttaccaaaatttcaaaataagatggagaatgaggaagaagaggaagagaagtaatctagcaattataaagttgtcctcatatccatacaaagatatgaagagaatcatatttgcttatctcttatataatgtcttttctggctagatggtaaagatagttgttgatacattcaccaaagagcgtcattagacatgtgttgtgcactagttatactccctgtgataatgtgaatacaacagtaagaaaatatcaaacattttctttgactctgattcctcctgattttttttgtcttaatcttttcattcatactcaagaaagtgaaactagagtttgtcaaagtcacttcagggctaaaaagagagatcatttccattatgtattattaaaataaacctttagatagttttaaagtcaattcaacatttttaaactcttgaaagggaacgaagttgaccttgactctataaaagtattttctgtattcaggaaaggaggcagtttccatgtcagtgccacttactaaaatagtataagaattgtttctgatttaattattctcatttagatcttcactatctttaaaagacaatttaaaattgcatatatctatgaataaaacaagttgcctgaaaatattttatcctaatataaaattatctgttgtgttgaagacattactatttaaagagagcaaacttattttagtgaggtattaattgtagtgagatggctgcattctgtttcaagactcttatctggtaacagtgatgtttgggctttcttacactctctttattttgaaatacaaaactttctcgggcgaaaggagaaattgaataaatagtactatgaaattcaacatatgggaagcatttgcagtttagaattataatgatatcattttaaccttaaataaaagagattgacactaagaggtgtgcatgttttcactcacatctgataattctgtatatgaaggattctgtttcacttaacaatttgatcatctttagcacaatccttaatgggttttgcatagggaattgtgtgcagaagatacatactttataacaatcaagttttacaataaactttaggagtatttactcagggcagcaaatctgcaattaatttctcctaactccttgtgaaccaatctcattttcctcccacttacacagcctatacatggatatactcaaatgtatagagtaaaacataagaaatgatcttggctgatacttaggatgtgactaatggttagctgtcaagtgtaaaaattgtggatgatagtgttgatttttctaataagcattttcatctttgggactaaatattttattttatatagttttgaattttgaaatgaaaaagtaactgtcttttaataactggaatcagagcttacatctttcaaaaattttaatgtttctaagtagacctgtaagcattaatatctcctttttgcagacaaataaactgaattgtacaagtattatttaggaagttatatatccaggctgaatttccgtattgattaaaaaatatttaaattcaagaattgtattttattcaccaaagcctaccgtgtagtttctaaatatattttgtttaaagttaaaggaattatcttttctcaatgtcccacaatatcagaaatttaagtaacataagaaatatatgtatgtgtatatattatatttaataatattccatgtttaacatattacgctgttaatgttacatttacatgttacaatgttaatggtatacactatataacagtaaaacttataacattaatttattaaaatataatatatataataacataatattaagttggtgcaaaagtaattgcagattttgctagttttgcaccaacctaatactatctatttatatatttttcttcttgtattttttccatcactacttacagataataaaatcaagaatgcctttttttgtgtgtaactctctcctatgcattttctttttctgctttgaaatagtaatgtgacctactgcttggagctttggaaataagatctaattttataattttatgaattacaatagaattataattttagaaatgtaaaataaatttataacagcatttactagctccttgccaggacatatactaaattcaagagcttctaccagtgtggattgtttctctctccacatttaccagcttttgtctaggctttttcttccatgttgtttctccttaataggcaagcacaaagtcaggacagagtaggtgacactgcatgggtttcatcaaggtagaaagcatccttgtgaattactaactaaaagattgggtttaaccaaatttccagatctttttgcttgaaccagagattattgtgtttcacatctaaaacttgaaaggaaatgaaattggccttattttccaataattttctactgcatcccaaatagttggtgtcagtcttctacgtatattagcatatgtttaatgacatttcatgttaatgctttagttaagtttgttttcagtctaatcatccttgtcttaaaaatttctataatgaattgattgaagaatgtgcttattccaagtagattgttacttgtttccattatagatttggcgaatcattctgttgttttataaatggaaatgatactcttcaaaacttattcgtcattttaagaagagttactaaataagattgaggctatcgtgtttttgtgtttttcaatacaaagtaaaaacgggggaaatatagggaggaaaatgtgttaaaatttaaaaaatatttttgagatcatactagtaaattttgtttgcattttttacttattggtgagtagagaaaaaaacccaagtgagttctgtaaatcatgagatgatcataacctagttttaaaatttcagaaactgagagattatatttaaaagttatctcatttaaattctgattaaaaaaccagactgtcattgtgtgtcattgacattggtttcatcacagtgtcttagcaagatgtttcagggacatacacaatttgcacaagtttatttactcacagtaagagaaaatttcaagctgatagctttaattattttagctgattcctctgattgcactcatggaaaagccaaaagaagtgactgtttttactttatctctcccagtcataacttatgtgtagctctaaaggcatccccaggttggaaaacaagtttgatctctttctgaaaatgctactaaaagaagatatgcaagagatgtgagataggaacattgtaagaacagttaaaaacctaaaattcagaactaaagcttgggatgcaagaaggaattttcatggaattcattattttcttgaattacagcaccaaacacgggtttgcatgaagcaggtagctggtagtcatttgttgtatcaatagtgattcaaaattttatctacaactgttaacagttcatttttccttatggttctttaagctcctgtttagctgtatcccatctgcccttgctaaatacactagcttacacacagtctttctggattccgttgacttgaaaattcaaatctaaaaacaatggctaacatttactgagtgttcactatgtatcagtcactgctctaagatatactaactcattcagttcccatagtgatacttagtggtgtgtggtgtataatgataccatttccactttagaggtgaggaaaatgaaactcagggaggttaagtaacttccctgaagttacactgctaaaaagcatagaaccagagttaatactcaggcattctagtttcagagcatacacatgtaaccagcacaccggagtttagattatacactgaccaaatgtcattatcaaaatggtatttgttctccctttttataaagatttcatagaaaattaacatgtgatggtactaagatatatagagaaaagtaacacagtaatttcactacatctgttcatctcattactattaaacctttggtcactaaatagaccattatttgatgaggataagagggactataattactattcctggataaagatttgcctggacaaattaatattcaatcagcagttctctctgcctgacacagaaatgactacttttccatgctatttataattcctggtactctatgaaattcctcctcttaaattaatacattggtcctccctcgtttacagggaatacatccgagacttctggtagacgactgaaactatagataatactgtagcctatatgtactatgtacaaatttctttttctttttgtataatttcagaattatgtagaaatatttttatcttataataagataaaatactttttcttatcatagatcttagcaacctaagcatatgattttttttcattccttattaagtcaagaatttgccttttcacttaaaggaagcaccttacagtttgtctttggcatattcaaattgccagcattgctcttgcactttggggccactatgacgtaaaataagagttacttgaatacaagctctacttattttacttaataatggagacagtctgtcttataacccagatggctactatgtggctaatgggtaggtagcatgtacagtgtggatgattcacatcctgggagggaagaagcagcatggtgtgaggtttcattatgctactcagaatggtatgcaatttaaagcttatgaattgcttattcctagaattttctatttagtattttcagaccatggttgactccaggtaactaaaggcatggaaagcaaaattgtaaataagggatgattactgaattatgacaagcctttctctgatgactgcattacaagttgagctatttgcagtgaggttgcccagaaacctagaggtagtacatgttttttgagatggtatttccattaattcttaaattatctcttttgccaagcacccttatcatcttagttaattcaggcagctctaataaaatacctttgattgtgtaatttataaacaaaagaaatgtacctctcacagttctggaggctgagaagtccaacatcaaagtgccagcagatttggtgtcttgtaagggcccatgttctgttatggtggaaggagaaggaagctccatcaggcctctattataaggttacttatcccattgaagttatttcatcaggttataaggctctgccttcatgacttaatcacctcccaaagaccctacatcttaatatcatcaccttgagagagattttattatacgaatttggggggaacacatacattcagaccatagcacttatgattaccctattttagctcaagctaagatcaagaaaaagagattttcctcttcagttagaaaaaaaaactttcaagagccaccttattatttgtttaacaaatatttattaagcagggacactgtgcctgtaaaaaaaaataattaaaaactggtaccctttttaaaggacttaagagttaatgtgcctcttaagcaaagattatccaactagtttaggctaaattagttccaatcatattacagcatgtgtcctctttgaacctaagtaatatttacatatttaattatatgcctttttaaaatatttcacctgtatttgattaatgttgaatagcctagaatcttcaatgcaactgtaagcttctaaagagtgagaagacctggtattaccttttcttttttattcatttgggcatatccttaatagttgattgaatcactggttatagactttaatctcaaagtgattatgatcttcagtaatcaataactccaaataaattcaaatgcattttatgctaagctatactttagaatccttcagtttaaaaaatgtgaataatggtaatgcaaattatagtaaagtataactttgctgttgaaaggactttctgatacatgttttaatttgtgactagcaaaaaccttacgaggcaagcagagtacaatggtcactgtgtacaagtatgtgtaaagtaaagagtgatcatagtactgtatttgcctcatttgtgggggtgaaaggagattaaaaaggctttgaaatgaaattttcagaattatggaaaatatcattatgttattactgcagacagaacatttctttgcaattggaacatctaactctcgttaaaacaatttctatggatatcacttgtgaaaagagttcagggaactatgtcatagtagatgtaatcaattatacaagattactgtgtttcctgtaaagatatagggaagagaatgtcttcatcagaaatgttatttctagagactgcttctttgatatatatccacaagaaacataatttcctactcaaagtagcctttcctatttacaaaaaaaaaaattcagtaatctcgtgttagagctttacctcttttctattctgcggggaggtgtgggggaagagaaggtgttaaatgtgattttatatacatccatgtattatttcattattgcattgctataaagaaatacctgatattgggtaattgatagagaaaagggatttaattggctcatggttctgcaggctatacaggaagcatgatgttggcttctacttggcttctggggatgtctcaggaaacttataatcactgtgtaaggtgaagggggagcaggcacatcacatggccagagcagaaacaagagagagaggagggaggtgctacacactttatgtgaccagatctcccaaaactgactcactatcacaaggacagtatcggggggctggtactaacccattcatgagaagccaccaccatgaaccaatcacctctcacaagacaccacctccaacattcgagattacatttcaacattagttttgggtggggacaacatccaaactatatcaatccatgtaatattaatatataattatatattatatatgtgtgtgtgtataatatatatgtgcgtgtatgtatatatatatgcatgtgtgtatatatatacttagaagaaattggtttcattgtaaatggaaagcatttctctgaaaaatccataaacccttacacagtggggggaaaaatatccaaaataccaggacattatttaaaaggcatattataaatagatttcatcatactgctatcactgtaagcttacaagggtgtactgactctagtagcacccaacccccaacatagaaacagtaaagtaaaaatgtctgataatgaatcctgagtatgtaaagccgctttgaagaaacagaattttctcaggtcaaaaggtaaccaattaagttagaatgtgccaactggaggaaggactggtcagtaattgaagcaaggagaagagaataagagagaaatgtcgttatgttttctcctgagagaggtgcctgaaaaccatcttgtcggtcaatcactgcctttaatgcctgaagaaactgaaacccaaagagaaaaatgacttttgcccaagcacaacactgattcacatctaaactggaactaaaaatcaagattcctcacttacacttaggcctctagattatagagcgagcacatttactcatgccttttctctgaaagcaacagattctaggcaatagtaggaaaaatgggggcttacttggttgttggttgtttcagtttttaattttttcatgctgatgtcaatggttagaaagatttttctgttagcctagtgttttgattttatgtcttcacttagaagaaacattacctttttatatttaagttgcacacaaaaagtattagtgtcaaatatttaaatacagtccttttaaacttgcacaatactacttataaaaacatatcagagaaaggagtccacatgactgagtgaaaagctgtcttttgccacaaattttatactatatttttcaggaattatctcctttcacttcataattgctgctagcaggggccaagctaaccattaaatagtgtttctgacctcatgcactgttccatagctttgtaaagtgcatagacagttttttttccccagaaatagaaatgcttctgctactaagttgaaaggcattattagtgaaattagaatatgataacaaactgcagatggtaaaagattacttcctggcagagaataaatccaaatgcattttatgctaagtgaaatgtgattatcaaaaaattgtaataataatgattgattcatgaatggataactgtgatccagctcctgctgccaactatatgtcttaatcagatcaagatagaatcactgattaaagatagaagaaaaaagagaaaccataatgaattagaatgaatatactatattaccaaggtcatatgagttttgatagttgctataaaataaatagaatagccatttaagttcattttaaaccaaaatacattcttctgccaattttaaaattatctaaaatatatcttattacaagatcattttagtcaaataaaactttaggcacttttgaaatgaatgtttacagaataaacaggcaacagactgtacttgatatatcactactataaaagcttttgtggagtatgctagctatgaatttctagctatgaattaaatgttctaatttattacgttatactcacagtttaagaaatatttactgaactcttctatacgccaagcatatctgagtttttaaaaatgtgtatctttcctctcatagagcttatatattctagtcttattacaaaagaatatcaatattttcaaatagtgtgcatagggaatgccaaacaacacttttcttatgaagggcagattctttccactctcttcctcatactattgttgactccatttagggatcttctttatcagcaggagtggattatttctgtaaaaaaagtaaaatctgagtaacataaaatgagctactagggctaacaggacatgtatagtatatctaacctactttacaccatgtctgccctaatgattagaccacacctttcctgtttactcaattattcattcacgacatgttcattaggtgcctaaaacagaccaatctgtgttctaggtttagggcataaggcattgagcaaaacacataaagctcctgctcttatgtagcttatattttagtgaggaagaaagagtaaaaatagagaaatagatatataaaatacaatcaaatgatgataactattaaggaaaatattaagtaaggtcaggacataaagaataacagggatgctaatgagtggggctgcaggaactgaggatttgcatgaagaaataagatgaaggaatatctaggtgaggagtactccacacagaagaaatagaaggaaaagtgaattcacaaaacagggtaaccaatgagtgagccaaaatagagtgagaaaggctgatggaaacaggagtttgggttatattcatggccaggcagaagcttataaagggcctatgggccatgataagagagttctcatgaagagttatgatttttctttatgtagtgtgtgtgcctgaatgacaaagctgtcaatatataaaatattcataaaagaaaaaaaattatccatggagctattcagaagcagtgcactctttctaatcaaaactactacttgaagtctgtttaaatgtaattaaaaacagtgactgagtttataagcactggaaaacacaatgtcaaaaaaaagcactggaaaacacaatgtcaaatccagaagactgacacataaaggtaattacaatgcaacaagcacttaagtatgttataggaataatcaaggagcaaacttcctcctctgctttgaatgtaaaaagatacaaagcactttttcccacctgcacaatgagaaaaagccaaaaatctattaaactctaatttttttcaagctgtaacttttctcaaagtaaccaaataacccaacatccaaagagggacaagtactttcaaagagagacagaacacaaaacagtctgtccttagagataatctaggagtaagaggttactgtcttccacacaggctaggaagaatcacttgcaatttttatgaactcataaaggctaagtgtgaactactgtatttatttggaatagcagacacaaggggagtttgtacttatttgcaggctattgaagtactcttccagcaagtgctcttgagaaagttggtatcagaaggatatgaaacagagctctcctgagtggaactatggctgcaggggaccaggcatagtactcttgggctttaagcaataggagtttgaactctgcaggcccatttttatgtggattttttcaataaatatattggaaattttcttggaggtttgcaactatttgaaaaaaaaaaagactcacatatgaatggtatagcctagaaatatttttaaacaataagaaatggttaggtaggtcattaattcataaggtaaactggatactagtctattttatgactagatactagtctatcatttaccactataaaatttacacaaatctattatgggaagttaaaatgtatcaaaacttacacacacacttacagaccttacatggcaccatgcccagtctaaagaaatataaacaaatgtctaaatgtggcattaaattataactgcataaaattaactgtagtacatattgtactactgtgataatttcacagccaactccagttgcaactgtggtgaggtcaaatgttgcaagtaacatagtgtgagcagtttgtctctccagtaaattgtatcatgcagtaaaaagtaacctctcacagttcttgcatagttttcaccaagtttagtgcaatactgcaaaccttggataataccatgggacccataaaaagtgcgactagtgatgctggaagtgtttccaagaggcagaaaaaagaagccatgacattacaagaaatgtttaattgcttgatgtgtaccgtggactgagctctgcagctgagtttgactggcatttcagacagacaatttatcttataaacagataatgtaaacttatggtattgaagatatagtacagtactgtaaatgcatgttcccttgtgattgtcataataatattttcttttctctagtttactgtattataagatacagtatatattagtgtatgaaatatgtgttaataatctgttcacattattagtaggacttccaggcaacagtaggctattgatcgttaagttttggggtagtcaaaaattataggtggattttttactgtgggggttgacacttctaaactctgcattgttcaagggttgactatgtttttcccatctattcaccctttatccctagaaagtaaaagccttaagatcttggggaagggggaaaaatcctcttatctatggggtacatgcaaagacctattgctactggtaaagactcctgggagctggtcaggaaactgtcttggttccaggatctttcacagatataagccaaggttggcacattctgggaggcaggaaactctccagagaccaatcacaaatgaaaggtggtgtttcaaagatgaggggcagtaacagtgacaacacccttaggcccaagttgcacatgacctgtgtgaaacggaggctggaccaggtccgcgataaccttgtgcaaagtaacacacaacagatgtctaccacaggggaaggacccaagactcacagaggacagaggcacctccacttggtgcagctgtgaagggacaactaaaacctgagggagaaaaagaaacactgaggaaaaatctctggcaacacaggccctattctaaatactacaaagtaatagcagcctgctgctagaggaatccaaagcctgtggtgcactggacatagtgagggcaacaacaagacacatatccatatcaattcctgactagattgctacagccatacaccaacagcctggtaggaggagagtctgtatcaatatattctatttacctcagtctgcagtctcttacagcaatatgtctaaaattataagaaacattagaaaaaacaatccattgtcaagatgtaaagcaacaaaaatagattgagctatatcctagatgttagaattatcacagtgactataaaagtaactagggttaatatgttagcaggaaaggtgaatataacatacatgaataataggggaaattcagcagaaagaaggtaaactaaagcagtacatagagggaaatttataggactaaatgtctattttagaaaagaagaatggtctaaaattgacaatcacagcttctacctcagaaaaagaaaatcaaactaaactgaaattaagcaaaataaaggaaattgtgaagatcagagccgaaatcaatgagatagagaacagaagcaacaaagaaaaatcaatgaaaccaaaagctgtttctttgagaaaattaataaaagtgataaacctttagccagactggttgggatcaaagaagataccatataaattatcagtatcgtataaagagagctgacatcacttcaaatttcaggggaatattacaaacacctttatttcagtaaatttgacaacttagatgaagaaggcaaattccttgaaatataaacgttaccaaagctcacctgaagaaacagataacctgaatatgcctgtatatgtttttaagactgattttataaactctctcactactgaaactccgggcccagaaagtttcactggtgagttctaccagacttttcaggaaaaatgacattaattatacacaaactcttccagaaaattcaaaatgtgtgactatattctaacccatttactgaagccagcattatccttgcaaggataatttaacattcagaaatcaatcaatgcaattgcccatattagcagactaaaaaagaaaaaccatatggttatctcaatagatgcagaaaaaacttccaataaaatctaacatccattcctgataactctgaacagctctattcctgagcaaactctgttctcagcaataaaaggagactttctcaaactcataaagagcatagtccaaaaaccttcaggttatattattttcaattgtgaaaaactgaatatttttccctaaaaatcaggaaaaggggaagggtggctgctattactacatctattcaaaattggactggtggtaccagctggtgcaataaggcatggaaaagaaataaaaggcatacagattggaaagaaagaagtaaaattgcctttatttgcagatgacatgattctctctgtagaaaatcctacagaaaaggaaactagaagaagtgagtttaagaaagtttcatgatatgagattaatacacaaaatcttatgtatttccatattttctggcaatgaaatttggaaattaaaataaaagtaccacttaaaatagaatataaaagtataaaatacttaagaataaattgacaaaggtgcaagacatgtacactgaatactacaaaatattgcttaaataaattatttgaaaagctaaataaatgaagttatgtataatgcttatgaattggaatactcagtaagtattgggatgtcgaagttacctctcttttttttttttttttttttttttttttttttttttttgagatggagtctcgctctgtcacccaggctgaagtgcagtggcgcgatctcggctcactgcaagctccgcctcctgggttcacgccattctcctgcctcagcctcccaagtagctgggactacaggcacccgccaccacgccagctaattttttgtatttttagtagagacgggtttcaccgtgttagccaggatggtctcgatctgacctagtgatcagcctgcctcagcctcccaaagtgctgggattacaggcgtgagcaactatctctttttataagcacatagactgctgaagaaataaggtaattaaaatagcatggcggtgggagagtgtgtggaatggcaggaagatacaatagcaaggaataggaactagagatgagcatgaaaatgtaaatcagtgtcaggtcataaagaattctgcatgccatgctaagagtttgattttcacttgcagaagttgtatgatgacattggaagttttatgtttttaaatttttattttaaattggttttagattttcagaaaaatgcgacaatggtaaaaagaattctcttatattctttacacttttcctaatgttaacatcttatataatgaaagtgaaattatcaagaatagtcattggatattgatgcagtattactaactgagccgcagaccttcttcaaaattcaccaacctcttttttttttttttttttttttttaatgacagagtctctctctgtcacccaggctggagtgcaatggcgcaatctcggttcactgcaacctcagcctcccgggttcaagcaattctcctgcctcaacctcccaagtagctgggattacaggcaggagctaccattcccggctaatttttgtatttttagtagagacggggtatcaccatgttggtcaggctggtctcgaactcctgacctcaagtgatccacctgcttcggcccaacctctttattaatgacttttctatctgtttcaggatttttgcctaagatcccatatttcattaaattgtcattcctgcttagtctcttctagtatgtagcagtccctcagtcttttattgatgacctttaaaacatgggaatgacataatgcgattcaaaaatagatatgattgcttacagtatagatgattggagaaagtgctgtaaaatcaagccagcttaaagacagttttggtaattgagtgtgtggtgatatcatttgaattaaagaactggcagtagatatttcaaaaaagaatagttttgagaaacattaggagtaaaattaacattatgtgataaccaagttgagatggaggagcatgggaaacaaaagtgaagaaataatcgaagatgacttctgagattgggttgtgatattctaggtagatagcagtaactgagaaagcaatgtaaaatattattttgtcattctctatctttctcttacacaaacataaacacactgttccccacatctttctcaagatattattcttacttttatgggatataattttctggactatattaaatattctgtcattcatccagaaataatcagtttcaaatccaagaagttttataaggaacaataattttaataaatagaatttctataaaatgattaaaaagttttaaagacagacatataatatgatctgattatcattcttgccacaattatgtttaatcctcactctttgcttgttatgtttatgattatgtaggtgaagattaaattttacctataatgaccaaatatgacattctgcactcaccgagtttcctaaagtgcaattgctatatcttctatcagctgccaatcagttattaagtataggacagataaggtgttgttttagataaactgataattttataaatttgcaggctattgggaaaaggcctttctaaacacagtgttaagcaaaacagtcttaaaagactgacaatttcattgtatataattttaaaatttctgaaaagctacataactcataaataaatttaaaatacaagactaaaggcagttaaataaatgtggataaatagtggtgctaaggcatgtaaaggtctccttcatattaataacaaaaagacaaactccatcataggtcatatttcttgcctctcccgccattctaaccttgcaccactctctaccatgctctttgcactccagccacttggctcctctttctgcctttctggtatttcattgtctctgtgtcacaggatctttgcacattctatttcttcttttggaaacattttctttactctttttcgtcaaggtaacctccatccacttaattagttcctacttacccttcaaattgcagctctatagtcacttctgtagcaaaggcttccccaatctctagttgaggaaaaatgtttttgggctatcatagaataacgttctcttttggcctggaacctactcagtatgtcattaaacattcatatgaatatcttctgtctcacccattatactcttgcctattttgggccattttgcaccctgagtacctggtacttgcctgatatagaaatacattttatatatataatatacaggtatatatatgcacatatatatgtgttctttgaagaattgttactaaaataaaaagataaaaagataggagattgatctgaatttccttaaatcgggagctatgaaatctatcattgaaaaattataaagtaaatatgctaaatataattatattagtaaatatctgtatatttagtaaatatactaaatataattatatttatatactgtatatactaaatataattatatttatatactgtatatactaaatataattatattatatttatatactgtatatactaaatataattatatttatgtactatatatactaaatataattatatttagtatatttactaatttttgtaattatatcatataattgtattttgtatatttactaatttttgtcttgtattttaaattttatatataaattttataaaacttatgaaaatatataaattatatataaatatacatagtaaatatcaaaaaatatgtgttccagccttgtctctactacttaatagcaatgtaaacataagcctcaatttagttttgaaaaggggaataggaaaatattcaatttagccatgctgatcaaatgataaaatgtatgtgaaaccattttttaaactccaaacaaaataaaaataaagtaatatttcatcattatcatttttattacatcaatgatggtagaatcactttaggtctgattaaaagtgtactcaatactttctaggttcttctcagtaccattttgcagccttgttgaaattttcctttataaacacatggagctgaaattatttggagctaaaactatagagaatcaatgttttaataccaaactaaaaattttttaaaagagaatactattagggattcttcttctttcttttctttttttcttttttatatctaggaggctgaatttttctgaattttgtaataagggagagttaaaaaccctcctaatttttcatatgggcctttctgtttaaaaacaatgatttattttgtagttcttcatggcccagacattctaatctaagtcaggtttgaaccccaactctgccatttactagtgttacagattcactagtggtatgatggacaatgcatttaatgtcactgagtcagaattttcttacttgaaagttggaataataatagcttttctgcacacggttgttatgagatataaattgaaaaataaggtgacttataatatgtgccaggttaaatgtttaattcttctcaggtttggatcactaattataattaaaggttcacgttggctttagatgagtgaaaaaatagttgactgaaaattactcaactgagttcatttgatggctggtgatcaaccatttaagcacttctattttgtaagaaggaataaaatcttaacaatttttaattaaaatattttttctgtattttcacttcctaagtagataattatgattaacttggaccttgtaacactatttacatattaaggcaagctttatttggaagaatttgttccagatgattttatttctggcaaactacattgatgaggtcccaaatatagaccatcttctaaatgtcacatctcagatggttgctaaaaatcatatttgcaaagaattctaaatgtctgggtaagctgaaattgttttgtgttactgtattcctagaagtataaaagcaaatgtctggagctttttggtggaatattaaaaaagcaatcataaatagtatatttgtgatttgttaataaacagaaaaaaagtaattagattatatttagtcatcatagaaagaatacacaagtagtgaagttccactgcccagttatggtcattgttgagtatgactgaagattattgaaaaaataataaaaagtcaacaaatattagatgttctgcaacaattacttgaaagagcattgaagttacaatccgccaggctactgtttctcagaaagggttacacatcagaactattcaggtaacatttcataatgcaaatacatgactaccacactggactgaataaactagaaactctaggagtagacttagtcatctctctctctatttttaatctccacttttgattgtgatgcagggcagattttggaaagactatggtggacaaactgggagcactttgaggatagaacctgtcatatacattctctgatctccagggaagttccttggacgtggttgaaagttgattatttatattgatgaataagtatgtcttaatcccttctgtgctgctataacagaatacttgagactgggtaatttataataaacagaaacttattttctcacagtttaagaggctgggaagtcaagatcaatacactggcgtctggagaaggtcttcttgcttgctgtgtcatcctatggaggaagggcaaagagagggcaagagaaagccaaggggaggccaaacctgtcttttgataaggagcccactcttgctataatagcattaattcattcagaaaggtagtgcccccatgacccaaacacatcacattaggttccacctcccaacaccaacacattggggatcgagttttcaatatttcaactttgggggacacattccaaccacagcagtgtatgatgtaatgtgctaaagtcctgatgtgtcttaaaatcaccggaggaagttatatcgggacaaattggtaaatataaataagtcagaaaaaaaagatcacaaagaagatatatgttcaaaaaggatgatgctaccaaaaaatatttcactgagttctcattttcagtaagaggtaataaattttttaactctttatgcattttatttttaatcttgttttacttagtaagaaaacaaagactcaaaatatttagcttaagaaatgaaaatgttagtgtacatgaatatatcttagcttaaatggatacatttatagagcagaattaaattccataactgcagagtgaccacaaagggcaaaagtgttgcaattgctattaaaaataataaaaataatagttgtgcttttggcagttagtgcaggctccaaacatctttggtagtgacagaatctcaaacaactggagtcataaaaccagcaagcttttcaatatgatctgtatgtatagatgtttacgtatatgtgcatatatagtataaataaatcacaaggcttgaaataataataaagaactatgccattgagatgtcataggtttagattattttaatttaaaatagttgataaatacacgttctgatctttcaaattcagttctcatactatatcaaatgaactgactatgcattctatgaaactgcaactcataataatagtctcttaattgtcaagacatgaaattcttgcaaaaggtagtctgcgttgctaagctttgcttctgttcttactgcagccttttatttcctgaaatctcccttcagctgccatgagttatagcctatttttatactaaccttcatctagggccctgtagatccaaagcaaatcaatttctatctgccatgcttcaaccgacattttgttttggtaaaatagggccaaatgggcatcaaatacagccttgaaggggaaatggcaggttgctgtggaggcccgttcttatatgtgcacaactgcggctttgttttgagtcatccagtcccaattcattttacttgtgtgagctcttcctttcctcttcagtgggactacctcctttcaacaaacttgacaataaaacaatctcaaattgagctttcccctatttagagctttatctttacttcgctatgcaaaattttaaggatacaactacaagactccattgtttgcttgttgtggtgaaaaggatgattggttagagagctgggtcatctattttgttttttaagtgggtgcatttgtgatttcttgacaataaaggattgggccctctcagagggatgcgcatttataacttgcaggccaccactctcccactctctatgagaaacctgacaaaatgattttggtactttttcttattgagtctcaaactctcaaaatagtgttccaggatgccaatttaccaacaagtcatcaaaagcacagcaggtaaagccaatttcccatccttggactgcacgatctctaaattatcttttaggcctgacattatatgctttctggctgcaatttttgattattccgattttgattttgtaggaaaatttcagttattcttgctaatatgaatagcacgataggcaataccaaacagtaatccaaaaacaaagtttttgtatacaaaattaactggttttagtatctgcttagttcgtgtttaataggaagtaacagtgggttggaagaaacaagattttatgctaaagcaaatgtatctactaagcaagattaatatatgacttttcattttggaatatatccttctaaatctgaagactaaaacagacaattttcctgtcatgttacatgtgacagaatataatattgaaagtaaatttttccccaaatttcaatgtttataactgtataaattttgtggtagaagtatgtaaaatattatatttacttaatttcctgtaattagtgtaatctaaagattgactccaactgtgtaccccttaaggcactttcttattttgattttaaatgctacaaaccaaaatctcttctaaaaagtgacttactacttactatttgcttatataaatcattaatggtcatatataccaaaataatgaaataaaaatttgactactctttttgcattaattcattgaaattataagtatacacttatattattttctatgaaaattgaattcatgaacatgactagaacatatgatttttgctaaaattagacctcacaatgttatggtctaagaagcatccatccaggccaggcacggtggctcacacctgtaatctcatcactttggaggccgaggcaggtggatcacaacatcaggagttccagaccagcctgaccaacatggtgaaactccgtctctactaaaaacacacaaaaaaatcagctgggcttggtggcacaggcctgtaatcccacctactcaggaggctgaggcaggagaatcacttgaacccaggatgcggaagttgctgtgagccaagatcacaccactgcactccagtctgggcaacagagggagactccatctcaaaaaaaaaaaaaaaaaaaaaaatacatccttgatgctttcacatttattggaaatcagtataatctctttcatgaggcaatgcttgaaaaatatgtctcaaataattattcattattttgcatgtattggttggcttagcattaataaattaataataataaatttatttgatgatgatatgcttatcattagtacagcacttttaagcttgcactttaaatcagccttcattaactggccagttaattatatacaagaacttaccattaagttttcctttaagtttttaaagaactatgtaaaacaatttataataaattttgaatcttaagaatgttatacctagaatgcctaaaatctaaaataaggctgaaccagttataaaatgaaaataattttttcattgatttcttcactgatttttgaacttatttttaattttttatcttcaaagtttgccattatgaaacattacctcttcactcttttttctgtgtatacaatttctttacatttacttataatttatatttgatctagttttaagtacattttgaggtatgcacatagaagagttaaagtgaaataaaaatagattgtaaccatataataggaattataaattgttgatctaggaaccagaatgagacactggctacaatgtagtatttgaaattatttgatttgaccataagctttcttactgtcaaggaaaataacaaaaacatttttgtttctccagtttatggaaaggggcaatgtcatcaagtttttagatatcagaatcattctgttttcagtggccagaaatgcttttctccaaaccttcatctttctgtttattcaccggtttacatattatctactttttgaaaccttgtattatgccttcagtagggaattatcttttctctgaattataaattgataattacaaaagtttatctaccactaattgaatatctatcatgtgagaggcaaataacagacactgttttctctaatccttgcaataatcctgcgagattcatgctattttaccctctttacagatgatgaaaccgagccaagagaagccaagtgatttgcacaaggtcgcatagataataagagcagaattcttggaataccaatagtgctttgtaatttgaggatctcctcatatcgaatgttcctttctaaaacattttcatagctatataaaaaatctgtaagctttatccatccagtgcttctcaaaaagggaaaactatgtgaaacccactgacattttgaatattactgtgctttcttgcagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacggtaagtgtttataatttgtttaggttttgtaagctgatatttgcatgagaagcaaattcattaaatcttaaaagtttcaagggtcttactcattgttatttgtggttttcttgtcttgtcatatttttcttataaacatagcaacaactgaaaattgtgttaatgtatttaagtccaacattttggtataaagtcaactttaaatataaatacctgtacctacttaatgcttagtttacaaatgtttctagagagaatctgattccaatacatcttgatttttcaactaatgggaatttagtcataaaaacaacaccgtctttcttccctttcaaaaaaatgtatacctctctataatgcagaagatcatattggataaccctagaacactgaaaatttacctctttctattatttggctaaatgaaatctgaaaaatcttgcttacacccttgtgtagactttaatacctactcagtacttaactccttggagtcactaaaattatatcaccatacagttcatattatatgttgtctacagtaggaagtctcacaaaagtactaagtagtaaaaaaaaaattctttaatcttccaaggtaaaacacaaagcattgtccctaaatttatcataatttgagaataaaatgctttgtctcagtatatttactggtacttcattaacaactaaacaaaataatatttttgtttacatttattttttctgaatttatctaccttttttctaactgaccgatccccaatatcttaatctatagattccctcttatttgtggcagaaataaaatagagatgagtatgatcaaatgaggggaaatgaacagatcttgataaagaatgcctattttgaaacatgtgttttcttagaggttatgtcttgagaaggagtcttggaaaaatttcctgttcagtaggaatgggttcagtttttacagttttctgaaaagaaagtcagagaggatttcactctctgtagcataacttatttttctttgcaaataagtaaataaacatcttaaaaaatgctttcttgtcctaagctacccagcaatgtgaacgatattggagaacagttacacaagagtcgtccagaaagtgccatcaatagaattgagaacaaacaagttggcagaaatctaggaatcaacaaataagaaagagctcctgtggactctcagggagggagagcaagtggcagttacatttagccctaaatattcaatggttgcatggggttttggcagccagagtcttattaaacttggtgggtaggcttcagccaaagtctgtggcactctctggaaacacactcctttgtctccaagacggaaatccttatttttgttgcttaattcacgttattaaggggtcacagaacaaagtctaagagactgaaatgaataaaataaacaaaaaggatattaaaaataattggctcatcagttaaagtaaggattgaactcaacacaagcctgaaattccctgataggattatttagtgaacataataaactctttggaatcaacatgctgaataagactgttgattttcttacagtcagattatttgtggcctttataacttaaatggtattttctttttttacttaaatgatattcttatgacctctgatcaaacatatattgaaataataaatttaaaaacagtaactttatttaagcggggagaacaattttcagttagtactatgaaagtgatttatttatttatttatttatttatttattttttgagatggagtcttcctctgttgcccaggctggagtgcagtgtcacaatctcggctcactgcaacctccacctcctgggttcaagagagtcttctgcctcagcctcccaagtagctgggactacaggcacgtgccaacacgcctagctattgttttttttttgtatttttagtagagatggggtttcaacgtgttagccaggatggtctcgatctcctgacatcgtgatccacccacctcggcctcccaaagtgctgggatttagaacagaaaaggaacttttgattaaggcattttctcaacattaaaacaagaatattactctttcattataaatgaccatgaagaaagaaaattccttgttagtttgtttccaagtcctacatatattatagtcaggtaatttgtataaaagaagacatttttattacgggtgagataactatattttgaaaatatatactaaataaatatatagtcacagaatcatttatgcatatttgaaatttcttattcttttctcctgagtttttatttgagtaaataagatggaataattatgtaatatatgactgggtcatttgttagatctgaggtttgctttaggaattttatttttgggataaacttgctttttcacttatttagcttaataatttatgaaaaatatttctgcttctatcactaacattatctccagtaatgcccttgtttaatgaaagaaaatttccctttaatacttacaattaatcttgcaagtaaagcattggactagagtccaaaataaacatcaagctatccaaataccttgtactttgaagagggctacttgtatttacttatccattcatcagtgtcatcattttaagttcaaacattggaattgtatgtgacttttatcttggttatgaagaattgctttcattaagaaatggattaactatggatggaatctatggatggaattaggcagcttcctggggccaaatgttattgaaaatgtattttgtatagaaaaaaatatatactttttaaaaagatttagacttctatatcaagttaattagagaaacctccttttcaaaagcagttaattataattaagggcaaaatataaatgtctactttaaattccttaacaaagaaaactgatatctttgcttctaagtcaacagatgaaaagatgaaaaaaatgtggaaactttatttgaatggattgattcaagacacattttaaaatgcttgaaaataggttaggaagtgttcagcttttaaaaatatgtccttctggaaatattcattgctcacttgctcagtgcaatgcaaactatgagataaaaagtattacaaaacatagtcttagtctttaataagcttacagttaacaacagatgtgtctttcttaatagagaaaatagtggattaagtgttatgaatgatgtaaactcagttctactggtgtgtaaagaagtatttaattttggcaccagtgattgaagaaggctttatggaatgacttcactcttgattatggaagttaatagtatttcaagaggcaaaaatatgtgagaaacagcccccctaccaatagacagtgtgatcaaatattgcagcaattaagatattaaaaataatatctctgagcattttaatttgtcagacactagaatgagatatcatgtcatttgatcttctcagtagctctgtgaagtaagaactttactgtcacaattttacaaatagggagacaggaacaagtgataggtaacttgttcacaaaaaacataactaggaagtatcagatcagagatttaacgtctgacagagcctatgatcttaatcatttatcagtataaaggggttgcaataaactatcacccaagaatgtaataataagggctaatctaatagagaacatttactatatccagcctctgttctaagtgttttacatgtattatctcgtttactcctcataatagccctttgtagtagttattattttattattattatttttacaaatgaaaaagctgaagtagtgggaggtcaggtaacttccagtaagtggagaagccccaattcaaatatgaatgatctcttcctgtccttgctttcagccatgaaggtattttaacattatagatataagaataagattaatttccaacagattgtgaaataaaaagtaagtgtataaattacatagaatcattttcagtaaagtgacttcaagccctcagaattccaacatactaatgccaagggaaaatactatatgtcaattaggaaggtttacttattattgaaagcatggaaatgagaaagtcattgggacaaaacaggctgacctatctgtaacagaaatagctgccttctccttgtgggcaaaagtagaaatattgcaacctcaaataaatcatttttttgtcggattaatgcttctggcccagtaaaggtttatgcagaaatttgagaaagccacctggctttttaaggtaaactctgatggctctcaaactttgtttacctgcctggctcaataactgttcttttttctttgcaaatagaataccaaatttgagagtgcaatattcctggctgaaaatctgtagtcccgggatatcttacagctaacttttgtgatgtaatgctgtcagaaattgtaaaaggttgggaattttatcctatttgcaagctagcaagttagcctgcatcactttcatggatgctggtggaaaatactaggcttttagattgtatagagagactttattactcatggtacagcaagcagcatgaccctcatagtaatgtctgtttctgttgccctcaagttccacaaaacaatgtggagcagttcaagtgaataccctatgtgtaatgggcttgtatggcagctgagaaaccctgagcttggggaatccatgtgtcttgttccctaataagaattcctgttttcaaaatgtgtagtaacacaggagacctatggagaattgtctcccaataatgtaatagtcacattctttctacaacgttgttggctaatagtaaatttcccccgtgagattgccactcctctagttaatctgaatggtggggattgcgatcaaatccattcagtttttctcatctgtatttatttaaagagactataaacaggactttaatgagcaggattgatctcaaccatgcccaccagggtcctggacccagtcagctgaacaaatactatgaaccactgaagtttactttaaaaagccaggcggctctctccttaagtttctgcataaacctttccacttggcgagaagcattaatttagatacaaaaggatttatttgtggttacaaagattccaccattgcccataggcaaaacctatcacctataaataccctggccagtgagttgaagctgacctgaatgaattccagagctgaagtggtgccattgattgcttcagtgaaattcagggaaaaaatttataatggatgaatcccatagtaggataaactgcccacaggattcacagatattgctccatgtagctcccataaataaataaaggtagcctcactttggagagatctcattagtgtactatattatcttctgctgatctttacttaaacagttgaaaatttcttatggctaccctaatgttcaaatcatgtgtcttcagaagggtggtaatcttcatacaaaagttatagtactggaagtgggcctggtttgcctgagttggtggagggaagggttaggcccaatttcaggaacccgctgggtggaagacaaacaaatattacctcctatgtgacctcctcgccctctggtaacgccaggtgttctcaattactagaataattcagtccagttcttgtttaagagagactttgtgagagtagttgattaggtccgtcctcattgtctactccaggggtcagcaaactactgttgggcttgaaatctctttttgtaaataaaattccattggaactcagccatgttcatttatttgccttttgtttggctgcttttaagctacagtagcagagtcctgcacttgtaacaaaagcaatataacctaaataaccctgacatattattatctagccctttaaggattgtttaccaatccttgttttatgccatcagtttagtggctttattaccacccgatgtaatgagtgagaatagtggcagagaaggtatttagaggtattgacaagcattctgcataggagtggcagatgcatcctgtgctattttcagtagacttatttctaagaataaaagaatggcgatcaagtcgtgaatagagccatctggtaagaaaaggcaagtccaacagtcagtgaagtttaagacacttatcctagtttggatgttctgtaccagagagttttctttcatggagaatactccagaagtcattttgaaagacaaatatcattaacatctgtcctttccccataattgtaggggtctgtgaatgttcccttcttatttggtgctctccctctacctccagcaaattggtgtatttcatcctaataactgtgatgtcatcttttttctcaattatttcctgtttgcacatagactttttataaaaaatggtgcaagagctacaaggacatttttataaaacttacagagactgattgtgtcccccactttggcctgcatgaacaagctgtgtcctcacaaagtgctcattatccttatgatccagaatcatatcaataaaacaagaaactccaggagactgaaacataattgagtccaaatcccataagctccgtttaggcaaggctgccacacaggctgctctggggaaaaagaaagaagtgttttgcccagaaaaggtcagaatgaaattttgaaattaaaagtaggtgtaggtaatcccacacgactttcatgttgatcattgcacagaaatcacccaagatgatattatttctttcttggaacatattcataaagtgaacaagcagcctcactaaggtatatgagccaggaaaaggtgaagaagataaagctggacatcttttgaagtcaacatttgaggagattgtttcaacactcaacaacactggaagtctgttgatggtagagagcgaggaagatacgctgagttccttgactaccaggccattgttgagcatcttttgcatacatttgtcaggctgaaaatggtccagtgagctgaaaacatgacgcagattaattttaagagcttctaaagtagtgtctacatcagctgatcagactggaacaataataacacgacctaaaaaagtatctacaacactttcaggcagtcctaagaagtgatcagaggccaaaatagtcaatgtgcttgcagtgggagtggacaaccctctttggctttccctactaggatacaaggggtcaactttcagcaggaatcacaagtattgcatacagtgcaggccctggtaacagaagttatttgctttgtgtcccatctgtgaatggtagacacggtaaatggtagatcatgtcaggcagcaatggtggcaatctgtgtgtctgtctcaataatcagcttgagtccagttgatctgatcagttaatggactttcactatgggtttctccatgagtaaccctgatgtaatcttgatatacttccacaattcacagctccaaagagtggtatctttaatgttactactctgtagttctctaagtggcataccaaaccactaagctgttgacaacagatcagcagtcataatgtgtatatatacatatatacatacacacacaaacacacacacacacatatatatgtgtaccatggaggagagtattgtacagagctatgagaacaggcttcagttctgcccacttagcagagtaagcatgtccattttcagtactgcatagcaggtgctgagcttgaatgacctaagcaaactacaacgaacactttcagatttcaggtcagcaaagtcatcaccatttgtttatggaacttctgcatctcacggccctttagagtcagcacttagcttcaggaggtaaagtcttctaaaggaagaatttgattttgatgtgcatgcttgttggcccctgcacatattactagttgctgaattcgaagtgaccctcctcaagataggaatgtcaggtcattcatagatcaggctttcggtttcagttaagagtccattagaaagctaatagctgcttttcaaaatggatgtacctggtagccatatttggggagcaccaagtccataatcccaaagtgagtctctaggaggggcttcttctcttcagcagaggtcccaactggcatagtcattagtcagagtcagaaatgcccagagtccaacatagcgatagggatctctttctggggagagaagaagcatgtctctatgtgacattattcccaataaggaaaatctccttgaatatttgtgaagtaggaaattagaagcatataacacatgaattccaattatatactcaatgtaggaagcaacaacagtatattaagttggtataaaggaacccagctacatgtcacgtgcctttccctctcccactgaaacccccaccaaatagttgaatctgagcattttcccctcttcccccagggctggataggtgctatatccgacaaagccatagaagtctgagtccctcccttccccaagatttctcagaatattgatacgtgcctagggtgtttagtctctcttatggcaagaatccttcttttaaggcagctaatgccagggaaaaggggaaaggaggggaagggattgtggatccagagacctattgtacagcaataagcaaggcactttctgtttcaagtagctactatcaagttcaaccaagcaaatctggttttggtctactccaagctctatatcttcatgggtaacaccatttatttcagctcagactgattctttcactttttatttttttaactttgatagttgaaggaatatctctgtatgaatattatagaaaaaaggccttccaatatttccaagcgttgaagaatgattgtgtttgtgttaaaaccttgagtggcacttgcttcaggaaaaaaagggtgtttatttgctttctattaaggttctttaaaaattggttggaataaatgctagttgaatttatacttcatgacttgaaaagcaagctgattttcattctgccttctcaaggagtgcagtatgtttaaaatactacttttgcctgctttttgatttgctatgaaaaagataaatattttaaggacacctggaaaattttgaaatacattttatatgcatatggagattaaagctaagagactaaaaaaaagtcattctttattttggttaattttgttttgttttgtttactatggcactcagtccagtattctctctgcatagttataatgcagccttgctaatgtaaccagaataactcttcattgataatgagaaattaacagctgaaaaaaatcaataccataaataggtaatataattttaatgaaaggcgacaatctgaaggctggatattgaattagtatctggagagtgtgtgcatagatgattgggggaaggaatcctaaacatcagtcttcctcacagttacatttacatgcatgagaaacaggactcctacttacactaagattaaacctaattagtatctatgtagaaaagagtgaagatgggaaaacaaagataaatgtgaagagaaaatgactgataattagccaaaattgaattaaagacatcaattcactgagccccaagcataagtaactacaaataaataaataagcaaattaattaattaattaatcaagttgatgttggtatttgaaaaaagaaaagcttaaatagcaagaaattaaacttctacctttagaatataacaaaataagactatattaaacacaaagtgtaagaaaataaaaataaatggaaataaaacagaaaacaaaatgagaaagttaacaaagtctaaaattattaatttttaggaaatattttgataaaacactagcaagaccatttttaatttttttttaagattatacttcaagttctgggacacatgtgcagaatgtgcaggtttgttacataggtatacatgtatcatggtggtttgttgcgcccatcgacccatcatctacattaggtatttctcctaatgctatccctcccctagccctccacgccctgacaggccccggtttatgatgttcccctccttgtgtccatgtattctcattgttcaactccagcaagaccatttttaaaaaatacacacagaaaacaaaatttgccagtatcagaaattaaaaagaatacatatcctccacacacaaaaaatattctactggaaattctaacactgaaataaagcaaagaataaaacacaaagaatttgaaaaggaagaagcaaatatgtctttatttctcaatacataataatgcacatagaaaatcctatgaaatctaaaacttataatttaattagtaagcttatagcctatattcgcaagtaattgtatttctttctaatagcaataaaaaattaaacctgaaataaaacataatatcaaatacccagaaataaatctgcaaaattttgcaagacatttacgctaaaaattatgaaacattgaccaagagtatttaaagaagaactaaataatggagagatatatgttcatgattttcaaattttagtcttaagatatccatttttcataaattgatttatagatttaataatcaaaaatcttaaatttttaaattgtttttagagccttttgaagaaattgataagctgatcctaacattgtgtaaagatcttatatagccgcaacaattgaaagagcaaagaaaaagattggatgaaatattttacctgacttcaaggcttttttgatattggcataaggattgacaaatagattcatgggacataattaggagtccagaaatcaacccacaggcatagagtggggttgattgttaaccaacatgccaatcaattcagtggtgaaatgtttaagcaacattgctgaaccaattgggtccctgtatggaatcaaaacaaaaataaattttactctcatctctcactacacacaaaaattaattcaagatttatcacatactaaaactaaaaccttagaattagaactcttttagaggaaaacataagacattatcttcataacttcaggatatataaagatttcttaggtaccaaaaagaacattttggactttctcaaaattaaaacgttctgctcattaacatacaacattaagaaatagacaaactatgaactgtgcaataaattctaaaacatagatccgaaaaacgtataaatatgtgaaatatgtaaagtgttcaaagaatacacatatttaaaaactcttaaaaagcaccagtatgaaaccaaaaacaattttaaatgggtgaaagccttgtccagaccattcacataagaagatatataaatggcaaataaactgtgcaactttattagtccacagaaaaatgcaaatttaaattacaaggagatgccaatctgcatccactagattggctgaaggcaaagactgacaatccaattgcacctctgatactttgctggttggaatgtaaaacatacagccacttaggagagctgtttggcaattttttaccaagttaaatatctacttaccttgtatacctcacctatttcactccagaaaaatgagaatgtatagccacacgaattcttgtacaagaatattcatagcagcattattcctcatatccaaaactggaagcaactctaatgcccatcattttgagaatggttaaattaattttcatacagtagaatactattgagcaaaataagtaatgaactattgaaatatgaagaaacactgagttaagtgagaaaagactcacatttataaatgagtaatactgtatgattccatatattttaagtccagtaaatacaaaactaagctatcgtggtcaaaatcagacagtggtcacatctatgtgtctggggtagattgtctggaaagcgacacaaaataacttttagtggtaatggaaatatccattatcttgttttgagtgatagtaacagtggaatacaataaacaatctgttaagcatttaagatctgtttattatatgtaaattaaacttcaataaaaaattacaatatagaacaacccatcaaatatttgaagacaaaaaaggtaaaggaaaggaaaaaggaaaaaaaaacaatttacagaaatatcataattttaaactaaacacataattgaatcatgatgatttagagattactgagtcataaaaaaaaggtgagaatttaatttggtggccactgggaacccaaatttgaaagtatattagaatctctagaagagctttttagtaattggaatgcctgggcctcattccaaaaccattcaatcaaaattttgcagggtgcatagcaacatatatatatatttaaaactccacaggtgcttctgataagccagctttgttccttgatgaggcatctggaaacagcaaatttcaacaggtctcttcttccacatctttgattgacagttctgtttcccctgccagaaagactccaagcgatgcagaattcgttactttttgatgcagcttttttcatttttagacattggacatttctagttgtcaaaaagtacatatgaaactgaaaacacacacattgatcaaaatgagccattttctggaataatattaaataagtagtctgttttgcttatagtcgtttatcaataagtaaataaaatgatacctctctaaacttaccctagatgtctactgcataagcaccacaagcagtttaccatttttgaatttgatgttaatttcagatatctcacctttctaagtggctttatcccttgctattctagtttttccatctctctgtatgagaagataagacctgacatatttactgattacaaaatatgccacgtgttgtcttgttgctgtagagagatgtgagatatttacctctttttaaaatacaaagcacttgtactgtgttttctttatcataatttttgcttttcaattttatgttttaccttcattgtgttaatgatattgaccaacccttccaattttgcattgttctcaattggcttaacatgctagtcatgatttcaaccaaatgccttccaagaggaggcattgtcaaacaggtggattatggtattgaaagaggctcattaaaggcaattggcagtcgttccaggcagactcaccatcagagaggtctaagcaaagaattaagacagatatatctgacaatggctagatgccataataaaagagtcttgcaactgaaataatacagaaaccagaaagttataagaggaggtgctcgtcagaatagaaaaatagtaggtaaattgttttaatggaattattctcttttgagagtactgatgagagaaacattaaatttcagggctggaaaagctgggtagaactgatttactagaatgaagcaaacagtaaggttgataatgtgctcttcatcaaatgagctacttgagttatttaagtttccttgcctagtaacaataacaacccaatattgggatggatatattggtagatctattagaatggattcagctgtagagattggagggctacttcaatgacagggagctaaacagtttattatgataatgatgcaggtacatgaacttaatgaaaatagttattctcttaccatatcctcacctctacttctattcatgtgttggcttcattctcagtcaagttagcagactctggtgacctaaagcatatcctgacagatgattgtattaaagaaagatcatttcctgtgtgtgtgtgtgtgtgtgtgtgtgtgtgtgtgtgtgtatgatacacatagggatttttatccatacatcaaatactacatgttgtttgggtccttttccattcttaaaccaaataatttggtcaagtatatggagggctctgagttaccaccctgagttacatgatgactctttggtagaagggtgaagggtaggcatacatatacacatgtacctccttttttggtttgaaagcaatcttacttataagaaaaattaaggaaactataattgttttattataattcattattttaaaatcccttttagaacataccctttgaaagtttagtttatatttatttgtttcattttgttttggtcagctaaaaattattttatggtcttaacctttctgttatttttcttatagtttcaggatagcctttactattctgcaacaaggttggtggtaaccttatataaatctccactgtaatttgttaaactaattttgaaaatcagagacctagatatgcataataagtattgacaaaatatcttagcatggaaatggctgtatccagtatgctgggtagatatgtacactttttgttacccatatgcacaaaaacaaagaaaaaaatcaactttatggatgaatcagagggttatttatgggctccactgcatactgaaaacattgatttaatgttttcaaactagagtcagtacatagtctagtgatctaaactacttaagcaccactcttcaccgtatcactctttacttacaatttaattgccatgtgttcttttgaaatgagcattgaaggaccatcctcatgaatgcattcctaagaatcacaatgtttattctgtgtagtcttgatgtaggtttaatcaagacccttgaaatggacacattcctcttaattgattgcaaatgtttatgattacccagagagtgttttcaaatgtctgatgactataatattactgactttctctctagacagtcttaaagctgtttattgctcatttggctactttccagctttcagttgtctcatttacttccatgtgcatcaataagcatataattaatccaaacatcttattgaaccatttcctttgcattagtatatatgatgttaagtaggtaaaatttatatattctactgctttggatttattcataagtaaaatgttcttaacaaatattgatcagcatcaatgtaaagatgcctcttatactgaaatattatgatctcatgctcagatcacaagctattatcaaatagaaattcaatctcagtgatgggccactgttgccagatcgtgtcacctcagaaatctagtatagcatataattatctttattttttaaatacaaagtaaaaatgcagcacaaatgccaacaaaataataaatgactcaaattctttttgaagtgaagttttttctaagcaagattttttaaatggcttatggttaaaagttttattttctcaggaagcaagccatttataaagtatgttttgctattcacgtgttgggaaaagtctcttcagctcaatgatgtatctcatatatccagcagtatgacatactccttcctatttttaaaaaaagcccaaggtttcaaatattaattttaatgcttggcattctgccataatttcagaaacaccaagactggctgaatacagtactgaagcctttttctactccaagtgaggtcttaaaatgtattacatgattaaaaagattaaatgtgcctaatctacacagaggaggaagaaatgagtagaggaaaaaaataagacacaaaaacttagtgacatatctcttttcctattgaattcaatattttaaaagtgatatttcaaaacaataatcagactgagaattactattttatgtattccagagaatgccactaaattttgttaaattgcaactgtagtttggaaaatgagtagtattgcaggatacctctatctgtaatacagtctgtggtatcatcagatggtatagataatatactccatgagggcaagaactgttttttgttttgctcaacattctcttccaagtacctctcacagtgcttggcacatggtaagcaaagacttgaaacagatttatttgtttatgtttcttaaatttttaacattgatacatatgacatgtacatatcatattttcagggtacatatgataatttgataaattcatgtaatcaaatcagggtagttgagatatccatcaccttaaatatttatctttgcaatagcagcatttgaattattttcttttagctattttgaaatgtacaatcaattgatcttaactatagtcatcctactgatttattgaacaccaggtcttatttcttccaagggtatatttttacccattaataaacctctttccattcccttaacccctctacccttcttggcccctggtcatcaccagtctgctctctatcttcatgaatttcacttttatatgttgagaaatatctgcttagatgctgaccactggtatggaatgagcaataccgtgtcatatttctgattaaaagccttttttggggtcagtttagaaatatacattaaattctaatatttcctaggattttttcctaccctaatctactttaatataaaccattttagtagagagattaaaattaatcttactttacagatgatagtaaagtcattattttacgtgatttaataaaatgaatcattaagcttcaatcagccactacctcttggaggattgttgtgggaaactggcctaaataagtaacacaatacagatatctgagaaattgatggttgctagaatgttatagacatcaacttttagttcctatcaatattttattccattttcctattaaacaatggcagaataaaatcaagataaatgttgttattagcattatcacattaaaatatcatttcctgtttaaatgttaatttcttccactaaactggaagcacctcaaagacaggaactgagccttcatcttccttatcaaagtatcagatgtttgctttaaaaaaaaatgtattaatcaagaccctttctcttacaaatagcagaagtttacttcaaaatagcttttttaaaattgactcatgtagtttgaaagtctagggaacagctgccttgcctctgtttcactttagttactttcacactagacatgttggctcctgcaatcgcaaaactactgcattgggacaacttgtgatacacaagaaagaccacttcttctgattatccatatttcacatttcagtcttcactgtaatttgttaaactgtttctgaaaattagagacctagatatgcataataagtattgacaaaatatcttagcatggaaatgactaaatccagtatgctaggtagatatgtacacatttgttacccatattcacaaaaacaaagaaaaaatcaactttagggatgaatcagagggttatttatgggctccactgcatactgaaaacattgatttaatgttttcaaagtagagtcagtactatcccttaaaaaattacttaggccagaggacatggagagttcgaactaaccagcccaggacacatgaccatccagcaatgcaacctagagagttgggcacatgtagaaaacaagggaggcatccagatttatttcttaaatgaaaagtggcatcttgttgtttgaataaaggaaaagaaatattgggaagattaaaaataaaagacatcaactacttagccaccagtataaccctgttaacttagaactatgattctaagttaacagggttatactggtggctaagtaagaatccaaacctagttttcttacaccaaatgcagtgtgttttcccctagataaagttgttttctaaatgaaagatggaaatgttgactgcaaatgatttataaaggctttacatatcatcaaagcaccctgaaaaccaaaacagtaacttttgacttgataaatgtaaggaaacattcaggatgaactctgtcctgtgccaccaaaatcccccttcaaaactgaagactgtcttctcccaaatgctgagagggcttgccgctgactaccttccttatgaattaccctccgcttaggggaaccacctcaccaaaggacacacaggggtgtaaaattcctccttccaccagcgctaacttgggataactctgaagaccatcccacttccagagctccctgcaggtcttcgctgagactgcatcgtagcctccctctgctggctctttcttgttcccttcccttggggcacagtgttattcccgagagcagtccctgatagcctctctagtctccaatctctaccccagagtcggcttcctgggaacctaaccttctacagttaatctgcttttcttaggcctgaaggacaattaaatagtaactaaaacaatgaaaggttttcaagggaaagtatttatgtgtttgctatctttttatctaaaattttcctctatttttaaacaaaacctcacattactttttagcatggaaatgtttataccttaccctcttatacagtctggataagaaaaaaaatcactaacatcagggacgatatgcttatccaggttctccaataactacttttaagggaggcaagcagagttgactaagagattataatcttggcagtgtgcagaatgttttcagtatgtgcatttactgagaggagagagaattcataatctttgattttctcaaaagagtctgtaacacaaagaaggttaagaaattggagcactggttcccaaatagtctcttaagaagcatcaagtgagagaaaatcccttgttttttttttttgtttgtttttttcctgagcgtttctgatcccatagaaatgggattgagcaaaaatcttcatttttttttttttttaagtttcagcttttactttaggtacaaggggagtgtgtgtaggtatgttacatgggtatattgcacccaggaagtaagcatagtacccaattcatttttcagcccccaactttctctccccggctagtagtctttggtgtctattgttcccatgtttatctccaagtgtagtgtaatgtttagcttccgcttattagtgagaacaagtggtatttggacaagttttccagatgactccaaaataaaactcagtggattacaatttggaaaaatacagacttatggatgaaaatatagttctatgttagtttctattgctggtgtatcaaattaccacaaatttagaggcttaaacaacacaagttattaatagtattttttattttattatgattatactttaagttttagggtacatgtgcacaatgtgcaggttagttacatatgtatacacgtgccatgctggtgtgctgcacccattaactcgtcatttagcattaggtatatctcctaatgctatccctccccactccccccaccccacaacagtccccagagtgtgatatttcccttcctgtgtccatgtgttctcattgttcaattcccacctatgagtgagaacatgcggtgtttggttttttgtccttgcaatagtttactgagaatgatgatttccaatttcatccatgtccctacagaggacatgaactcttcattttttatggctgcatagtattccgtggtgtatatgtgtcacattttcttaatccagtctatcattgttggacatttgggttggttccaagtctttgctattgtgaatagtgccgtgataaacatacgtgtgcatgtgtctttatagctacatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccatttttgatggcgttgtttgtttttttcttgtaaatttgtttgagttcattgtagattctgcatattagccctttgtcagatgagtaggttgcgaaaattttctcccattttgtaggttgcctgttcactctgatggtagtttcttttgttgtgcagaagctctttagtttacttagaccccatttgtcaattttggcttttgttgccattgcttttggtgttttagacatgaagtccttgcccatgcctatgtcctgaacggtaatgcctaggttttcttctagggtttttatggttttaggtctaacgtttaagtctttaatccatcttgaattaatttttgtataaggtgtaaggaagggatccagtttcagctttctacatatggctagccagtattttttagatcacaagtctgaaatggaatctcagtgggctataatcagtgtcagcaatgctgtgttctctggtggctctagggaagagtcaatttccttgccttttccaccttctagaaacaacccacctttcttcactcaagatctctttcccccatcttcaaagccagcagtctttcatctctctgaagatgctgagtctcaacacattcttcaggagttagacctccctttgatgctcctgttctgtctccctcttccaattttaaagactgtgattacactagagccacccaaataatatgggataatctccctattttaagatcagacaattaacagctttaattctatctgcagccttaatttgtctttgttgtgtaatctagtatattcacagattacagggattaacatgtgagcattttggggagaccaatattctgcctaccacaagttcctttatagtgtcatggaaaaaacatcttcctcctcccccagtcttatgtttaataactcaattaatgagccttccaccacctgttgttatgtaattatctggtcagtagaagaaattactggaaactacagaaacttcttttagctttctgttatccataaatagcacctagtcacacccactcacctggaagcaccttgaggtcaggaaccatatattctttattttggaaacacagataactcatctcattggctgccagctaatcagcatacagataatgtggctgaatgattgtgatgtgtgatgatgtttgtgttcattgaacaaaaccaaaggcttactctcttttattttttatttttttgacatggagtccccctctgttgcccaggctggaatgcagtggtgccatctcggctcactgcaacctccgcctcctgggttcaagcgattctcctgtttcagcctcctaagtagctgggacgacgagcatgcaccaccacacccagctaattttttgtatttttagccaggctggtctgaaactcctgacctcaggcaatccacctgccttggcctcccaaagtgctgggattacaggcatgagccactgcacccagagtactctcttttttaatgactcttacacacagcagctcataaagagcatggctctgaatcttctctcattgaacttaccagttgccacatatcatgggtatttggtgtcatttcctcaaataagcaaaactatttatgcttaactcctgcattccatgagtctgccttgtaatttatgcttgccattttgggtagctagccatcagtaaaatttaggcaatctggcctgttggtgggaagagtggtggtctcttaacaaatagtcatgttctttactaacaataaaggaattacaatatgttagaccctacactagattttgtatatacacagcaaacacacatagacacttttgcaaaatcaatctttgaagacttctataagataaatatttttttctgggagtggtggcttatgcctgtaatccaagcactttgggaggccgaggcaggtggatcgcctgagctcagcagttcaaatcagcctggccaacatggcaaaaccctgtctctaccgaaaatacaaaagttagcctggcatggaggtgtgcacctgcagtctcagctgctcaggaggctgaggtgggaggatcgcttaagcctgggaggtggaggttgcaatgagctgatgtcatgccactacactccaacctgggtaatagagtgggaccctgtctcaaaaataaatataaacaaataaattcttcatttacagttgaggagaaattttcaaaaaatgttacagtcacatatctaagaagtgacaaccaggattccagtgttaggaaacagaggggttatagtggtcttttgtcacatcacttttcagtatgcatatcactctgatcaaaaattaaagctaaaaaacgttatatagtttcaaattaaggataattaatttactagatcaatttatttattaaaaaaattttttttgagggggcatctcactctgtcacccatgttggagtgcagtgacacaatctcagctcactgcaacctccacttcccaggttcaagcgattttcttgcctcagcctgggtatgtatttttagtagagacgaggtttaccatgttggccaggctggtctcgaactcctggcctcaagtaattcacccacctcagcctcccaaagtgctggggtttcagacatgagccagcacgcccagccccaatttaaaacatgcaatcaaacacgtcacttccagacttaaactgcttttcattctgctcacatatccagtcatccacttaaggcagatcctctacttgaaactttcaatagattaaagctgtattttgaataaaattaaaacctcttcctgtgtctcacagagatctacataacctgactcttcctctccatccagcttcatgtctcactagctaggctgcaaccacagtggtctcctatagatttttgatccacaggctctttaatgtcctggacattttctgagctgttgccttttctccttatctatttgcttggataatgtcttcttatactttacctcagagtttaaatactagttttgcagagaaaccttcctctaagtaaaatatatcctcctcctcaccctattatcatctaccaatgcattcattgttttcttccaaacacttagtgtgctttgtggttttagtttgtttacttgtttattgtctgttttaatgtttgaatgggtattcattgatgtgctcctagctcctagtattgtgtctaatattcaacaaatgtttttggagaacaagttttttctcaaagtgaaaatgtaaactagtactggtattttatttttgtaatcagaagatttcacagagaataagtaatctgaaactttattctctagtcatgctctgttttctgagcatcttggatctatttcagtgttacttttgttttgtttgccttgtattcagatgtacaatttaagtaactcaaataaagaacaacttacaatttgaaatcaataatctgctctgtctgctctgacatgtattttttttttctttttttttttttgagatggagtctcactctgtcacccaggctggagtgcagtggcatgatctcggttcactgcaacctccacctcccgggttcaagcgattcttctgcctcagcctcccaagtggctgggactacaggcgtgtgccaccacgcctgactaattttcgtatttttagtagagatggggtttcaccatattggccaggctggtctcaagctcctgacctcatgatctgcccccctcggtctcccaaagtcctgggattacaggtgtgagccaccacactgggcctctgacatgtattctaaaggtatattggttctggggtgaggcccaagcttgtgtatttttgataagtttctcagatgattctgattcacatcaaagtttaagaacatctgcttagtatgtacatagtcttgttattgtacctctaccagtgtcaaccaaagtccatcaaatttaaccctttgcttaattcatggttcagagtcttacacctttatgtacattctgacttggatattgaatgaatacataacacctttattattccacctcttttatctcatcctctgccctagctgaggattttattcttttaacctgctttgatggtaacatcctgagtttaccacataattaatgataagaaatgtaagatagaatttatacagtatatatgttgtaaagatttttaaagtcatcagataagtaaacatataatatttacaactattttgaaatgaaagaattcagaagaagaaagcaaaattgttgttttagtcaatttgtaaccttgcaaatgtaaatgtttataagagtaaatgtagtttctaaatttttggctatttgttttcctgttctgtggttttacttactgctttttctggtttgtatgttgaaaaatacataaattaactattaccactgagaggcaaattttacttgcagggaagcacacactattaaggattttgagatctagtctattcataagttccctacaatcccatttacttgtttctctagtatttgccctttaaatattttattctttggatatataatgaaaaatatagttcatgatatagtaaaagaaaatctactatattaagattatagcataatctatattaagcttgtattgtgccagatacttatttcagatatcttcttctataaacaagcaatctgatactaagaagaaatatttgtgatatttcagacatttattgttacttaaatacacatcaaagtacaaatgataaactctttagattgaattttacttttcttatttaagtgtgacgtggacactggacattttaatttgataaatttctagaactttgcttattttggaataagtatgtaaatattttgctgatcatcatgcaatcaaaaatgttacttaatattttctaaaatgctgaaatatgttttgaaaaaatatgttttgcacattaagtattttctccttactaaggcaaacttggtatctcctaccaacttttccaaatttagctaaggaggtaatactaattaaatagattaaaatgcagcttttatttgtggtctaagttacctgaggccctttgaagataaccttttgaaactttctgtttaactgataaaagtcaagtttagtgatactgttgcctattttaagaaacattcataatcttgattcagattcatcagtcatcaatgatattcatgcttacatgaggttaatattactctttaaaatgctaaggaaaatagggaatgtctttcccttcttcttgttttgctctagagaaatggggcatctctccaaccatctccgtgcaccctcacccaacatttctaggattgacatcatttaggttccatgtagatagaaagaaatccatttaaaaaataacaattcctacatttttcatgtgaacatttcaaaatgtaccaaaccttaaacatacttgagagttccgtcagctactcagttggtaattttagacagcctacagtgtggaacaataatctattctgatataggtgaaatagcttatgccttccttctgtacaataattcacaggtattttgatgggcttttgatgtttccagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggtaagtgaaaattgtcttggggtgagagttgtacaaaacaattaaaagctttggaatagaccctacagaggagatgaaaattaagagcagtgcgagggaattaactacacaattcttgttaacactaatggaggtagcatagtgaatgcctcacttatctcatttaccccttactgtccagttagttgctgagagtatttgtgtttatatatatttaggcacatagacagaacaattttaagaagtcttatagaagtttaaaagtgctgttgacctgaatgaatctggcaagatcaagaataaattcacaagtgcacagctctctaactaatccttagtaatttttgtaagttaaaattttacttctgaaaaaataattacttgaatcaggacattattgcctaaacatgattactgttacaaaacatatacagatttatatcttctctgtgaactttgtaccaacacaaataattaagtgtctgaaactctgtaaagtgatgactagtgtacattttatgatgctgcatcctcaaatttttaattgtatctgttcatttagttagaagctctgaaacttagtaaaaatacaattaagactttctagtgataggtataacatctctatgttctaaaatgcctgctattgccttgtaaaagtttattgtcatgtctttttgccccacttcaagtttttaatgttacatagtgatagaactgttcatgactttacaaactttcacatggaatttttaaaaatattttaaatttgaggacgggaatttatttgtttaatactttttttttttttttgcctcatttcactattatgcttctgttagctcctgaagtactgctataaagattccaaattaggaacatgttagaagttctttgacactcacaatatagttggtatcaaaaaacataaggcagaatataaatcactaggaagggtaaaacttgtggaaaactgtcagtaatataaaatttttcattttaataggaaacttcattatgcagtttaaagacaaattatacacattttactttttgagttcagcaaatgacttagagaatcttattgaactactacattttttcataatataaaatatttccaattttaaagaagttgggtctttccttcaagaaacacaaatctggaagatgggagtgagtacacagaggatgtaatataaattaggatgttaaaattgcaatagaggcggttgaagcatctatggtcatttttgttggaggagatcagagaaaacctcactgagcaggtatatttgaactggacttcgtgtcatgggttaggaatttataaaacagaagtggtaatgatatggtttcgctctgtgcctccacccaaatctcatcttgaatggtaattcccacgtgttgagggagggacctggtgggaggtgagtggatcatgggggcggtttcccccatgctgttctcatgatagtgagggagttctcatgagatctgattgtttaaatgtggcagtttctgctgcgctctgactctctcctgcctccttgtgaagaaggtgcttgcttctccttccaccatgactgtaagtttcctgaagcctcctcagccatgtggaactgtgagaaaattaaactgttttcatttataaatgacccatcttgggtagttcattatagcagagataatgctagtgtattcctttgctagagctgccattggcttaaacaacagaaagtttgcatctcacagttctggaggctagaaatctaaaatcaagatgttggcaaggttgattccttctgaggggtgtgagggaaggaactgttctaagcctccctccttggcttgtagatgaattctttttccaatgtctattcacattttcttctcttcgtgtttgtttgtgtatccaaatttcctttttctataaggacatcagtcgtttggatgagggttcaccctaatgacctaattttaatttgattacctctgtaaagaccttatctccaataaggtcatattctaaggtaccggatattaggaattcaacatataaatttgagaaggaggtagtgatggcacaactttacccataacagttaccattagctgttatgagcaaataaggcagaggagtatgtttgagagttcaatttggatcctgtaaaatttgagctagcagtggattcttcaggtggtcttaactatgttttaacacctttatagtacttactatcttcttactacttactgctttcttttctaacacctttttaaaaaatgaactcatataatcttcataaaaagcctttgagttggtactaacatcatccttgttttgtagataagaaaactgaggtgtacagggtttaagttgtcaagatgacacaactaggaagaggcagatctgggattaattccaataagtttgtctctagagtttgtgcacttaaccttggttcccagacaggttggttataaatgcatgactggagaccaggaaaaagatcagtgctcgagatgtagtttatttgtttttcatcagtttaatatgcattgatttactagttcactggttttccagttcatcgtagaaactatgctaggcactagcgatacaatgacaacaaagatcccattccttttctcaagtttatagcctggtgttggagaaggaaaatgaaagagtatcagcattacaagatgcatgtaatggcagaacacatacatctacgctgatctccagagccagccatgtctggttgtagaggtaaagtatacagtcatgaaatgttgaggaaggagcttgttatagatggtatcttgaaggaggtgcttcttgagttgagcgttaaaggacatgtggattggatcaggcagaaaagggtgggaagaacattctaagcagcaggaagaccataaataaaaccacggaggcggggcatgcagcaagaaggcaaagggctagggaaggaatgggtagaggtgggtgtgttgaccaccctgttgagacgtttggtgacgaaagtaagggtaaattatggtttaaaatttttaaaaatcccatgagactgatatcagaaccagggatatctgtttcatttttaggataaaacaagctgagccttttcacacaggtgttgggaaagcaaccagtgatgaagaggagattgtagaatggaaaaagaatattgatgagctaagaccccagagtgttagaattcatgaagctctgccaggggactactactcattaccaataacctacaattgttgcttcaaaggtagacagaattagttcagacttcattaaaggaattttcattgataatccttgtctttctgataatcaatttcaactgatatgatcttaacttctcaccttgtcccccaaccttgaccctgaactttatacttataataatgtatcccttccatcttggtccccaaacacataaaatctattatctttccttaaagacttttctgtctttccccactcatccaccatttttttaagtaacttatcttttataatcactgattttatgtctccaaactgtggaccagttattccacaggcatcttaagcaatgatgtaggaatggcagacagaatgtgaactaccaccacctctatcctagcctaagctcaccctattgtactgttctctgacctgcaagatggttcctgtttctcaattagttgttctcagacacatcccacctcctcgatgggttctaggattgtttcttttgagtagggaataggctgaccctattagtgctgggagcagttcattcaaaagacaggcagaactaaatttgaaagagtacactgaaattctgaagacacaaagagaaattatttctgtgtgacctagagtttcactcagtctagtggaagaggcagcatataattaaatattactatgtgaaagaaaattctataataatgatggatcaatgatgttctggaataccgtaggagaactgactcatgctacagagagcttagccagagtcagaacaaatttcacagataagttgtgtcaccagactcttgaaaaataaataagaattaatcaggtaaacagtggtgggcaaacaattcagaatgtgtctgtgtgtgcttgtgtgtgtgtgtgtgtgtgtgtgtgtgtgtatgatatatgaacagaattaaaaaatcaaattctactgaggcttttaaaattacaaaacaagagtctatttatttctacctccagttattcttttcagaagtatttattttttattttaaaatttaatttgtatttacttttagcatatcctgtgtatttgcattgttcaaaatttaaaaggttcaacaaggtaatatcctgccactgttcctcaaacacctgagttccttttcatgaggcaaatagtgtttcttatgtggcattccaagtatatacagacacacacacacacacacacatttttattatttttcttacataaatagttatgtactatgtttaaattctgagcttggaattttaaacttagtaacttctagatcattctattgagacatacgatgtgttcctaataatatctaatggttatataatattcccttggtaaatgtattagtccattctcatgctgctgataaggccatacctgagactgggtaatttataaagaaaaagaggtttaatggactcacagttccacaggactggggaggcctcagaatcatggtggaaggtgaaaggtatgtcttacatggtggcaggcaagagagaatgagagccaatccaaaggggaaaccccttataaaaccaacagatcttataagacttattcactaccaagagaacagtatgagggaaactgctcccatgattcaattacctcccccaggtccctcctacaacacatgggaactacaggagctacagtttaagatgagatttgggtggggacaaagccaaccatatcagtagattaaatgactcttagctctttaacttttttgttttaatttttacttactctagtaaatattactggttgatttattagtttgtcatctcttacctaccttttcttatataataagtgatgatttacttcatgtccttcacctacacctgcacatcctctcaatatattactagttatagcacaattttaaataactttatataacacagttacacttctatttccataccaactactgttgacagtatagtaattgtaaagacaatatactagttgtaaaagttcgttcactatttttccactcttctacctctcagcttccatgtcccacagatttacttttatattgagtgtgttggaagcacgtattttctattctgttactagaaataaattattcatgcttgactaaaagttggctttataagatgaaaatctgtaatttgcttatgttttatcactataaatattgttcactgtacaacaaagtattaagatatgattatatttagttttttatcactcagcttcaggtttcttgtttgaattattacttttcttacttttttcttcatctttgggtatgaaaattctaaattgctgttttcaataacaaatctccaaaatccccatttcctgactgcaccctttcctcccagagaccccctttcctgctctgtttctggtgcatccttaaaatcagataaattctagtgggtcagatccacaaattcctggttcctgtgtcttaacaatttcttagtttccggccttgctgggaaatatcttgaagtaacttctgaaggaagagggttttttttttttcttacagagaaaacatctgtgttagataagctgtgtagaggcaagagttatagtgctgttggccacaagttcaatgataatgaatcaacaatgaatattaaataaagtgcctttaaatagaaatgcataaaaccagaggctggcagggaccaaactctgtatttcccctaggagcagtgattcaatattcacaaatgcagtgttcataggaattttatagaacctaactactgtgaatgacaagcatccacaatcattgttattatattcacttatgaaaatgtattcattctaacttcatccttgatgaataatgtggctaattgtaaatttctaagttaaaaaattatttacctcagaacatcaatagcattaatttattacataatggtaatttgatcatttagattgagtagatagaagatggatatggttattttactggaggtagtgctagcttttgcatgtgtatttatgttgccttgctcttggataataatggcgacattagttgccccaattcacctagaaaattcacctatttatttagaagagaatcctatgcttcttactttttttttcaagggataaatatcagctttcaggaacattttgcatgtgacagcatgtgagaatcaacatacatttacgtacaatcagtctgctttattaactgattttgttttttgcaaattcacctattcattaagctttatttgtaattccaaaatcaatactcagtgcactttcatgatcatatatttgcatagctcaaaaacttgagttgttagtaattaaggtcaaataaagctgctctctgcattcttgttttagctcctctatgacaagcaagtgttcttttctctatctatttatttagtgcctttttcaattttttgtgctttcatcagtgatttccctgtttaaaatatctcccaaacatagtgctaaagtgctggtctagtgtccctaagcacaagaaagctgtgatgtgcatcacacagaaaatacttgtgttagataagctatgtataggcaagagttatagtgctgttggccacgagttcaatgttaaagaatcagcaatgcatattaaataaagtgcttttaaatataaatacaaaaaaggcagaggcttacaaagaaccaaaccattcccctagaagcaatgattcagtattcataaacacagcattcataggattttatagaacctcgctactgtgaatgacaagaatcctctatgttcccatattttgagctctccatctcacacctaccttttatttggccttttcaactatcaagacttctatgactctgcaggtagaggtcttgatgcttaattgctgcccttatgacagtctgtagtctacggcttctgccaccctgcttcaccagatatcattgctacctctgatcaagcgtcactgcttcatttttatttttcagtaatttaggcaaaacacttttctgatggcctctgttccttttctcatggttgttggctcatatacgtattcaattcttcatattttcatgagactctgggagtcatctcctttaactttcttgagttgaaaggtccagaatattctttcagatttttagagattaaagctcaacaatgataagggacgtttaagaccagtttttatagattttatgaaacaatattaaatcatggcatttcagatttgaaaaatataatatgtaatattttgttgaattccaaatatatagttgaataaattaaaggcctctctagatctaactcacattcttctctaacttcctccagctatgttctgcacctctgcagattgtagaggacacccagagtttgaaactggtcaaataggttgttagcaggtcaaaggggtgcagaatttttgcatctgaaaagaatttattgaaaacggcttaccatggattatatgatagaaaggcaaatgaagctggaaagaaactgatggattgagaaattaggaaagacagagaaactaaaggttatgatgaggtcagagacacaaccaagttcagcaagtgccttaaacagagagaagttgaggggagaaattctggtaaaaggggaatagcagaactttcaaccctactgttttctatactttataagttagcatgcaaagttattgaaatattcaagagaaatattaactttaaagtcagaagaatgagttttatcaaagaaattgctcacttagcattgtcatgtaattgctaaggggaaaaataagcatatcaattctgtttgcatctttttcttttttttctgtccctggagaaattatgtagcattgagttaattatgctccctttgaagtcttagaaatttaatacattaaatgtctacacttagtgctccacctctcattcaagagtatcaaagctttaagaaaaatactgcagttatgtgcagctgagtatataaacctgctgtgatattggcagaaaattgttacacaatatatctgtaagtgtccttgaaatgaatatagtgaaacagcagtgctcacttggttttatttaaatatagattggaatgatattttgaaaaaaatgtttttatataggaataatgttgcatttgttgctgtgtacattatagtctttccagaaacaatacaaaaaaattctatataaattagacattttggccatggtctttagtgtttgggtttgagaagatacgccaattctttgaaaggaggaagttttactatttatacagcaatagatattgtctccaatttacattttttcttcaaattttcagaaaggaaccctactgttccatgacatccttttatttcacagtaagaaaaggttattattatcttgtattccttaaacatactttatgaaatagttttcattgtattgtactataccctaggttcattgaaaaaaagaactttgaggctgtcaaacaacaaaaaggcaaagttacatatttcaaatatgtatgcagcttcccaaaaataagcctttggaaagatttaggaaacaagggaaggtagcttatctcagtagatacagaatgactcccactcatcaaaagggtgcccttttaagaagtgtctgttcatagcctttacccactttttgatggggttgtttttttcttgtaaatttggtcaagttccttgtagattctgggtattagaactttgtcagatggacagatcgcaaaaatgttctcccattctgtagctcatcatcactggtcgtaagagaaatgcaaattgaaaccacagtgtgataccatctcatgccagttagaatggcgatcattaaaaggcaggaaacaacagatgctggagaggatgtggagaaataggaacacttttacactgtttgtgggagtgtaaattagttcaaccattgtggaagacagtgtggtgattcctcaaggatctagaaccagaaataccatttgacccagcaatcccattattgagtgtatacccaaaggattataaatcatcctactataatgacacatgcacacggatgtttcttgcagcactattcacaatagcaaagacttagaaccaacccacatgcccatcaatgatagactggataaagaaagtgtggcacatatacaccatggaatactatgcagccataaaaaagaatgaattcatgccctttgcagcgagatggatgaaaccagaaaccatcattctcagcaaactaacacaggaacagaaaaccaaataccccatgttctcactcataagtgggagttgaataatgagcacacatgggcacagggaggggagcatcacacacttgggcctgtcagggagtgaggagcaaggggagggagagcattaggacaaatacctaatgcatgcagagcttaaaacatagatgatggggactgggcgcggtggctcaggcctgtaatcccagcactttgggaggctgaggcgggtggatcatgaggtcagtagatcgagaccatcctggctaacatggtgaaaccccatctctactaaaaacacaaaaaattagccgggcatggtggcgggcacctgtagtcccagctactcaggaggctgaggcaagagaatggtgtgaacccgggaggtggagcttgtagtgagccgagattgcgccactgcactccagcctgggcgacagtgcgagactctgtctcaaaaaatataaataaaataaattaaaataaatttaaaaacctagatgatgggttgataagtgcagcaaaccaccatggcacatatatacctctgtaacaaacctgcacgttctgcacatgtatcccagaacttaaagtataataataataaaaagggtgccctgagtactcaaattgctgtgatagttatttaaatgacacatttttttctaaaataaattatttggagacattatacaatgcacaattttaaagatgaagcaattataatatagtgcatataagtttacaactcaacaaatttccgtgtgaccatcatccagatcaagaaacagaacataactagcatgcccagatttctcattcatgcacgctccagttaagatctccccaaaggtatcctgacttttaacactattcaactagttctgattaattttaaactgtatataaatagaatcatacggtgtgtactgttttgtctttctttcgttcagcattatatctgtgagattcatccatgttgaagtttgtagaaaaaattcattcattttgattgcctcaaaatattttgttatatgaataagacagaatttatatacttctgttgatgatttttttacagttttgctcattacagataggggttctatatacatctttttggatatgtctgtagttttgttgagtatatacttaggaatgaaattgctagctcaaggagtacgcataaggcatgttacatattaatgctagctgatgctgccagtttcccaaagtgtttataccaattttactatttgaagtagtaactgaaagcattccaattttccgtttcttcaccaacacttgttattttctgtcgtcatcattttattttaactgctggacatatattagattcagattttaatttgcatttttctgatggatgatttattttgtatatttatttgcttcgaggatatttttcttttatggagtgcctgttgaagttatagtccccccttctttcccctcatgatttgtagaagccctttgaatataatggataaaagtctcttgtcaagtgaatgtattttgaaaatcttctcttctgtctgtcttttcaccctgtaaatagtgatgaacagaagttcttatttgtaatgtagtccaaattattacattttttgtagttagtactttttgtcttttttaaaagaatgcttcttactccaaaatcatgaagatctacatacaaggtttttctagaaacttgttttatcatttacatttaaatctgaagttcatctgaaattaattgttttgcataatgtaaagtggaggtaaagatacattttattttccatatggtgaacacttcattttaacacaagatcagtgtgtctaaatggaaagaataatagaagcttccaatacccattaataaagtgggagttgattagtgtatttgaaagtattatctctgtactgcatcctattgctatgacctatatattattttctaatatgaagcacatgactttagaagaaaaggaaaggttatactggtgaattaattgaaataagaatcttcctgtgatcccaggatcacaaaagttcgtgatgctggattctatggtaaaagttgtaactctttccatgggcccaatagttatgggtcatcaagtagcagatagtggccaatcactcaaaaacaaactgctccatataaatatagtttttacaattgcatggaattgtaagaaaaaaaataactggcttaaaaaaaaacaaatctctaacaggcactgattcatccctgatttagtttatatttccttgtatcgtatttatcaattattattaaactgctctcaaatctgagttttaactttagctttataagcttgtattgaaaggcagctctgttactagtcaatccacagatgtgggttttttttttttttttttttttgatgagaaagtcttaaatttattttactttgcgtttgacctaaattgtatatgatagttcttgcttctgttaatgaggcctgagacagcatcaagtttttcttttctgattggagagctgtttaacttgcagaaggtttctctgaacatggaaactaagcaaagaacgggtttccaatgagtctaaacttccaaataaaacagacccaaattaccgctcttgtgaccactgacttgggacactgatattggtggacagtttgctactaacttctcctaacagcctatagtctatttaataatttttgactgcaacatctactgctggtttttactttatactaagttcttaaataagtcaatcatttttattccattccatttgaattattatccaagcaataatttgaataattgtggaaaaacaagaaaatatctgaatatttgtgacaattgtaccattattttaaatataaaatcacagttgcttcaaccttcaagacaagaaaattgaaatccttctctaatccatttttcacttattcaattattcaaacaatatatttaaagctattctatgcaagtcagtgtgggaagagctgtaagaatacaataatgaatggtatatgattccataccccaagggatatagactcataaggaaaatgctgtaaacacgaagtgtgcaaaataataaaaccataagaacagacacagttaaattactcctctctactcctaaagggacttgagaataaagaaaacaaagttgctacctgaaacctaatcaaataaagtctattggcaatgtatgagttacacatccctaggttattcatatcaaaactttattgttctgctgtaagtgagaattcttgaccatttcaaaaattcttaccataacctgctgtagtcttctcaaagcaagtctagaatgtaaatgaatccaaaaataattaaatttttattgagttttccctccatgaaattatacaggtgattcaaaaacaaacggagtagttagactggacctaatgataaatttgaggttgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataaaaaaaaaagaaaaaaaaaaaagataaatttgaaaatgggaatttggcagtgtttgtctattgctgcttagagaagacaccagtcatggaaggcaaggacaggctaacatatgaaggtattctctgtggtatgtcaggcacaattcatcagatttaattaaaatgattttcaaaattatgcacctctttgagctctgctcctactctatgacataagaagccaggagaatagtgagctcatgcattctaagcactagagagatgtatttattgcaaataaataaattagcaatttatatgctgatttctatttaatttgcttagtacataaatggcaaatacatgctacaagtgctattaattccatttccagaccaaaaccatagattaccactatctgccctgctgtactgagcagctatagcaaatggatcttagttagcactggagtccgaacctatttgccaatctgggttagtatgagtcagtctcccagaacttaatcaattccttaaatacttactgacaaaatcaatattttagttttgtagagaaccagattttacggtaatgccaccccatgaagctttgttgaaaaattagatagtctctctagattacaattctatccagactttttctcactataatacaaataggagggaaaaaactgtcttgacagagcaaattaaggtcaatttgcttttcctaacaaaacccattgttattagaatgaaaaaaataccctgtagcatataagaaggttaaaaaattaaacttatatgtgtctatccaatagtaaaatttcatgaacatagaggtcctttaatgttctggctaattaaatttttagtgccttgtagactataccaaaatttctttttggtttctacttgtagaaaagtgttagaaatactttagtctgggtttttttgttttgttttgttttttgaggtaagagctagagtatagccaagatacctaaatctttcacattgatatatcagtatgttgctggatattcagattatcaatgcttattacattaaaattcacgttagacctgggtcctgaaatcatatttcacttttttcatatgtcttttttagtaagctatctgagatcctccttataaagttaaatataaatgtacccatgtctatgcaaagttttgcatattggcatgaaagagtatatatatgaaaacatacatttatacacaaataaatgtagaagttttgaaaaagcaaattcattaactctgattctctgatatatatacataatatttatatatgttataaaataatatctgctattcagtattttattctgttaaaactaaaagctattaattgatggctagttgaaacataataagttgttacttccaatattgcttgatcaaactcaagtcagattattagccctctctaatcggccaaaaacttcactttgaaagatatcatgagaaacttgcaaaagtaaattgccatttaaaatttattgtgtagaaattacttttttttaaccgtgattcttgttttgttccttaatagcctaaatatcctgtaaagaacactggtattaaatgtaagaagtaggtgaacactttaattttgaaaaattattgtaatgaataagcaaatccttattaaaaaggaaaagtgaaagatgaagggtgggtttagaactgaccagaattcttaagtttaatatccataaattcttacatataggattgatatccagcaggtgtgcacctataaagctctcttcactgcttatgacaggcatcctttctcatggaagatgtcctatttgattgctgagtggctgttttacagagttttaaaaatattttgaataacattcccaatcacatgagtcctctaggaatgtagaattgtgagacgtacatctactgatccaagtaggtaacttcttcaatccacatctcttcatatatcattctgtttttagtcttcttagtgaataaaaataatgtcaattttaaatgtttaatacctaataaatatttgcattttaaatttcactcactattatttaattagcattagtatattatagttagactacatgttctctaatttggaaatgtttccagtgataatttttaattttttttcaaattgccagttttaatgaggggaaaaacctaactttctctttattttgtttatatattcataatagtctacagagttcaaaagaaggcataattggcataatactttagagataaacaaaaatgtgtttacctaaaacaaagtttcttgggcttggcactattgacaatttgaaccagataatttttgttgtgggcagatgtcctgtgcattataacatgtttagcagcatctgcctgtacctagtagatgtcaataatacctaccccagctgtggtagaagataaaattatccctggttgacagtcattgataactatttaattctttttttttttttttttttttttttttttttgagacggagtctcgctctgtcacccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccagataactatttaattctgaaacagtaaatttttgttctcatgaagtttttattgctgtcctatgataattacttttcactttaccactaataatagctagctagcatttattaggttctttcagttgtgtgacactgctaatcactctgtaagttaacacttataatcctcaaaaaacccaatggcatagatagaacagtatcttaatttcacaaataaaaattttgtaaaatgatgtataagcatttgtctatcttaattaggtagatcgtttgcattttattttttgtttgcttagtgatcacttgcgaagttattatactattttttaacatgttcatcatgaaatgcattttttttggagttacttggtttccaagtgacatttaactccctaaaatagcatttaatcagtaagtttgtgttgtggtctttgaacatgccatctgagggacaagagtgtgctagattgccttttgacttacgatttttagaacaaaataaatgaaaaagaaaaagaaatgaacatatacataaactgagaagcataactaattgacagcaagaaatgacttgattctcaacactgtaaagtagttgctaaaggcagtagctaatatttattgtgttttccttacgtgccagacactgctgtatgtgtattttacatatgtacacatgtatttatcacactaaacctaggggatagatgcaagtttagcctcattttacagctgaggagattgatacacagaggttgtaaaagtagtttcaggtcacacagtgagtaatagcaaaaccaagtttagattactagtacggagtgtgctaggctgggcatggtggctcatgcctgtaattctagttcttgggaggctgaggcaggaggatcaattgaggttgggagtttgaactcagcctgggcaattgaagccagcctgggcaacatagggagaccctatctctacaaaaaaattaaaagttataatagctgggtatggtggtacatgcctgtagtcctagctactctggaggctgatgtgggaggatagtttgatccccagggttcaaggttatagtgagctatgattgagccactgcactccagcttgggcagcagagtaagaccttgtcccccgcaacaaaaaaaaaaaaaaaaaaaaaaaaaaaaaaaacaacagtacgtgctatattggttttacagctctacagtgaaagtgaaaaagtcaacttaaccttttattcatgacataagaggtagtcagtatgcctaactcccactaaattatttgtaaggcgagcttgtactgtgaactttatcagtaaaatctattacatggtatcataatataatggaggaattggtcaggattatggatttttgtcatatttcgcccttaagcatagagaagaacagaacttttggattaaatggattaattttagtgtatgtgcttatactagagagagaaaaagagagaggaagaaagaaatctaggttgaataaatactttctgacataaagaaattttgaaatatggaaattattattggaactccagtggctcacaagatagtatttaattattgatatgataagatcactcaatatgctgaatgtgaattttcagaacaaaagagaaatgttaatggtggtttaatctaagagatccaatttgtcaatcaatctcccattggacttgtagagaaaacagatggcaacgatgattccctcattgctaaactgtcctaatcagggctaagaagaggagcaggaatggaaacttgggaaacctgaggtacagaaagcggcatgagcctatttcttagcaaacacaagtttgccttttctgggagacctgaaataaatgttcatcctggttcaaactcccatggtgatcctgacctgagcttagagttgctacaaaaaaattcacaaattttcagcagaaatgaaataagaatttcaaaagagactccgaatttgatgagtagaacttacgctttgcatttctgtaactgttttgggaattgcaaacctcatggtattactaaattatccattccctattctaccagtgttggtttgtattctcaagatatattgattgccatgaaagcaaactaaagccacaaacaaacctatcaacctagcagtccaaccttctctggacattaaatttatatttttaaaaaactatctaaaattcagaataactgccactaggagagtggagaaatttggcaacaaatatagcttaaccacacaccacacaaataacttttttattataagtaactgagaagtttagcaattagtacatctacttaattgcattttaaactgtaacgtgtttcttggcccacctttctgagacatgtttgttgttgaaaataataataagaatagggttatttatttcctggcaatgtcctccaactagcttaatgttgaaatactgttttttttgtttgtttgtttgtttgtttttgttgttgttttctaaactaatagtgcaggatcccccaggtctttcagaatctagcatttcttttcccctttccgcaaggattctggcatcgagatttttatgttgatgatccacctgctccaaatgtggcctggagactagtgctactaggggaaaattcatcctcacactctgctgttgccaatatcacaatccagggcctacttaatacagtaaaatgtctcttgcaacccaacaacactcccaggcatctcaacactaaaccttacttcaccatcattgcaccctttgtcaagtcagtttccctttagaaaagctgatgatcttgtatttattttacctattcttttttgcagcccttgtctccatgatgtttggcactcagacacatggaacctggcagggtgtatctcaaagtcatgtctccatttagaccttaaattagaacttacaacaaatttggggtgttccatttcagatggtacccagtgaggttgaaggttggatcgtattgttcagagatggagtggatctaactagggcaattagctgtcaggccccaaatgtccaggtatatttccttatgattaagctctttaagcaaattgaccaatcttttcccaccctgccagcccttcaggctgccagacatagaatgacatagctgagatggctgaaaacatgagcatatgtatttatttgtaatactgttgttttaattatccaggttgagaattagacaggcgggagacccaaatgcaaaatgaaattttaccttaaaagatcggtgtggtggctcacgcctgtaatcccaccactttgggaggctgatgtgggtggatcacttgagcccaggaatttgagaccagcctgggcaacatgatgagatcctgtctccaaaaaaagttttaaaaattagccagttgtggtgacacctgcctgtggcccttcctgcttaggaggctaaggcaagaggattactggagcccaggatgtcaaggctgcagtgagccatgttcgcaccaccacagcaatccagcctggagtacagagcaaaaccctgtctcagggggaaaaaaactggtaatacattctgaattaaataattactttatatttactatgaaagagaaaatttcagataattaccagagaaacaaaaactaaggaaaaaaaagaaaagtggctctttaaatttccctacagactaattaaatttatttttctagctttgcttaatggacggatacctttgtgaattttggatctttaaaatctatcaccagtattcccataatttattgttctccgtcattagattgtaaacttcatgaggtcgagctctttattttttcaagtccaaatcccacaccatatatagcctaatatattgcagacaacaatctctaaataaatggtaaatttttgaggtgaaatttattctggagattgatgattgcagctacttgattttgagagttgtagacatcttataactggtttaaatgagaactaaacgatatattccagaacgactgaaacagttctctcttatccaattgcatcctttctgcctttcatctttctatgagagtgtctcacattgcatttaatctttacattggctaaattctaactaaacaaaaatttcttaaaacataaatgaaagtaaagatttttttcttagcaatgaccaaccctctccctagacagcctacttttggtattttgggactgattgctagaacttccatgaaaagattaaataattttttttttttttttttttttttggtgagatggagtctcgctgtgtcaccaggctggagtgcagtggcaccatcttggctcactgcaacctccacctcccaggttaaagcgattctcctaccccagccttctgagttgctgggactacaggcactcgcttccatgcccagctaatttttgtatttttaggagagacagggtttcaccattttggccaggatggtctcgatatcttgacctcatgatctgcctaccttggcttcccaaagtgctgggattacaagcttgagccaccacgcctgcccaattaaaacaacatttttaaaatccagtctaatctctttattttttaaattaagaggaggttaaaataactagtaaattatatttatttatttgtaatattgttgttttcattatccaggttgaaatttttaaaaattaaaaattaaaaattttatttaaatttttttatttttatttttaatttttatagatgcatactagttgcatatatttatggggtacatatggtattttgttataaggatacaatctgtaatgattaaatctgggtaactgggatattcattacctcaaacattaatcatttcttcatgttggaaacattcctggttcttacaagatataaaatttgagacattcagttctcatctctgcacaaatggatctgttttttctttttcctatgtatacaactagcactatagagccgttatctaggaacatctgttagttgcttaaaccgggtctcctagaatagtgtctctcagtattgttatatctgtgatctgattttaggaacttgttctttagtcatttattcccacctcaatccataagcaaaaaacacaaacaacaaaaatggactataaacaattatctgcaataaaaaattataagtataatttaaatatctggactaaggaaaggataaattagaagaacattagaaattaacatagcacagtataggccgggatgttgcactatttttcccaatacaacagtaatcaccttgaggtcaggggctattgtaaatttcacattctcctcagtatttgacatagaacctacatataatttggcactcaatacctacttgtttgtttcacttaggcaaaaagtagagcagaaagaaaatgtttgccttatgtagcatgaaacactttctttttatgggtgagatcatgcccatttaagaaccttgacacaattgcaaagatctagggaactgtaccattctcaggttgcttcacttcctggctgattttaaacacctggaggaatgaactattgaaaatcctttgtgctgtccacaattaagtttgggggcagcctcacaactctcagcatggatgctaatttccaaattttaacctgggcccttaagggatggaattggcttacctgatatctctttagaagaaatgaacttcaacgtgacatatattcactaattattattatttcttaattctgttaaaacataaaagatgaaaggctaaaatgtaattctaattggcaaaggaatttcataccgggaaggcatctcttgattagcagctgtgtaggcagagggagggttgggggtatggaaatttggctaagaattcacacagaaaagtgctcgatgtgcttcgaaatagctcaatcagtactcagcgtgctgtgaaagcgctcaactggtgctcaacttccagcatatttaaatgagtggaacgcttactttttaaaagtgctcaattgggagtgctcaagttgtggtacctattagttgaatgctaattaacttttccttttcatatggttcacttctctgttaagcaaacagatagttttgctgttcatgttttgaggttaaacctggactttccatgagacattaagggatttgtatttattttcgagaaggaaattataccatcaactattccatcaactatagcttttcctttgcatgctcttgcatgcacgttctcgctctctctcggtctctctctctctcagatttttatattatactcctcactatttctgagctttattgttttgtttgaagccattttgagaaaactaaaagagcagagctagatgtgttatttgatctgatatcttttattcctgatacataggtttggtttttcccaagtgtcttttcaatcattttgataacactgctcttcagaaatagttttgagctttaatttgagtttaagaaactgcatagttttgtgctatgtttctaaatgtccactttcacctttgttgaactcattactatcttacttttttaagttggaaagatgaatcctgtaatttggtacataataaagacttcattaactaatctgtttaagattgaatttgagctatatgttttgagaatgcactttgggaaaaaattactatgactttcaattatctcactattgccatgaattaagatgaagatttaaatggatttttttttctgtaacttcagaatttctttcctaggcagatgctgggcacattgtacagcattgcacaacatggcagttgtgtcctatttcccctaattaccaacagaaagctatgcacgggtgaagaaagccttaggaacatgctcctataaatggagaaaaaagaatgccaaagctttacctgtcaaaatacaaactgtcaaagactgtatttcagtttaattcttgatcttctataatgatgtggcaagctgttgttcaaagtaaaggttaaggaatatttaggcaaatagaaaagtagaattccatttgcttcacatagcaactgaaaaagaagaatgcatagtctcacttttagggtgaataaaatgtaattttaattagcatctaatgcaggattaatgcattagcctcctaactcatctcccagttaaacacattctaagacagaaatgcctttcaatatatgtcattgaaaggccacattaggacttcttaggctggaagtcattgaaaatgtgggtcatctaatgcccctgttctgatttaggttctccaaaaaccttctgattttaattggcttccatataggtctactgtggagaaagaataagtgggtcagatgaatattgtttagaaaataagttagtcatatttcagtatatatgaaagacttacaaatctcactgaaaatgaagaaatttgtaccatggctttgaattgcgatctgaattttgtaaatgtgaatctgaactgagtaatgggatggtgcttagtgttctcctaatagcaattttctgagtctacagtcctaatggcctgaccttggatggtggtgaattcactaaggtaataactatcacaacatgaaacctctttaaagaaaacttgctggatatcaaaattctgttttaaatttttctctttgagtttaaattgaatttctgtggtgttttcacaaaagtgctatgctcagttttatgaacataatgaacatcatttttttttacctttatgcaaatattctcagccactattaaggcattttaatgaaaattaaaatttgattttttagcaacttgcagtagcttataatgataatattgaatcaggaatatattttttgcagaacaaaatgaaggaagttgggtagtagaggtcccttcaccaattctacccagtggctataagaagcaatactgggttattgctttgctgtaaaataagagagaaatgtatgcctcgttgcccctcgctgtttggcgtattgaaacttgcctattaaattaccctttactgagtttcaccgtgctctctctgaaaataaaagctaattcagctttcctatatttatgataatgaaaagtaatatctaaagtgggggtttactgtgcaatcatacattcaagtgatgtatttactttcataaactaaagaaggtatttaagtggtttgcattagttttaaacaattatctttttgtattcacttgacctagttagataatgatgtgcaaacagatttgatttaataacacattagtaaaatgttcggtgaagtcttaaaacaactgcttttaatattcctgaacaataggaggctttgggttcagtctcctgtgaggtgtgtggtgcttgtttgcaatcagctctgacattttcagagtcttctactacaaagagattctattttgaaaacaattattagggagcagctgaatgtgtatcctccattgagcactaagtttttgttgttttcagttgttggtggccaagattaagaaatgattgagaaagcttccgtgtgtgccatttgatagttatacaagataatactttttcactttttaaaaatatctttcccaaattgggattttgtaatgtattaatatgctaatgactgctatgactgtttgtgtccttcctctactgtatgatctgctttctagttgaaaattaataaaggctcccaactggtccaaagttttcatcaatatgagcagatgttgctattgtttgtttggctggagcatttactttgaaagatatgatctgagtttgaaaataaactaagccctagtcctatttttgtacagtggcatcaggaaaatattttgttttgtttttatttcagtagaaaaccaagaagagttaccttatcaattttaggatgtgaatttcagaaagaagtcatgatggtgttttgattttattcttatatcaaaatcctgccaacaataacaacaaaatacttattatatgtggatcaaatgacaatgaacttaccactgctttttataaactgtgtggtatgctaaaatttccatcattttatccattttgtaaaaatttaacaatcttgtaatacaaactatatgccactattcaaattaattacaggttcatttaaacatcataataaccccacaggataattactttactattattatgcccattgtatagataaataagctaatgtccaggcggttgtatagcctttccaacgtcacaccacagatttttaactcaggcaatctgcctccgcaggctgttcttgtatctgctaaactatcctgtgttaaaaattccaacagttattgtgtgtgtgtgtgtgtgtgtgtgtgtgtgtgtgtgtgtgtgtgtgtttaattatcctaagaatgctaacctcttggatatttttaataagtccttgctttaatggtaagacagtggactttctagtagtgatactgttattctttgactgaaaatgtggccaaagcttctgaggaacatatatccaaaagaaagagagccttccgaggcagctggatgacatgacaatcctgaagatcaatgagatgaaaatgtcatactgccacattcatttcatttaacctttaagtttaaaactttcaatgaaaaggaatcactgaaaatgttagcatatagtgtaaatactgaccagtcttgtttattatcttacataaaaataatttcaataaattgtatataaatgttatatatccattatatatgtaggagaaaatgaattctaaaggagaaacaatagaagaatctgtggttgaggcaaatttatctctttaaagatactttattgtttagaatcaactatagtactaagtgaatacgacttaaatttgtgatttaaggtgattccacaactgaccaagacatcagggagataaaaggaacaatgatcagtagggtataaaatactatccaaatcttaaaggcaaggtaacttatttcatcttgttaccaaaaatattaaactcttgctttcctttaagaatatattcataagcaagaaaaatgtggcctcttctattgcatagtttataatctaaagttgttgattatggcagacaaaaattaatatagaagtgtaagtacatatagagaaaacaaaatatataattgtttaaaatcttggactgtatgtcagtagtttaaaattctaaatgatgaaattaagcttataactgttactcttgtagccagttgatattcgccaagtcatgcttaacccttctcaaatttcagtaggaaatcaatattttgcagtttgctcatcttaagcagatggttatagcaaaacctcagcttgagtttatttatccattgaacttctggggaaaaaattaatgcaacataaaatcaaataaatatttgaataatttttataggcattattatgattactatgcaggatgatgccttgcccttgagaaatttgcattttatattaagcaatcttccattttatacgactgctgcttgagatgacacaaatatatcacaaggacctaatattttaggcctagaaggaacctataggacagctctgtcaatatcatctaagcaggtgacaagcaatgtcatatctatttagtgaagcaagtaaacagaaagaggatttcaagatagaaataaaaggtacaaggatgcacaaatgaaccttgtatgtggtttgagatggcaataggacatgcaatttaggctatcttgtactgctttaatattaatggatataaagtatattgtacgtgaaacaaatgagtttcatctccatgaaactgaaaatatcatgggggatgttttaattatatcatcttctgtaacattttatcatgaaatcaaaacatgtgggaccactatattttacatttatctacctcaagagtgatgtttccaaaattaaaacacaaatttattataattaggaaattaagtgttctttcagaaactcttcatgtattttgtaattcacatgaagttgagctttttgattttgaacataaaagtctagcaagaattttttcttcgttttttttttttttttttttttttgagatagggcctagctctgtcacccgggatggagtgcagtggtgcaatcttggcttattgcaacttccacctcccgtgctcaaaccatcctcttacctgagccccccaagtaactgaggctacaggtgtatatcatcatgccctgctaagttttttgtatttttggtagagatggggttttaccatgttgcccaggctggtcttgaactcctgagctccagtgatccacctgtctcggcctcccaaagtattgggattacaagtgtgagccaaggcactcagctgaatttttttcttaatttagtataggtatttgagtttgtttttgtaccatatttatgttgtaatctacacacctaagaatattatggctacatgcttatattatgccccttgtgctctattacttatgtttactacttatgtttgtaccactaaagcttcattaaatctctgtattgccccattacagcatatccagccaaaatatttaatacatgaatttgcctcttataccctaatctaattgctaccctgacttcctattgtcaaattgactcattgaatcttgtcttcagatactgctgtaactactccctcagttaattacacctccagtcattcaatttttcaggccagacaaccgataatcaccttttctcatgcctcacacaacttcactgttctcacagttctcttcctatctctattgccattgccaacagctttcttaaagtatttgtgagtcccaagtttcttttgtgtggcttgttactttaggttgctaactgctgaagtctaacttcccttcaaaactccttcctaaataatgtccaaagaatctttctaaaatgcaagtaagattagatcactcctttacctgaaatcgggtcacagttgtttatcatctttatggtcatctccgtactcctcagagtggcatacaagtcctttctactttcatctcctgctattctttcatttactctaaacattttatagttctctgagagattctctgctttcctatttatccttcaagactcaggttgtataaatcaggctccaatcaaaaacagatttcacactcaaattacagtatctcaagaagagtataccacagtgaatctgtttacaaaagtttgggcagggtgtaagtaagacatgaatgttaatgcaattatctaggttaacacaaaaagtaagagctattacaatcctaaacccagaggggtgaggggagacagtggttatctgaaaccagaaggaaagacagctctgtagtaaaggctgactggagaggatcagtgaccacaggacatagcaaatttgcaggcagagggccaggggaatcaatacactgaacacattattctccccattggctgaacctcctgaagtcagaggcttccatagggcccacataatctgccaggtcaggaaaccaggggggatgatggaggtagatctggagagctaatagaaagtttcctaaaacaaatctgttttagattctccccaagtctagttagaaacttcctcctttgcttttccatagtccatactgtcctattataacacttgtgttttatcgtaatcaccttttcttggtctgtgtctttctagagcacaccacgtcctaaggcccccggaagacttttcccttacccttccattccaataaacttaaatcagcatcaaatattgtcttttatttcactgaggccctagactgtacttttgaaacacacacacacacacacacacacacacattcacacacagacacacatagctgtaaattattgtagttacttgcagaagataaaattgtacaactcaattatataatgggaaactaaacattatgagaaacagttaatgttatgaaaatgaaagtatataaaatatgtctggatccttcttggggtgatcaagaatgtttgtaacaatattctaagtaattgcacatagcatataaaggaagaaaaccaagcaacatgccgttgctctctaataaagtataaacttgaaatagatatatgcaaacaaaaaatatgaaacagaagttacaaaaaaagtatcttggatgtgccaagtaagggtttgatcgtctctgccatcccttaatctccattggaaaccatatcattttctttcttttcttttcttttttttttttttttgagactgagtctcactctgtcacccaggctcgagtgcagtggcaggaccaccgctcactgcaagctacgcctcccgggttcacgccattctcctgcctcagcctcctgagtagctgggactacaggcgcccaccactacgcctggctaattttttgtatttttagtagagacggggtttcaccgtgttagcccggatggtctctttctcctgacctcctgatccgcctgcctaggcctcccaaagtgctgggattacaggcgtgagccaccgcgcccggctggaatccgtgtcatttttttatggacagttggcatttgctcaattttatgtaaatgcaataaaaatacaacttcatctattcctccaatgtatacagtaccccttacctcacgtaccctctgacatagaaattctgaagttgccattagaaatgttactgatacattacaaataagtcaaggatacagtgacaataaatatgatagaaatttgtatagtcaccttaacttagtgttataaaatatgtcttctctgatactaactttgtagcatgttaagcaaatttcaaaatattgaaaggtctatgccaatcaatacatttcacataaatacagcagtattatgctctaggttcccagaatacataaaacttaatggctagacatgttagaaaatattaaggtaatgctgtttttgcactggatctcattcctatccttgagatgtcatatgtttcagtaaggtcacagaaaaacctcacctcaaatataagattatatccatgtcacattttgacaaactgttttagtctctggagaactgtctgccttctttatctacaaagtttcagtacttctgctggagaaaatgcatttaagttttcccattttccataattcagtttattttaatataaagttttgttttatattcaggttactatattgatatgtttctgttatttattactattttgtagttctatttattttgtgttattatttcttatcattatatattttagttttattttccattgtgtttaattaataggtatctgaggctgattttagatttaaaattacatatgtagtctttctcccttgtttaaccttgagataagatttatttaaacaaattgcatatgagctactcctaaaccaaataagtttagttttgtgctataacctggaagcttgataaagtggatcctagatcctgatatcctggcagttaccttgactcaaaaagtgaggaagtaagacccagcattcagtttcaagcctctgagatatcatcatgaaagaagaaacaaaagcaatgatgtctgtatacttaaaatagaaaactaaggtatacagggtattctttaaagcttttgaaaaaaaaagtctttaaattatgtgttgaaatgattacaaaaatttataaccactacagagagctgccaagttcatttaagattgattaaaacaaactaacttatagtctggatctatttatctgaggaaatacatttttacctgacactggacacatttaaattactgatagttttagctttggaacatggcttgtgaaagctcctgtcataacagaaaattgtgcaatagggatttaacaggtttttttgtagcattgtgctatagcatgaatattgtttgtgcttattacaagtttctggtgatcttgtttgactttcctacacataacaagggatttggacagttggaaaatctgtacaaatagtaccacttgtggtttaatatttaaaacaaaatactgtggctgcagtgtgctggcttatgcctgtaatcccagcactgtgggcagccagaccagcctgggaaacatagcaaaaacttatctctacaaaaatacaaaaattagctgagcatggtggtgtgtgcctgtggtctcagccacccaggaggctgaggcatgaggatggcttgagcttggaggtggagattgcagtgagccaagatggtgccactgcactacagcctggttgatggagcgggaccctatctcaaacaaacaaacaaaaaacctacttctcttttaattttccctattgtttcattgagagatgtattaatctatctgggctgctatcatgaagtgcccagcttataaacaacagaagtttatttctctcatttatggatgctaggaggtccaagatcaaggtgctggaagaaatggtgtctggtgaggccctgcttcctcagtggtcatctttttgctgtcacctcatatggcagacggggtgaacaagttctctggagtctctcttataagtacactacaccaaataatgaggcatctaccctcatgatgtaataaccttccaaagtttctgtctcctaatattatcacctagagggttagaatttcaccataggaattggagatgacacaaaccctcagatcatagaaagttatttttaattgccaaggtaacaattataacacagtcatttctggtcgatatgtacttgcataaacaagacttatttttcatgctattcaaccacgtcagaataaagaaacagactgaaaggaccgtgaggtttctaaacaacgactgtggttgccacatgtgtatcaagaactgtgaaggttcaatgtgcaagctgaaaagtttgctggatactgtttaataaacaaaggaagaagacatacgtctcctaggctggagagagagaattttatttttcatagcagtggcagcatccatagtatcagcattcacgttggtttcacatatttcccaggtcacacaagagacagggtggaggacccaaatggatacacaataggtttgcaacacagttgagaaatctgtgattaggaaactcaaatcttttataataggctgcaagaaatcccatgtcttgccccagaaggaggcagtaagcaaatctgccttttgctgtagaagtttatctaagaaaatattagctgaattaattctatatattttcttatcagattgcattagaaaaaaatgttctgcaactataaatatatgttaaaaccacttgttgaaacaggacttaaggacacactacttagattaaattattttgcattacaaccaaatattttactcttaatcaccatgttccttgttaattatttcataaatataacagtttccatgaaaatcaaaccatcctagtgacagtcctgaatatgaatatgctctgttgatgccacttatgttatcatctttatataggaggccaatatggcatggaataaaggagataaaactatacatattcaataaaattgtagaaaagaagtttcctaccatgttgcatgtgcatgtaaatcttagttgcttcttcagccaagaagtttgaattttgatgaaggtgaaaatttggtataagattgattattacactattacattccactttagaatagtatatctaacttcttaatttataaaaaaatcacatatatcattaaactcaactgttttatttaatgactaaattttcatttatttaagacttgaaacaagtatgaagactttctaggagcaattatgacctaccttgactgctctaagagttttcagaggattattctaacatctaaacacaacatagatatctgtgaggggagcaaaatacatttcgtttgcctatcttttatttgcattgcatatgagccatgttctaagtgatttttttttctatatagattttaagaagtttttcttaaaggacattacaaatttctaagccactcactccagcacagttcttaggaatgtaattatgaacaactaaagacaaacgttataatgtaatacatttcctctaatgcaaaattagcatgcatctgaattacttggagggttgggcaaaacatggatttctgggccgcaccccagtttctcattcagtcatgccagataatttacatttctaacaagttgccaggaggtgctcatattgctggtctagggaccacactttgcgaacaactattttaaataaaagagactcaagatgatggagatgaagctgatgaagatgacagtagcagccaacacaaactaagtgctgtcctgttacttgtcagtttgctaaattctttatgtgcataagctcattatgtgttgtgattatttttaaggagaaaactgaagctcaaagaggttagacaaattgcccaagatcacaaaattgaaaagcatcagagctagtttttaagctgaggcttttctgacaccaaatcctgtgcttaacaaagaatagaaataactgcagtccataagggcctttggctctacaaagcaggtgggagagatgcactgtgattcaggagagccaggcacaacctgtggttcctagtaaggggtgagaattttcatgtgtaggaattagcccttgaaatctaagtacttgaataagtcagaaatagcccaaagtcataaaaagcccagaagcaaaacataaatgacaggataatcaccaaatcaggtcagaaccagggtttcttcatagttttaatatttaaaaataaatggcttctgttgcttaaacaacaatatttcttcatcaaaatactggagactgaaatggtgtactttctgtgctttgtgcccaataaaagtccaaaatgatacatttgctggagtacccataaaaagcaacattaatcatctgcttgcagagacaagggcaaagacaaagtatcagggaacagtgggatctttgtggatgagccttaaaatctgaaccacaggccaaaacaaaaccatctacctttacctttaccgacctgatttctgttccttgatcataccaagcttgtttctcacatatggacattacaatagccgttttctcttcccagaatgctttttattttagtttttacctggctggctccttcttgctattcaggtcttaaaagttgcagtctcagagagacccatctctgatcacccacactttgtagcgcttatcacagcatgttgcaccatatattttagttacttatttgttaattatctttccctccaaccactacaatgaaaactctgttacgaagggaatttttgcctgctttttactactatgtttctagcacgtagagcagtgtctaacacatactaggtattcagtaattatttttttgactagataaatgaaggagggaagaaaaaaagaaaacagacattgtagtagttgaactcttaatttgttttcattttaattattttttatttatttatttgtatttgtatttatttatttatttatttttttttgagacagtttcactcttgtcacccaagctggattgcaatggtgtgatctgagctcactgcaacctccatctcccaagttcaagttctccagcctcagcctcctgagtagctggaattacaggtgcctgacaccccacccagctagttttgtatttcttttttcctttttttttttttttttttttttttttttttagtagagatggcgtttcaccatgttggccaggcttgtctcgaactcctgacctcaagtgaactggccgcctggacctctcaaaattgtgtgattacaggtgtgaaccacagcccacagcacctggtctactcttaatggatgattcacagggttttcatgccccaaatttgtgcatgcacacacacacatacacacacacacacacacacactttatagtctgtagtgatgatcgaatgtcatgcagttatgtaattatattctctctagtttttgcccctcctcttttccctcaatgcttaaaatagacaaaggtatatatatacacaatatctttgaaaactgcaagcaaattcccagttcaaaatttgttcaatttttaaattagattaaatcacccttgaaagataattcactcagctccaggaatagtatgaattatgtagaaggcctaagactaaatattttaattccacatttcccctatgtcagggaaaccacctaaaacccaaccgcatatttatattcttgtaattaattgcagactaattttattcatgaagttatatttgaactaatagtgacatcgagagttaattctatttggcagtgtatttggactttcatttggtatagaatttaaatcaagggatttgaaaataaagttaagagggcaattcaattttgataaaaattgagtcaatgatgaaagcgcatcctgtaagctctaatgtaaacccagtctttgaaaaatatcatgcatggtacttggaaattctttgaggaatgaaagcttttcatgtgtgatcttcttaaaatggaatttacgttcaaattcaatggacccatgtgcacaaagagtgataatgcatctgaagagtctttctggattctctgtgtgagtgcacttgcatgtgaagagagaaaggaggagagagagagagagaaagagagaaagaaagaaggaaagaagagggaagggagaggttgttaaaggaaagagccactacaggtacctaagtgatttaaaaaaaaaaaaatcttatacttataaatattgtgcacttagtgtgtaaataaaatgttttgtaatgcttgttcagctactatgcttttcattgggattaactagacatcattcaatatgtttcatttgtggcttttaactcatttatttgctcacttaaaaaatattgagtatttaccatatgctagtttctaatctgggtattgggaatgcagctaagtattttacttccttattcttacataattttctaaactgaaaagaagggaaacttgtttttgaatgtagaatgattgaaaatataatgagattgaatacaaatgtattccgtaaaggtctatgccatattttttggtttaacattttactgtaatgaaatttgatgaattttttaacgtacttataagagatcaagtggaattttttcagtaattttgaataccaatcttagaataaagaatagacttttaagtaaaagtagtcaaaggttacaggcatttatattcaaacctacagtgttatcagtgcagcagagagaatcaaaaaacaaacaaaaatcctatacttcttatttgcagggaaaaaaatcaacaagtgagttgtagtcttaatgcctaccattctagaaaaattactaatggatgatcaaatattttctctttgacctacatgatacttgacactttgtatgagaaaaatgtgtactcagattaaatataatctcaaagcaatccttttaatttcaaactttggaaaagaaaatgtacttttttttgaaatttaatactcatggaaaaacagaaatagtgaaactagaaatgtgacacaatgctgatcacttcttgaagtactgcttctaggatgtgtgaggagggaagagaggacattaaggctgcttgcttcatgctgtgagccattagctgattgctccaggcttcaccaccaacagcagaacagaaggggaggtggccctgatgaaagggaggaaagaaaaaagacagatttattgtcttctctataggatcttatttccattctactccagtgctcttttctaagacattaaataagtacttaaccctttactatttacactccttatgatctgaaacactgggaaggtatttatattttgccttgaaacatcattttaaaatgttttacttttaaatgtttattgagttgtacttacaaatgttaattatagcttcctaaagacaggaatccaggaaactggatttctctatagaaggattatgtaaatttggttcactacaggatgcattactagcattttgaaaatgcctggtacatagcaagtgcttcacaggtgttacctgaatgaataagtggttgctatcttttgtttgtgacaaaattgaataatatggaaggatagaagccatgatgtgtggcataccaggcagcgtacaaagttaaggagtgtaattgtttaatgcctaatgcttaaatgacactgaccatgattaaaacccagctgacatctgccatatgcctctgaataagtgagttaacttttctaaatatgttttctcaaatgcaaagtagaaataacactactgccaacttcataaatggcacaccaataacactcatacactgagaccttagtataaatcttatatattagtatcattatttagagtggcagaacatagcccatacatagaagacaaaaataatctgatcatgaaataaaaatagaagagaccttgcgtgaaggaaaagaagggattcaaaatgctttatatataataattaacttcaaaacctaattcttctttatgtattttatggcagtaaattctgtattctcaattatagcatattaatatatctccaaattaagtatatttattgaagcatgacttaagtgaggattgtttaaaatgcacaaggaggtattagtttaaatatgtttattcacgtaataataacatgtataaataggctagttttattcataaatatctgcagttataagtaaagttacttataattccattacagtgttggaatagaagccctgtgaggacagggattttgtctgtttttaatggctatttgtctagtgcctagggcatatcctaattgtggtagatatgtaataaatatttcatgactaaagcaagtaatatagaaacattatatatatttagattcttggaaaagaatttcagcattgctagtacaaatcgatttcatgtaatctcatgacaaaggaaagtttggttcccatatcttttgcttaggcaaatggcatcatgaatttatgtttcagtaagaaatagaggaaacagtcattattttcagggccccattctgttgactaacaattctacacagtcctgaggaaattatgccactagtttgtgacccctcagcagcagatcccgtgtgacgctgctaagcatacattgaaatacaaacactgcttatataatacttctggatcaacaatgcatataaaattcaaaatctccattttcctctcacaggtgctaaccagccacaagggaacctaggacaacaaggaattcaaatattgtcttataagtaacaacctggtgccaggcagggtggctgacgcctataatcccagcactttgggaggcggaggcaggtgggtcacttgagatcaggagttcgagaccaacttggccaaaatggtgagaagttgtctctagtgaaaatacaaaaaaattagccaagtgtggtggagcgcacctgtagtctcagctacttgggaggctgaagcaggagaattgcttgaatacgggatgcagagattgcagtgagccaagatcacaccactgcattctagcctgtgcaacaaagcaagactccatcaaaaaaaaaaaacaaaaacaagtaacaacctggatgtttagcttcaagaaaagcttttatttatgtatttatttattagagacagggtctcattctgtcaccaaagctggagtatggtggcacaatcataactcacagtagccttgaacttctaggctcaaatgattctcctgcctcagcctcccgagtagcttggactgtaggtccatgcaacacgacctggctaattttttaattttcttgtagagatgaggtctcactatgttgaccaggccggtcttgaactccttggcttcaagtgatcctcctgcctccacctcccagtaggctgggattacaggtgtgggtcactgtacccgaccaccaagaagagctttgatagtcacaaagatagtcttcaaatattgaaatcttatcaagagaagtatccattggtcaattttgcacttcgacagagggcaaactatgattacaagtaaaattaccaaaaaagaaagtttcaattcagtgctagaaaaatatttttttaagagctagagttgccccagagttgaataactcatctggtcagttaatgtgacagttaattctgagtttcagattttctgggagagtctagttgtacatatttaaatgttgtatagtgttttgagtggaaaatttaaggaggtaatttaagattacttttattaaaaggaatgtagtatcaggctctagtacagaacacctttaacctaaccattatatctattatatattaataggattacaaacatttcacactgtacataaatacacaaaacacaggcaataattatagtgtggacacaacaggtagcacgggaataaggagaatatagggtgtgagtatctttaaatctgccattacatctggtttggcccaaatagtctctttgcttataagtgctcactgtgcccccattggcacccttaggaggacaccaagtaggggcatgagtttactcacccctttcagcagctggggagagttattgggccagagagcctgttctggccagctctgcatgtaaagaccacagagatgcagctggttccatctgcatttttcttagtgtctgtgtcctctctgaaatttgtgctcccttgtccctatttgagaaatccctgcaagtggtagcctctttgtcctgaaccctggacctctggctgtctcagaagctttgcatcctggtctagggcatgtagaaactctcaaacccctgaatattacccacagaaatacagtcagaggtcgggcgcggtggctctcgcctgtaatcccagcactttaggaggctgaggtgggaggatcacttgaggttaggagttcaagaccagcctggccaacatggtgaaaccccatctctactaaaaatacaaaaaaattagccaggcatggtggtgcacacctgtaatcctagctacttgggaggctgaggcgggagaatggacgtgggatgcggaggttacagtaagccaagattgagccactgcactctagcctaggtgacagagtaagactcctcaaaaaaaaaaaaaaaagaaagaaaaaagaaaagaaatacagtcagacagaagcactgcctccagctcatatctattcctgccttctgtgtcaccatccctttcttggtgttaaagagatgtgagtagagatttttctggaggctgtcatctgaggtctggtatgcctggaaggggtgacttgaaaatctcaaaatcccacatactaaaaacaggtgcttctatctgcctccccatccttttccatccccttaacctcagaattgcacctcaaaaggagaaatatgaaggcatttaactttaatctcatctccttcaacaggctcaaacttcaaaccagcaataagggcagaaattagacaccgccttctttatattaaaactatgtgataaagtcagccagacttggttcttaataagggtaacaaaaaatagattaaagcaaaatatccaaaatattatagctgtgacacttacaaactatgaatagaagaaaatattagaataatagtgatataaacatttaatttcataatctgagtcatatgaaatataccactgttaaaaatataaagggacatctcacttttcctaatacatgtgaaaaccacttttttattttgaagccaacagtgccaggtcacaatattgtttctggagaaaaaatgattttcatctctcaagatgatattttaatccaataatcacattaaatgaacttgttttgtgtgtctcgatgcacagtaaaataaaaatgtgtcgttgagttctgaaattcttaatttaaatttaataaagtatgcatcagattttaatagacatgaatcagcctcaatgtaagcagtcttcatatagaatgcaagctgtttaatttatttttgcctgttctagtttcacgtggtaaaatactgtgtatagataaacactaatctccaaagtatgaaaggaataatgaacattcaaggaagggcacaaagaacttcagaaaagcaatcaaattttctttgtttcagcttacagagttagagtaaaaatacatacaaaataatataattaactcttcacaatgtaattttaaatctcaaagattaaaccgaagcattttccttatggactatctaattctttgtttactaattttaaagtagacttcaccaggtttggtactttgctttgtgaactagaaagtaaacaataagcaaggcaaaaagaataaaaagggagaaacctactttaaaacaatctgaaaatgataagcagaggtggttgtttactcttgatttaaaaacatgaagacaaagagtacatgattgcttttccaggaaaagcatgagatgaaataggcttgagatataattttactagaaatcaaagaagtacaaaatatttataattaaccacagcttaaattgaacaggtggatacatactggttagcatgttagctcattgtgtatttaaagtttgttaaactatttattgctgcttcaagccagactctggaaccaaatggtgtttgataccaacccttcattgtcatgagccgtgatagtaacagattaagaactgctttgcatggctaattctgatagatgaactgttacttcaaagctagcagtaataaagtctaatcagatgtttaggaaatgttttagatatttcagagaaagggaagatataatttatggccaggaattaaatggtgcaaaggtgttcggcagttataaatattaccttggaagcatagtttaaaaaaatcctgatgaagataaaaagaataacatgctcaaaacaaccaacctggttgtccatgtttatcagtgtttacttggaggaagaccaataatgttattttgtcctgatatgtcctattaacatttgttgtaagttactttaatgaaaacaaaggaagcctaaatatgaaattaggaaatagatccccaaagtgattgaatattctttgaatagtaatctatgtctaacctatttagataggtggaaatcaaagactcaaaaaagactggaggtaaaattaacaaaataaatacaaaattctggcctcctatttcacataagatgatacaccaagaaactggagtgatcttccacttaaaataactaacagttttatgtacatttttgaaactatcttcagaaatacttccatgagctggtaaaaacaccctggccaaagtcaaatggagcattgaatcggactttcattttgagggcatttgccaaatcaggtaatttgagtactgatttttgcaggctttcagtactcagaggacaggaaaaaaagcccagggctcgcacttgcaatcagagaagtggcagagactagctagtcagaaagctttttcatccttttcctaagcatggtggtgaataatatttcctggcatctcctgagttaggtagcagtgaggcagctgagttctagccgatgtgctatgaatgaaagtgtcatatgctcattccaggccgggacatagcatgagttttctcccttcaacagatccagtggtcatgtgttgaaggtggtagtgtcccagtttagaaggaaagtgaattactgactcaatgcatagggaagagccatcctggagaattccggttctccttaataagttcttatgtataactgattttagttttctcattttatgtgaaataattggaatttagttctcctaagattcttccagacgcaaagttgttggttttattttggtaagaacacatagcatgagatctaccttcttaacagatttttagatgtacaatatagtattattatccacaggcacaatgttgtactttagatctttagaactagtatgtatacctctgacataaaatagacacttggtatttttgaataaatagtgagcaaatgatccctaaactgccattccctgcaaaagtgtcctctatagcagctattcctcctattaattaaaattctattccttcattgttaccaactgattagggtacaagttttaggaaaataataattgaacaaattcaccctcaggagtaatgataccagctctacagactgatcaatattcagttgctatgcaccagcattgcttacattagttgttaaagtattgaaatattaccataacagttcataaatatctgcagcttcaaaccctccagtatttctccccaccaccaccctaacacctttccagagacctaagattttgtgatcatagttccttgattccacaactaaaagaacagtgtttggtgtaaacatccttttccttcttagcatgaaatttataggctaaccttgcctttatctcttctgatttgttggtgctgtcacactagtggttaaatattttgaataccactcccggatagcttggctaaaccgttaaacaatatttgtcatttaaaatcatctactaagcctagatgaatctcttagtgcaatgtacagtaagtaagacataattttttatataataattcttctaggtaaagaaatatcttaaaagtatctgattgaagaaacaagggggtgtggttaataggcatttaatgagtatttgtgaactttctgagaaacctcattatcttctctctgtattcgtggcaaaaaaacaaaaacaaaaacaaacaaacaaaaaaaacaccaccaccaccaccaccaccaacaaaaaacccttttcctctactgcaattctgcctactcgtattccttaggaacccattctctgtccttcttctctcactttataattatctgtaagggttctcatccagttcacctgatatctatttttagatgatccttacatttatatttttttgctcaaaactctcagttcagtattttaacattgtattggtcatctttgcctgggttcctacaatttaatattttcagattacctacatagaggctccttggtggtctagtggttaggattcggctctctcaaataacctgtgtattcccagtctcagtgattggcctgatgatcctccttttagactaaacttgaaattgtatattcatgatctcaccttctctttattcttctttcattcagttattcaccaagttttcttaattctgcttcctaaatatccttgaaatcatgttatatcttaattcccactaccacatgaggatgttctagccattctgaaaaatcttcatgcctctgcatattctattgctctgcacagaaggccttttctcctccccaacatcttttttctgccttgcagatgccaccattttatccttttatactaagttctaaggtcaccattttaggaatctgtcttgactcctattttcccctggaagtcatttgataaacatctctattactgcacttaacaaattttattgtaatgaattctgaactaagccgacatttcctatactctaagccactttatccagtaaaactgaattatttggcaacagtttatccaggttatctaatagtccagtaagatgacgtaagaattagcatggctggaagatgatagctggaaagacactggagatacatgtacaaataatggagaagggaggggcaagcaagtttataaaatcaaaatgacttcatgtggacagagcataaaacacaaaggggacaggcaatagagaagtgtaggggaaaatacaggagagaaaaatgacagttacccaatgctgggaagggtagcgagggcatggggggtagtggtgatggttaatggatataaaaataaagttagatagaatgaataagatctagtatatgatagcacaacagggtgaatatggccagcaataattcattgtatatttaaaaatctaaaagagtagaattggaatattcctaacacgaagaaacgataaatgctcgaggtgatggatacccaattaccacaatgtgattgttacatattgtatgccggtatcagaatatcatatgtatcccatgaatatattcacctgttacatacccataataattaaaaattttaaagattatgaatgaataaatatgtatgaagtacttggaacagtgcctggaacacagtgttatatgagtttatagagtaaataaataaaacacattttatatttacctcttaataaaagaaaaatagagaggacttacttgaatacatatgaaaaattaaagatatggactttgtgttggaaattggtgagaaattagtaaaagattttgttagcaagagaactatatgatcttgctttttagaaatatctgtcaggcagcatagtgttggaatagattggaggggcataatagtaggaacaaggaacaataatccagttcaaatagatgggcgtgctcaaatgtcatagctgatagaaagaaagaagaagattcacaggccctttagatgtagtgttgacagatcatggtgtttggatggggagggtgaaagagagaataagcctgggattctggcttactagaataagactggatataatagacttattaatgaaaatgagaaaaacagagatggatactttggcaagggtggaaatgggtgggtagtgattttgatttagatctaatcatcttgaaggacatataagggatgcacgggagggatccagtagacagttgaatgtatgaacttagagcataggagagagttccagtgtgggttaggcagatttgaaacttatcggcctattggtggtttttaaaggactaactgtggacaagatgatccaggaagcaagtatgaagtgaaaagtcagtcactcttgtttgttgaataaaaggaaatcaaggatcagttctgagctgaggtgaggaatagaaactcaagtggacacaattaagcatcatataaagtagcccctggtcaatagtgggaaaagtatcacagagcacaaacaaaagaatgagactgtgtcctgcactctatttttcttttattttactcaatcccttctgttaaagtgaaattttgtcaccaaatgaatccagatcccatgtacctggtagttgtgttctcagtaagaagaaaatgtagatttcaaccttaagcctatctactcaaattcctgcttcatactcagggatgcctacattatttgtgagactcgaaacaccctgaaaatgtaggctccccagttccaaaaccaggaaaaatatgccatgaaaggtaataaaaggtaccttttcctttcttccacgatctcttcctctactttgattttttagaatgtcctatttaatgtagtttttaaaataaaaatatctaagttttaaaatattattaattttatcattcaacactatattgtgtagtatcagttttaagtgcaaatatgagagcatgtaactcacctgcagaatcaccaaaattatacaatttgtatttcatagcttcgacatgcatatgtctttcattcttactggaaaagtagaaacgctgcacaaaactagtttttactttatttcctgatacatgcatgttctatcaatactatctactcttttgctttactgattactaaggatgaatgaaaggaaaggaagtatgttcaccttatcttacctttgtttctatgttgtcatttttagatgcaaatactcttctgtactcactttgagacttgctgaactctcatgctctctcgctacaccagaattctgcttatgtggcatcataaaggctgtatgataatgaggcaacaaggaaagactgataggcatacatattatacgtatcttctttgcttaaattcatgtttcattgtcccatcagatttcacttacaaaacccaagctcaaacataaaattattaaaattttaagacagaaataacagagcgttaagccaagcatgactacagttgcacatgtagtgttattttaggacataaagaaagctatatgttaataaatgcaaactagtcatcctctattacacaactttctcaatcacacagcattttctttaaggtgacagcaaaagttgtcagttttgtttgttttcaccatttgtgagatatgtcattttgcagacttttctgccactagagggaaagataatttgtgttctctgctgcaattcgttatgcaggagctagggagggatagagaataatgtatgtttgtatagagagctgaagcagcgaatactcttcatgagaagttttatcattttacatttatccttgatatgtgccttttaaaacatgaaattcttttgaagtaggtgaagcctccaatagtaccattatctaaatctgtttttgcttctcattgtcacatgatagcttttcatttagtgtgatgctggggaaagagaaaggagaaggttgaatcaatttattagggccaggtacatatgtggttttttaaaactctcaatttctaccatactaccttaccttgcagaaaagtcatttccatatctgtcatatttgcattttttttgtaattctgaacttctactcctttgttaaataaatgattttaaaaccacacacacacacaaatacctacatctaggaatacaacgatctaccatttgaagagctctggagttcgagtttggcaaagcaattatttgaactccagctgtctttgacagaatgtggaatatgtgtagattattctatgaagtgggaaacctaagtctgtgtctcagatgagactgaatgaagaggtttacaccaacagatttgccaaacaataaatgactttataagacttttttttttcagaaggtgctgaagataacagtgctattaagttgagcttagacctgattctagactgactctaaatgttacatttaaaaaccactcatttttatgttgctttggtacaaagattcattggccattattcttgccttatggaattgtactatataattacttggcaacaatattttaatggtatcatcagtttgtgctttttttttttctactggtggctgagtccatgtccccataaaatactcctcgcaagctgtgctaaatttcctagcagttgcctggcctccacctacacagtggaaaagaatgaaatggcttgaggaaatagatgattgtacttgtactggtcaaattactaaagaatcaataaggccgactctgtaaggttattgactggcaggctaatctgagcccataactttacttccaaccaatgtttcaaggagtgctggatccaggactatctgtagaagctaagaatcatagtgctgagaaaagcaacataagattattgtattcaagttattgagtgtttttgagtcatccagtcatttgcttatattgcagataggatgctccttcatcatgcctattctgtctctttagtgcttttgaaaaggaattgaggatgagcaatctgccatttcctgtgcacctaaatttatctcatttatcttttttataataagctgatatagtaaaagaaagattactaatacagaagagtcttagctactgtaacacttagagaggattaagttttttaatttcattatttttcattttaaacactgaaaataagacagataagaatttttttccatctgcattttttttttttttttgcttttctgtttcagtgtacttctagagattaagttcttagcaaagacatcatttatttagtattatcagtacaaatcactagatgcatcaaataaaattgaattttgagttacaaagacaagatgggggtaggataattgtacaaaactaaagtagaattaattccattatttaaaaaatactagtgaatttctgtagctattttatttttgaaaaggcaaaaatatatacagtttgatcatctcattcccgtagaagtcactcacatctcagttgttatcctagaatgtgtttgaacttaggtattcattatgaaatgagaatagaatgagttatctatctgtaactcaaaggatatatagataatctttggcacatattttcacagttaaacaataccagataaaatacatattctgttccacatgggaaaactgtatggataattcgtgagttgtaaaacacaggccatgagcattcctttttggattgacaaggaaacaagaattgtgaaacacaggtcatgattattaattccataaagcctaaaatttgtacagtaatcaatatagataaggtaatatcattgaatgcttaagaaaaaattatttgaaaaaccacaaatgaaaaatacaaaaaataaagttttccagttcgtctcgagtcttaaaaaaaagtttgtttacttcaagagataaaagtgacaatagctaaacaaatataattttgttagtcttaccttattagcccaaatccaatttctttgagtgatgacaatgctaaaaaattgtgttttcagtgaaattggtgttctgtgtcctccaagtccccctctacctttgctttttggcaaggttcctttcccctctcctctgcgaaatcatagcactcaaaaagatactggagcaatctccttaggaagatcccattccgctgtctacaattaggacacttgttagccctctttaatgggataaaatatgggttcattctgtatcgtgtaggcatttctctaatagagctgttattagtaaattgtgggctcataagtaaattgatattagtgtggatcataagccagtagtatcactgtcacctgggaactagctagaaatgcatattcttaggcaccaagctgatctactgaacctgaatctgcattttaacaagatttttatatgcattaaaatttgacaacactttgtctacaccagaatggtattaacactgaatgatggccaagaaaaaataaaatgtccagttgcaaaactgcctcagtctaaagaaatgatgtatatggtgacagtactaggctccatgtcagggcaggtgaagctaatggctgtttaggactgtagcggtagcatatcatacagtcatcattttctcagtctttgacaaaagttattccttattttactggaaaaagtttacatcataatgcaaatttaaaaaggatttaaggaacagtacatatatttgcaatgacagagaaagggaaagagagagattctgagaaacttttatttaagccctagcagaattttgacctcttagaaatcaagcaatagaagtatggctttgcctttaacttctgaggtttgagcagaaatgtaattttccagcctctcatcatttctgtgacctttctgaatttcttcacattcttcattattactggagtttagaactgagtatatctcactactttcttaggaaaggccttaattaatatttgaaggaatttgagcttctaattcccacatcctttttaatgccttattttctattacagctgtgccctaaatagtttttaaataattagctgtacatggtaatttatatttttaacaaacttactacataattatcgttcatgtggtctttagaccagattttgaaatactgtgaagattaagcaccagactcaacactaagattttcagggtaaaaaaaataacaattttaaaaatgtgtaaatcatagtttttatgtgactgaaactatcatctccaattccagtttgccttataagttttatttttaatatagcaaaattctccccccttcctgcaatttttgcagtgtaaattgtgcttactaaagttaaaaatattttaagtttttaccaattatgttttcttttatactttaagtttttcttattaatatctatagttatttctaattttttatctcataaaatctgctggaatttaatttttaagacattccaatttttattttgactatggcagcaatttagtcaatttctaatatatttccaaaaaatgatctccctaacatttccagaaaagccttgaaatcctaataacatttctttggaacaggccagttgaggtttttctcatgatgatcatgttaggactgtcatagtggaaagcatcccatttgaggaaagccctccttattctttgtgaattttagaaatttgatctctgaatcctctggaatgaaaaaaatcttaggcagactgacagataacaattttatcagaattgtaataagttaccataaattaacactgaatatgaagacagtgcttaattaaattgtatatattcaaatacatttattgaagaattaacgctgaattaaattagttacaattttcatgcctattagtgacatagaagctcctttaaaatataataaacatgtcagcttaccacatagtagtttcttcaaattgttgagatttaaataaggataggcctgtgttagcgaggaataaaaatattgtgcttcagctcagtagcttccttcttgtgttttctttatatcagtgtgtgtttgtatattcctttttaacaactttataatttaataaaatcttgtctgtaagcttagcaacccataatttatcattatacaactggactaatgaatttattttacaggtacatcatcaacctggaatcatttttgtctgttacatacattttacatgtagaattccttgaaatgttaaaatgtgctatctggagaagggtatcctagaaagaatgatgactgtaccaataattagaaagaagcaagaattttgaaggaaatatgaggagttccatcttcatcatggtcaaataagaaagataatagaacacccaagaggcaatatgagacagctcaaaacacaatattgaatgctgtgcaagattaaatgaagagaaaagagaagggctggtattcattcatgctggcccacacaggaataaaagcacttaccgcattttctagagcataatagttttagcaactcttttgaatctgcttctttctgttttatacatttactttaaaacacacatcttggaagtatcctcttttttaaaaaatcaaaaatattccatggtaaataacatacacattcctttcaggttgtgtgtatacatttgttgtaaacaaatatcttagaattaatattaacatttttctgtcaagatgtgttatttaaatacatatacaaattatatgtgtatttaacagccccacaatgtgatttaatttttatgtgcattaatctaagaacattatggagcatataaaccaaaatatcaagagtggttatctcaagacagtaagattataaatgcctttattttccacttctgattttttttttgtgtatatatatatatatatatatatatatatatatatatatatatacactatatatatacatacatgtatattttctctctctcttttaaatagagacgaggtcttgccatcttgcccaggctggtctcaaactcctgggctcaagtgatcttcccacctcagtcttccaaagtgctgggattacaggtgtgaatcactgcacttgccagttttttttttttaataacaagaaaaaaatttagcagaatttaaaaaaagagaagtagttcaaaatagacatttcttatgactgtatattttttatgatgggctgtcattaaatatttagccaaaaaaagaagtaaaaccatatgaaattttaattacttaaggaacaatgtcatgtaacattggtaggagtggctactagtctggaaaataagtttgggcagaaatagtagactgtggcttaatattaaggctacctgcaaatgcccctgtaacataactagtactggacagaatgtaagagttatgaatttgggatgacaaacatggagactcagaatacattatatggatttttagattaatacagaagttatagcatggaatcaggatccctccttaggtaattgccccactcctatccctcttcacattgtcttataattacctattaagttagttctctttatccatggactgtaagttcatcacacgtgaacttggttttctttactgtgcttggtatataaatagggccttaatgtattctggctagatgagagatgtgtgacaggcgaaaaaccaagcccggggggggaaaaaaaaggtaatttagaaaagaaaataaacagagggaaataccgaacaatacagatggctcagcagaaattgtagaaagcgacataaatagattttaagagcatgactttgggactaagataaccctggtttgattttcttctccatgagaatgaagagcagatgtaacgggctaaagtgagtaaggatagcagcactgagtagtggcatcagaaaagcatctaagttttattacaagacaaattaaactcagaatataacaaggctcattcctgggaataattttttaaaacacagctgagatagtcataaaacatgcagttattttaaatttagaaacaaaaccaggacctttaaaaatttatgcttctctgatttttgtccttccaaaattagtctagaaataagtttattgagaagtcagctgtttttaggctctatgttgacttttaatagtatcaaacgaatggtaggggaaaaaaatgaaaataccggttatccttgtttgaggaatctagctttgggagaaaagtgacaaaatatgcttaatttttttcctttcatttttcagatgtcgttttagaaaaacacttagggaggaaagaatgtgagtgatttttgttttcatgccagagcacagacacttacgtgacaattggagtaaataaagtaagctttgactactgttctctaattcatgcgtacctctgatattgacgtgttaaggaaaataacgtatctgcagcccctttccagagaggcactatgacgtaagagttcagagtatgagcactgttatttcacacacctgtgttcatatccttgcttagcaggaagaccctggagaagtttttcagtttctctgaaggctgcattctcatctggaagatggagataataacttcctcataggattgttgggataattaaatgaggtaattcctgcaaagggtttaacacagtgcctaatactagcaattgcaaagaaatataaattattttgttattattatgtaagcagatatcacatcaactgttagtcctcagacttggcaacttacaactggcggaaggagaggaaaggaaaaagagagagcaatgtcatagtaggttgttgttcttttctataaattcatactgcaaagagaagaaaagaccaggagcctgagcagaagcccctaaatatagccaaagtcaaggttattaatagagtgtgggattgctaaagattagaataaatgaatctaagacagaggggacacaggaaagaggagatatgagaatcctctgtcatttacctccctgactttcctttcaggtgtcttacagtagtgaaactggagagagtaaatgaaaggagggaactgttgacagcagagaatcagaataggaaaacttggtgtgcctgttatgactcttccaaaagagcttccctaagagcagagtcccaaaggagaaggcatgaagcatgatgttttagttttgcgctaactcctctttctctcagagtatctgctttttcatatcagagctgagtcttatcaacaatagtagcaacttaacataaatgaacattccataattaaaaggactccctttaattaaaaatactgtgcagacaggaggtgcttcttaaagcttggaagattgatggacggcgcaaaaccacctattagaaccacaaatagggagcagaaatttaaacactgaaaattagaggaatgtcatttgtatttattaatactcaaccaatattgcattgaatatctatattgttacaatactaggagtggagaatactagcaaattaaaggtgttttatcttaaagcactaaatcatatgtataggcacttataaggcattacgttataaaatactagttgtatcttttaggtaaaaggagcaaatgaaagttgagtgggattcacatagcctgcagtcttcatgatttccacatggaaagagagaattggagctagcatttaaacactaacatacgtgagtaaagataaagtgaatgaaaaattgtagtggactgtaatttgttagctaaaaattttagtatctatctattaaagtgtttcttatgctgttgacactttaaagctaaaaatttacattttctcaaaccccaacatctaaagtgggtagaaggagttatagccactggtctgctctctctacactcccttcatttggagaacatcacctgtgggaaagaaaagaagtcaggtgacctgggtctattctccttgtcagctggacatccaggaaaatggactaaaaatatttggagaaagagaccttatctctgcaatgctgtcagcatgatgtgctggcaaagaataatgaaacttagtaaacataaccctgtatcggtaaggcatggccatctgtaaggaatgccacacataaactatagaactatctggagtataaaatgaagatgtttcagaatttaacaatcactgctttatgaggaatcccagaagcctcatgtagggataatgcagggatataatctcttctggccagagctgcttgtcagacatgagaaggaagaacctggggaaccacccttaatgtctgttctctctgtgcttggtctgaggcttttcttgtctgtctccttgaaataagtactaggttactactgagtaaggtctctgattctcgtgagtctgctttgagaatctaaaccagtgtgctagctcataggttgctagatatgatttgggctccactaagcagatgctctgtaatgagccttcaatttgtagtccattaagtcaggagagaggcagtgcattgacaattattttactaatccacttaccactacagttaatgggagcaagttgtgtgcatggtggcggtgagagagtaaaaatcttgtatgtttcataagagaggtagtgaaagtgacagcaagaagagtaaataacatcagaaagggaatgtaaaaattgtttgaattccagctttgttctgagacacagcaagcaattgttgtttctcattattttaaaagaaattgtgtctttttgaagttactcttgaattgcttcaatgacaaattcatactctagaggcaccccattccttgtttgatggctccagttgttgcacagttatattgatacagatctgtctccaaagagattccaaccagcagcctgctccttggtgctaatttttattttgacttcaacaactatcaaatccatcaaggtatgctagtcacctggtttttgttgtcttagttattttagtagttctctatatcgtttttaaaagtctatattgcatcctgaggtctcttccctgaatgtgcttaaatttgggtaggctccttttttgaaaatagatattaggtttctctgcaacacaaccaccaccaccaacagaaaatggcaagaaaggaaataaaagagtaatgaaggatgagcctatagattaaaatacactaaaaagaaaaacttaacacatagtaacacatgtactttatttggatactgattcaaatgagctgcaaaattaatttatatatgagttatttgaaaatttgaacattaactgaaaacttgatgatattaagaaatcattttttttctaggtatgattttagtatttggattatgttttaaaatttctaatattttagagatgcattctgaaaaattttatagatttgtttcaaagtaacttagggtggtggtggtgagtatataaatataaacatatatatggttgggtgcagtggctcacacctgtattcccagcactttgggtgaacgaggcaggtgcatcacttgaggtcatggattcaagaccagcctgaccaacatggcaaaagaaaccatctctactaaaaatataaaacttagcgaggtgtagtggtgcactcttgtaatcccacccacttgggaggctaaggcataagaatcatttgaacccatgaggcagagtttgcggtgagccgtgattgagatcgcagcactgcactccagcctgagcaacagagtgagactctatctcaaaagaaagaaaagggaaggaaaggaaaggaaaggaaagaaaaggaaaggaaaggggaagaaagaaagagaaaggaaaggaaaggggaagaaagaaagagaaagaaagacttttgttaatatttcaaattcaccataataaaggcatcattaaaaagttttagatgaaatctcattagataaggacagttttctctcactagctatacgtcttacttcaagaaagcagctcaaaaatgtgtgtatatatatgtatatttagttagccagtcaaaagaatgaacaaatagataaaaaatatatcactacaagtagaatgtactattaataagaaatcatgggattccataaattaatttattagttatataaataaataatagtcatctcttttaaaatttaaacatgggcaattggagttgactctgttttggctatttccttgctcttagcaaaaataaaaacagagtctttagcttcaacttaagatcttacagaaaaagagaaacagaaccgtgactagagatactcattttttaaggaatcaaattttatatgaaagctattacatatataatttctagggttacttcttaaatcaacccagtttctggcataaaaatactttcactataatcaccagtactgaaaatgtggtccatttgtgcccatgaaacttgctgcatttggctctgagcaaaaggacactggtaggataacaattaaaataaaagttaatattttatttaccttcttagttctaggtcagttttcaaactatagaaacagagcattatttaaatattccctcagatgactaggggatcattcagtggcctcaagtactattttttaaaaaacagtgaataaaaagaacatgtattcactccttccctgaaagttatattattcttccaagtggcttttttcaacacaatgaaatacacacacacacacacacacacacacacacacacacacacaaacttaaaataggctaagtgtaaaaattatagaaaatatttattgcctatttttgagcacacaaaccagaaatatgtgtctttattgatgtactttcacacccagttgaaatatagcaaattatcttgaaaaactttgattctttctaaaatacatacaaaaatagttatatacaacttagtaatttgacaagtagtctcgaaaatatgatattcacagtcttaccaagattttaatgtccagtgatttactaactttgttgtttatataacaaattagccctaatgtattcaatatttgattgcttgatattttctcagtaagaagcagatatagtcaatatacatagattgcctaaaataggagtcattgccaagggtcaaatattataaagggcaagcctctttaaaagcatcctttatatcacagaaatagagaaggagttatttttcagtggttgaatgtacagaataatttacaagattgaagtgtataaaacattttatacactaaagctcaatgtgcccacttgtgctgaatagcttattgtggcttgagcttctcatacattctcaaacatgacttaagggtgaatggattcaattatcctacatctagaggcaaatttcacctaaatgtaattgcaggaatcaagaaaacaatccaaacttctactgagatatctgtaaaaattctcactgaaggaatcaagtgattttgaatgacacttataaatatgcaaaatttcatcatattcaagtatgtttcaagctgtacaataacacaggtttaacttgaaaaggaaaacaatgaatgttattattttcatcatgccttgtataggctatgttttttggcaataattagatttcaagtaaaacaaacttcacatcatcacataaccattttattttaagacagaggtttcactcctgtcacccagactggagtgcagtgggcgcggtcttggctcactgcaatcaccacctcctgggctcaagcaattctcctaccttagccactcaagttgctggaattacaggcttaagccaatgcacccggctaatttttgtatttttattagagatggggtttcgccacgttggccaggctagtcttaaactcctgggctcaagtgatccacccgccttggactcccaaagtgctgggattacaggcatgaaccactgtgctgggccccccccttttttaattgtaataaacaatggaatccagttgcagcaatgtcagtcatatctctggtcatctgatgtttctctgggcttgggtgcacatcacatccggatgtgtgtttcattcttatttccattgagatatagataggtttctctaccagacagttcctgcttcgccataatagcagttttattttggttttgcattttgggggcattaattctgacccaaattctatacatcaaactctaatgtcaaccaagatctgtttctgtgtcataaatccaattcccagaaagaggatctgattggcgcagctttgggtaactgtttccagcatacacttctcctttgaattacagtcttacatacccgactgcctattgcgcacatccacttagatgtcaaataggctttaaaatgtaaaatgaccaaatttcaatgacgattttccttagagtcatgtttgattcttttttttttttaacctatatgcaattcaagaactattccatttagctttacttttaaatatactcagaaaataatgtctgctcggtacttcagcactactgtctaggccaaaccatcatgtactcctgcctggattattcatctctttgcatctgcccatgccacctacggtttatactcagtacaaaaagtagaatcatcttttaaaaatttagatcatgtcacttctctggtcaggtttcctatctcacttgtagtaaaataaaaaggctttgcaatgatctacatggttctgtattacctactttcaacccattacctttctgatcttttaacattttgttctttatgttactcacttggctccagcaatacagactttttgctttttctcacatgtgccaggtacattctcaactgtgtggtctttcctcctgacttaaatgttcttccctgagatggctgcatggctcactccctcactctctccaactctttgtttaaacattgtcttctcaatgaggctttttctgactatctaaaattgaaattcctctcccaatattccctaagcttgctccacagtttaaatttctcttaagaaattatcctcatctaacattctatatattttactatatgtttattatatccctctattcctttgacatctcaccagaatgtaagcttcatgaacaaacagatttttgtcaattgtgtcctaaaccaggcttccaaataaatgtttgttaaataacttgtccacgtaggacccaatcaaccattcctgttcagtggagggccataggaagaggaggtttacgaagaaaaggatgtcatggaaagagaaaataattactctcatataggcatatattgttatttatttccaaaataaaagaaataatgctcagtatcgctcaatgatttacttagcattatataactaattagtgttagaaagtaaattgaagtcccgcacactcaagttcatagttcttttagtgattttatagccatagcttcatatgaccagaggtgtgttagtaaagagattcaaagtcatcacatttcaatatagctctaaagccaacttgttaattggaaaattgctagattatcattatatcccagtgattttcctattagtttactatttgaggtcatatgaattatctatttaataacagaaatttggggcaaattgggccatgatatccttcctgacctcaggtcaatatatttcatcttcacctacaagtttaaaaacatataccacaagaattgttcaattaaaatgcttctgaagtctacattaccagtgatgtgttcttaagttttgtggtagtcaaaggacctgctaatgtctgatattctattgtcatggatactgacaggctgaagctgtcaggttgggaacatttgccattatttctgatgaaaataatgagaattggccaggcgcggtggctcacacctataatgccagcactttgggaggcccaggcaggcagatcacaaggccaggagttcgggaccagcctggccaacatagtgaaactccgtgtctactaaagttacaaaaaattagccaagcatggtggcacgtgcctttaatcccagctacttggaaggctgaggcaggagaatcacttgaacctgggaggcacaggttgcagtgagccgagatccagccattgcactccagcctgggcgacagggcgagactccatctcaaaaaaaagaaaaaaaaaagaaaataatgacagttgctattggaaaatatatctaatcaaaaacataatacaatggacccacacatttgtgaatgggttgattccaaaacaactatttaaaaagagttatagctatattgcagaaagcatactgccactttaaagaatctaagttaagataaagagaaactttaattgcaccaagaccaaatgagtctcagaagttttgattcaaattactaaagtttggggaaaataaagttaactgataatgagattgaatatttgaattgcatctttaaaaatatcacatcttaaacttttttttttttcagttcaatgattcactattgctctgccaagtttctttctcttaggaaaacatcactaattagaaatgaggcatatttcatgaagaaaatattatttttctgttcttaacaacatgtttcactttttatttcattggctatattgaagagttagaaggaaattgtattgccttaaaaatcaagacattatttttatttatatgtataattagactatttagatgaattgattttcttaatgtgctgtgcttaagaaactagttagaaaattaatccaatagatttttttgaccaaattccagtcagattcaagagaggtttctcaatattaaagtggaaaaaaacagtcttttttcccatttttaagcaccatttttaagaactgagaatttgtcatagagcatattagtgctataatagactaacagctatgagtctttcatctcttaggagctgaaatttatttcctagctcattatatcctaggacaggaaggaaggaaggaaagaagaaagagagggagggaggaagagataaaaagaaatggcaatcaagaaaggcagagcccatgcttactaaagatttttaaatttgataagcttggaattgatgataaaatataaaacttccatgttaatatcctatgtaagaaaacacaaccaacttattatcataacttggcttacataaaattgtccttgttagttctattgtttgtttgttttttgagacgtctcattctgttgcccaggctggagtgcagtggtgtgatcatggctcactgcaacctccaccccctggtctcaagtgatcctccaacctcatcctcccaagcagctgggactataggcatgtgccaccacacccagctcatttttatatgtttttggtagagacagggtcttgctatttgcccaggcctgtctctaacttctgagttcaagcgatctgcctgccttggtgcgctgggattacaagtgttgagccactgcaaccagcctggatttttcttttaggatttttaaatgcattttgtatttagaggtaattaaaaattcacaggtagtcatgagaaataatatagagtaatcaagtatacccttccctggatttcgtcttacataacaagagcacaatattaaaactagaaaactggtattgatataatccatcgagcttattcagatttcacaagtcttacattcactcctttgtgtatgtatgtgtatgtttaactcaatgcagtgttattgtatgtgtagtttcatgtgatcaccgccacagccaagagagagaacaatttcatctaaagtctcctttgtgctattatgatctcagatacctccccccaaaaccccaaccctgacacctggcaaccactaatttactttcgatctccataattttgtaatttcaagcatgttatgtaaatgaaattacacagtatgtaaccttttgagactggctttttttcactcagtggaattctctggagattcatctaagttgtttcatggctgagtaataatccatgtagtccaaagtagtccatagtgcagtggactgaattttgtccctcccaaaattcatatgttgaagctttaacccccgatatgactgtatctggagatagggtctttcgggttaaaggaggtcatgagtggggacctaatctgataggactgtgggccttagaagtagaggaagagagatttctgtttttctctgtcatataaggacacagagagaaggtggctattgcaagccaagaatacagccctcaccggaaactaattggcacccttacctaggacttccagcttccagaacagtgataaataaataaatttctgttgtttatgccacccaagagtgtggtattttcttacagagaagtctgagctaacatacatggcatgaatataccagtttaaaatgtttatttaacccagagcctctgggttgcttccagtttggggctgttatgaatgaaattgctattaaaattcatgtgcaggtttttgtgtgacatactttcttatttgtctagagtaaatgtccaatagtgtaattgctgggtgatatggtaagtgcctatttgattttgtaagcaactgccatacactttttcttggctaactgcattgttttatattcctactagcaatatgtgggtgacacattgtttccacagcctcacagcattcaatgttatcattgtttttttattttagaccttttattttgttttgttttgttttgtttcagacagaatctaactctgtcgcccaggctggagtgcagtggcatgatctcggctcaccgcaacctctgcctcttgagttcaaacaattctcctgcctcagcctccccagtagctggaagtagaggcatgtaccaccatgcccagataatttttgtatttttagtacagacgaggtttcatcatgttggccaggctggtctcgaactcctgacctcaagcgatccacctgcctcagccttccaaagtgctgggattacaggcgtgggccaccgcacacagcataatgcttaataatgataaacatcttttcatgtgggccttactagatttttgaaaagtatattgaaccatattttaaaagccctgtggattttctttttcaaagatatgcatccaataccaaaaattttggtcaagggatttataagccaaaacatttttactccttaaagctcaattttcatacataaaactcctagagaaataaaatttagatgtttttagactcatggaaagaagaattcgaaattgtagatgtcagaaatcttttttaattggttctggagtcctttttccatgttttgaaaaaaatattatatatgtaaaagtttagttcaaacagctattttgaggagcctggttctctaggaggtgagaagctgtcccagttttcccctccaatccaacaaagcaccatgtgaggataaatagattttcagggcaacactcagaatctgcattaggagtggacctctttctcagacagtcatgagaaatcttgaggctttaactttggcttttaaacatcttcctagatacctgcaaagtaggagctaatagcagtcataataatgggtgcataaaagcaaattataattattggtttaataatcaacagttaataagcaaatgggtattttagtagaatatgttctgccgataatggaaattgatttttttaaaaagaaataaattgataaccacaaacttaattgaacagaaaaatctaaacattattaattaacttggaagaaatatattccaaataagctatagattggataattagaagttgttagtgataagaaatttttcctcaccaatctcattttgcttactgcttttaatgtgatgagcctaaagtgaaacaacatcctaaatcataaatagaaagaattgtcttcctttcattctttgaaagatgatagttcattctgactctccagtaaaagaagtcttatcaaataaaaatgattaaaaataaacatcaaaaaagataaaacatgaatttaacatttatcatttcacatttctgtcagtagcatggccaattgtctacagtagaggttcctagtgggagaagttagggaactaagcccattaaaatttctaatgcacttaggatgtaaccgtagtgtatctaacaaaatcatatattatgatggtaaaattttcatttaaaaattatgcttttctgagaccattgtctttagtgtctgaaggaatataatatatgttttaaatattactgtgcttttttaaattattttttgtagactctcttgacagaagtccagtttaacacagaattctcagccgtattttacctttgcctctatgtttatgttatctctgaagtgggaatatctcatgtgtgtgtgaatacacaacaatgtttgtcttggatttccatagaacatagcgagaattgtgaaatccatgtgtatttccggagtgagggagaggagcctcctaaattatgttgacttcgtttctcaccttgttgtcattagagtccaataacaatacaagtatgtaagttctcctacctagcagaaaaaaatttgctgcgtgataccgatgtatttatggatccaatttaggttactacctttaataattccctgttagtgtgtagtgtgcaagatgagttatcccagttttcccaagatcattcagattatgaagccatatattaagtgggacaaaatccctgtggcttctattctgtggcaaagtgtatacaaatgaggaattgaaaaaactctttttttttgcatttttaaaaaatatatagattgaagtgctttagaagtaaagagacaaactagaaataaacaataaatataatagctaatatttattgaccgggccctgcttttagccttttcatgccatagatgaatcctttgatcctcaaaaacacatctgagaaacattctatcattatcctcattttatggatgcagaaatggaggcttagcctgcttaagttacttaccaaaggtgagagagcaaagaaatcaagatttaaacccacgtatatccgattcttgagcaaaagtgtttcctactttatcatattaaaatttttcacaatacttcagaaacaaactctaaattaaattgtaatagaaatactttcattgagtactgttgattcaacataaaaataactttagggaaaaaattttaaagcatattttatgccaaccagcaggtacatagaatctgtcaaattaaaactaggtagtaaaatcatttttctttcaaattttatcactacccatttaaagttgtcattgctcctttataataaaattatttttttctaaactaccattaactagtagttttagcaactgcaaacattttataagtacagctgtttacaatgattactttttctatatgttaatgctatacagtcatttacccttaaagtatttacaaaagactcaaaattaaaaataaaaaactactatttgtcatttttaaacattgatttttcagttctttacccttagcttgtacctttaatttctctctctttgctaccttcgtccttcagtctatagctatcgtatggttttactcaacttgaaaaaaaaaaaacatataagctagtgagcaagtaaccattccttaaagctgtgctcttccatggcttctattatagattctcccttactaatcatccttaaagtgaaagctactgtatcctctttgtcactctctattcacttttcaacccactgtcatgggactctgccccatctgtccaggttaccacagcagtgtcacgttcaccagatacttagagtcctcatcttaactaacactctctcacactcaaactgaggatcattttttttatatttagtgcttatattgttttccttgaaaatagattttttttttttttttttttttttttttttccagagagaggaatcttgctctgcttctcaggctggagtacagtgatgcaatcacagctcactgtaacttgaactcctgggctcaagggatcctcctacctcagcctcctgactagctggaactacaggaacgtgccaatacatccagctaattttctgcagagagaggatctctctatgttgcccaggctggtcttaaactcctgacctcaagtgatcctcctgcctcggcctcccaaagtgctaggattacacttgtgagccaccacacacagcccttgaaaagttttcaagaagagaatgttttctcttctgtatgcgatgtgtgtgaatgtgtgtgtgcgctgagatcattttaagaaatggagttttaaaaaatctttatgttcttaactggtaaacactacctacctaggttccattatatcctgtttgattactgagcttttatttctattaagtgtctatgagagtttgtgagggtagcccaaagtaacaagtattctacttagctcacttaaagtgggctgattaccacctagggtataagtcaagatttctggctcttttatttggacctatgctaatagttttgcttgatatatgaaattaaatgatggcgggcactctgtaaaacagagcagggagatgggtttagtaaaatgtagtcactttaatgaggggttgggaagaactggatctgagctgagaatcctactgaggcaaatggcaaagagaaaaatcttttgttcaatctgaaaccgttgggtttgtaacacatttttttcccacataaatcagtttgatatctaattcacagacactgttggacagcacagcaattgcagccagggtagatgggagtgaaagctagtatatcttcttgtcttcgtagtaactgtatcttttctacaaaggtcagtaataacaatttcatttggggactgtaatacagaaggttaaaaatcaaatgaaatgtacaagtgtcattttccttattcttgtttttccttaaagtcttggggagtaagtactattatagattttgaaaattattcgcatgatgtgggataatgatgtccagcagatttaagtacccactggtaattatttatcccgaagaaaatcatatacagaattctaatacatgaaataaatataacaataactaagttccattaagtgtttacaatgagccaggcattgtgctaagtaccttgtacatattaacttgtttaatcatcaaaacaattcaatatggtaagaactattatgatccctaacagactaggaatttgaagcttggaagaattacataataacgtaaccaaggtaccacaaaaatagtaagtagtagatctagatttattctcaaacaacactactaatggacacagataaatgtatacctccttcaaacgatggggggactgatgcataaacttgggtggttttggctaggtccacgttttgacctcacagtattttctaaggaaattcccaggaccctctgctctagtgtatttaaagaaagataaaatctgaattttgcattctaactctcggaatacgtgctgtttgaagttctctcattactgaacttccattaaaatctttttaaacgaagaaaaaaggcataagcagaccggaatcatcatttacccagttactcaggttacatacaaccctaaagccaaattggatgctatacttgcccccacagtgtcacatgcaacccgtcaaaaaagttcaatatttttctttcaccaaatacaggcatattttggagacatcacacgatgtctccaaaccagaacaaattttctggtttctcagcacatgtaaatgttatgtttgcactatactgtagcatagtaagtgcaatagtatgatgccaaagaaaaaaatgtacatagggccattagaaataatttattgctaaagaatgccaacaatcatctgggcctttagtgagtcaggatctttttgctgatgaagagtcttgccaggatattgatgactgctgactgatcagggtggtgattgctaaaggttgaggtaatggtggtaatttcttaaaagaaaacagtgaagtttgtcataccaatcacctcttcctttcacaaaaggttttctgtagcatgccatgctatttgatagcatttacccagagtagagaagaacttctgtcaaaattggagtctatcctctcaaccttgctgctgctttatcaattaagttgatggaatattctaaattattttttgtcattttagcaatgttcccagcatcttcaccaggaatagactccacttcaagaaaccacttttattgctcattcactagattcaatgcttcattcattcaaatttaatcatgagattgcaggaatccagtcacatctccaggctccaattctaattcttattcccttgctatttacagcacatctgccattacttcctccattgaactgttgaacccttcaaagtcattcatgagtgctgaaatttacttcttctaaactcctgctcatgttgatattttgacatgctctcatgaatcatgaatattcttaatggcatgtagaatgatgaatttgttccagaaagttttcaatttactctgcccaaatatatcagaagaatcacctatttatggcagctatagacatgaaatgtatttcttaagggtgataagacttaaaagttaaaattaccccttgatctatggactacagactggatgttgtattagcgggcatgaaaacaacattaatctccttgtacatctccatcagagctctggggtgaccaagtgtgttgtcaataaagagtaatatcttcaaagtaatctcattttctgagcagtagttctcaacagtgcacttaaatatttagtaaaccatgctgtaaacagatgtgctgtcatccaggctttaatgtcccacttacagagtgcaggtagaatacatttagtataattctgaagggccctagaatttttgaaatggtaaggaatactggcttcaacttaaagtcatcagctatattaaccctaacaggatggtcagccgtccttcgaaactttgaagccaggcattgactttctggttatgaaagtcccaatggcatcttcctttaatgtaaatgaaaatttgtttaatgtagccaccatcgtcaatgatcttagctagatcttctggataacttgctgtagcttctacatcagcacttgctacttcaccttgcacttttatgttacagagatgacttctattatgcaccctcatgaaccagcctctactagcttccaacttaccttctgcagcttccttacctctccaatgcctgaagtttagatttctctgaacttctgttttctacacagcacatagactagtacctgaagatgtaaagattcctcatagtagctggtgaattaatgaattgattttaaaatatagtgtaacaaaccctagtttatcttaataaaaatcctttgtaagaatagaattatttccaatatttacaaaatatggtagtccatgagattatcaagaagtaggcttagaaaaaaaggatttaataaatttcacaagtgtttaagaaacttcttaccaaaataagctttctatttggcctgtcacattggaattcaaatggcattgaaatacttccagttccctttaaacttcaatgtaaaaattacatttttagtgtttaaaatgaagtatatctgataatggtcttctccaaatctaatctaaatggtagattccttaaactacctcatgcaggcctatttaatttcctcttaaattgtcaaaatctattttttagttgaactcattgtgtagatcactttaacagctttttttctgaaaatatctaatgatgttatacctctatacatactccattaacttaaaaaaatgaatttagaactctaaatgtgtgatttttatgtgtgaaaagattcttacttaggcaaactatattctattatctttaaaatagactgcattatcaattcaaatgtataactgatcaaattagaagagagtgatcaaaaatagtcatataggcaactcctaattaatattagatttaactttctctctacttcagttatgtagaaatagtggtttaaagataatgctacattatcagaagtcaaaatagtttttaaaacatgcctacaggcatatttttcaagtttccttattgttctgaagacatggctgctcaaatctggatcttcaaatatttgaattatcagaaacttcaagattctacacccagacatcaccgtccttataaacaatttatcactttagaattgttgccaaagcctaataaaaactctaatcctctctagagaaggaaccttgattttgtctttttcttctccagtgcagtagttttcagagtgtgttccctgaatcagcatcacctggcaaagtgttagaaagcaaattcttgggcaccagcccagacctactgaatcagaagttctgggagtggcgccctacaatttatgtttgcgaagccccgcaggtgtttctgatgcagtataaagtttgagaaagactatactggccttaggataatatctggcattcacaggttcttttattcatcaactgagcagaattaaatcaaaatgagtaaaataaagtaaatcaggtgcctgatataaggaaccagaaattcctaaaatttagttgcctgaggcagaactacataaacacataatatctcaattttcactgatttccagtttactaattaaaaaaaaatgaggtgatccatttgggtaaaattttttaaaaaactctaacttcacaaaatgtttgacagtctttttaccttttatccatgtctgtcaagcttattaaattgaagataatactaaacagaatgtcatgagtttaaaataatgattttattatccccctgtaaagacataaccatgttttcttcaatactcaaaaatgatagcattgaccctcaatcaatagatgtttcacgtgtgatgaatttgttctactacatctaaagagtccctgtagctactaacagcactcaatagagggtccattagggattcttcatggcacccaactgatacattcattcaaacaactacttagtaagtgcccacaaggtacttaattactgccagacattgaacaggatacaaggcaatgtagggcaattctgttctccaggattctataatgtggcctggaattaaaagtaaagaaaaggaaaagggccacacatttttctcataccatcatgtgccaggcactgaatagagcaggagaaataaactatatcagtaaatccatgttaccactcagggaagttggcttcattcccagattacaaataaggaaacaatagtttgagagatgctgagaacttgttcaaactcatcaggtaagaaacaagggaggtaaaatttaaaatcaaaactgatttttaagtgtccactgtaccttacactatatcagttcttatataaaaaatcagcagcaagtcttagaggaatacaataaatgcctaaatgaatgatgcacattatttgctgtagggcgattagaaaaggagcagtaactgtggatgaggaagtgaagccttcccagtaaaagttcaacacagatcttcattgaaagaaaatggtttgtagcttggataaaggaaagaagtaaatgtattccagatgggaaaaactgttaaacagaaatgtgtagtcaggaacaagaaaggcaggttccagtagagtggcaaaaatcagctcagcacatttagttgccaaataaatgatgtagaatggctttgcttggctctagctatgcatgaaggcacacattttaacaacgaaaggggagtggtgaacagtgccacttagctttacttaagtggtgtatttactgcctgtgtccgtgtacattcagtcaaggttttgaagtgcctgcttcttttggctctaattttgtatatgcattatctttcttcatgtaagtgatcattctgctcctctcctctgcaaccaacaggattagttcactttagccatattatttctcaaaaaaaaaaaaaaaaaaaaaaactcacaggtactctttcatatatttctcaagtccctacagctgaacaagttcttaaaaatatcaggtctctggccgggtgcagtggctcacgcctgtaatcccagcactttgggagtccaaggtgggcggatcaagaggtcaggagttcgagaccagcctggccaacacagtgaaaccccatctctacaaaaaatacaaaaattagctgggcgtggtggcgtgtgcctgtaatcgcagatactcaggaggctgagacaggagaatcacttgaaccctagaggcagaagttgtggtcagccaagattgcacctctgcactccagcctgggcaacagagcaagactctgtctgaaaaaaaacacaaaaaacaaaataacaatatccactctcccaggtacttatttgtagttactataatgtgcctgaaagacacaagttctaccatgagtaattcagtattcattcaacttgaataactacagggttaggagagtcattttgaaaatggttaggattattagttagtgttaagaaaatatttttagatagttatggtaggtaaagtatgtctgaagaaaagatgtatttgattgacttatcctttaacttcagtgaatttttatatctctgtatttattttgaatcaaaatccccaggtacaggtaggagaatttaagacaaaatttcaatagcacctctgttttcctgtcttgttacagtcctctatgtggtaagaaatgtttttgtcatttgctttctgtgaatttcaaagtgatgtcctgtgataaaatagtggttcccctaagatcttttatttaccctgggaatgtcattgatccaaaagaagataataaaatcagcaataaaatagtaaacattctgtatgggatatcacagttttaattgactacagacactcaaatcaatttttcaatctgcatacacatgacaaggtcagcaacatgggaagctgatgttgctttcctttataagagatatatttaagatttgtaatataaacatgaagtatggtactttgtatatctctttatatatctcttaaaaaatggactttaaaactgtagatattaatgacacttcaatgtaatttttaaacaaattttaacaaaaattacttagaaaatattttgcttagttttcttacaggttttttaaaaatagtatatttgatgataatgtgattaaagaatacacaccaatttttttatattatactttaacttctagggtatatgtgcactacgtgcaggtttgttacatatgtatacatgtgccgtgttggtttgctgcacccattaacttgtcatttacattaggcatttattctaatgctatccctccccctgacccccaccccatgacaggccccagtgtgtgatgtttcccgccctgtgtccaagtgttctcattgttgaattcccacctatgagtgagaacatgcggtgtttggttttctgttcttgtgatagtttgctgagaatgatggtttccatcttcatccatgtccctgaaaaggacatgaactcatcctttcttttatggctgcatagtattccatggtgtatatgtgccacattttcttaatccagtctatcaatgatggacatttgggttggttccaagtctttgctattgtgaatagtgccgcaataaacatacgcatgcgtctttatagtagcatgatttatatacttgggtatatacccagtagtgggatggctgggtcaaatggtatttctagttctagatccttgaggaattgccacactgtcttccacaatggttgaactagtttatactcccaccaatagtgtaaaagcgttcctatttctccacatcctctccagcatctgttgtttcctgactttttaatgatcgccattctaactgcacaccaattttttaaataaaatttatttttatcaaaatttcctgtgtactcagaaaaaaagtgccgtacatataaaactaataatgtaatataggaattgcttctctacatctccctacatgctcttcccactctagcgaagcaaccttcaatttttgttttgttttgttttagctacttttggtatttttcaaatattttaaataaaattttcacactgttttttcttgatttcctagatactgatatctattgatatactaagttgcaagatgagaatttaggttgcatatgtcatctctcacatgaagttacccttaccccccttctaatatagttttaacacatttataactaaattcatattcagtattatcatttatatgactgtctttgtttgggttgctataataaaaataccatagactgggtaatttataaacaacgtaagtttattgctcacagttatggaggctaagaagtccaaagtcaaggcaccaacagattgggtgtctggtgagggctccctctctgctttaaagatagcaccttctcactgtgtcctcacatggtgcaagggcaaaaggtgataatcagcttcctcacacctcttttataagggactaatccctttcacaagggctctgttctcatgacctaatcacctcccaaaagccccaccttctcatatggtcactttgatgagtaggttttcatgtaagaattttgagggaacacattcaagccacagtattctactcctggccctccaggatttatgtccttctcacatgtaaaatatatttattccagacgaatagctccaaagtctttttttttcttttcttttttgagatggagtctcattcttttgccctggctggagtgcagtggtgtgatctcggctcttagcaacctctacctccacggttcaagcattctcttgcctcagcctcccaagtagctgggattataagcatgtgccaccacacccaactaatttttgtgtttttagtagagacagggtttcatcacgttggccaggctggtctcgactcctgaccttgtcaagtgatttacttgccttggcctcccaatgtgttagcattataaacgtgaaccaccgcacctagcacccaaagtcttaacttgttccagcattaactgaaaagtctgaagtgcagaatctcatctaaatatcatctaaatcagatatgggtgtgactcaagatgggaattatcctgaggcaaatttgcctctagctgtgagcctgtgaaataaaacaacttatgtgcttccaacatacaatgattggacagacatagaaaacacatttccattccaaaaagaagaaatagaaaggaaaaaaagtggtaacttgtcccaagtccaaaatgtaatgttgcaaacaacattaaatctcaaggctggagaataattcttgagtagatatcctgcctttcaggcacactgggtcaagcatcgggcccccaagtttccaggaagccctgcccacatgggtttgcagaatacaaccagtattgcagctctcacagggtttgcggaatgcaaccagtattgcagctctcacagggtttgcggaatgcaaccagtattgcagctctcacaggttagacttgcatgctgaaggctgtactattctggaatctcaagggtgacctcacccccagagcttcaccagacattgccctaatgggatccctctgtggtggccccactcctgtggctgttcactgcctaggtcctcagactctctggagcttcatttgaaatctagagtcatccgtgcctccacagctcataaattctgtgcatctacacctgtggagatggcactgtgcagatgccatcattgtttaccatctgtaccttgcagagaggcagcccaagctgtacctgggcccacatgagcaacagtaagacagggcaaggagtgctgttccagaatggggagagcagagacttaaaatttttctgttcccaaggtcctggatttctaagcttatgatgggagtggccagcccgatgatctctgagatgcatttgtggagttcttctgtccattggcttgatgaataagagcccctggcttccaccaatccatagtaaccttatcaaatacaaacagtggaatggtcacatccttggtgttctctatttttcatttgcaacattgccaggctgagaattttccagatctttttctgcttccattttgattataattttttctttaatttgtttctctcttcttacattttactataagcaatttagagaagccatgctacatcctcagtacttccaccaaatatcctatttcagtgcttgtaagtttcaccttccacgaaaccctgggacacgattcagtcaagttccttgtcacttaataacaagaatcacctttcctcaagtttccaatgacatgtttctcatttctatctgagacctcatcagaatgacctttatcatacacatttcaatcaatattctgatcacaaccatttaggtaatctctaaaaagattgaggccttccctacagttctcttcttcagagccctcaaaataaccccattttatggtaaattcatagctttttctagcacgtaccttcagattctcccaggttctgcccattacccagttccaaatctgctccacattttaagttatttgttatagcagcaccccagttttgggtaccaaattctgtgtttgtcagtttgggctgctgtaacaagatactttagaatgggtaatttataaacaatgtaaatttattgctcacaattatggagactgagaagttcaagatcaaggtgccaacagattccgtgtctgatgaggactccctttctactttaaattggtgccttcttactgcatcctcacatggtagaagggcaaaatttgataaccagatccctcacatttgtttataagttcactaatcctactcatgacggttatgctcacatgacctaatcacttcccaaagggcccatcttctaataccagcaccttcatgactaggtttcaacacaggaattttggagggatacaaacattcagatcatagcaatagccatctaaacatttttttctagtttcagggaggatctgactgataattcaatgtgtactttcattcaatcatattaattttttgttcagcaccataccgaagtatccacatatccattgattccaaattgctttaccacctgtactttgcagagggaatatggaactaaggaatatacagatagttttgtgtggtactaaacaacaacaccaccacaccacaccacacacacacacacacacacacacacacacacacacacacaaatctcatctttaaaaaaaaaacaaacttcagagtaagatttttttgtttctgctccaaaagtgtgtataaaaaacctgcaatagatcaaagtccttacctcttcatctagtggtaactttttccctttgaactctgagaatgacaccagtattggtggttttaatttctgttgccctctttggatgagcatatttacaactactgaagttcaaacttgtcacattgactttgcatttattttttatattatcttttaaattggcatagtttagaatgcctaatggtttcattctttatatttatgtcataatttgttacctaaattaaaataaaatgtttcaagaaagggaactaacacttttgttttttattaaaataaaaagaaacaacaaactgtattgtctttatatagacttcttgtttataaccttgatatttctagaacttaatatagatttctatattttattaaactacatctcaaaagccactattgatttctataaattgacatagccattgacttaataaagaggacttaattcagctctgcaggaaaatcttattctttatccaagatttgctgtcttttcaacttcattcagaaatttggcagattggataacccttgacattttggtgaaccacctgacaatttcaattatagtttgaatttcaaacagcaaatatttgaggtgtttcagattccaaatcatatccaactctcaaccctaaaaatgtccttttcttggctctcaataacattttttccatttgaaatgtttcctttttaagtttcttagtcatattcaaagctaaagataaggatttttgaacagtgtcaacttttattaggacagagagaaaatacacaatttagcaatatgacctacgctatttcctagctttagagctagatcatcctttaactaattatttttcttttgtgttactgttttaatcataattcatattggatgttttgggtctttgacataattcttttcattagatttgcagatacctttattcataaagcaagtttaagtaaaagaaagttaaggtataattttcaatataatataaatatgatttagaatttttgaaaattatttgtgatttctatggcttacagtagataatctacaaaataatttgaagaatatttagaaattaatcttaatttatctcagaaattttattagttctgagaatgatctggcataattgcaagtattaaaaatttcagataaagttgattatgcatttttaatagtgtacatgcaaaataaaatttaataaaattagaaggatgaagaagcacgtgttttatttttaatggagatttttattcatttttagcacaaaaaatagcaaaactctagatagtctttgcaataatgtactggtagtatgtatgatgaaaaaccatacctggaaagaatgtaaccatgttaaaggatcagttggtaagaaatgttgctttcctgcttcttactactctgtatatcagaatctgaactgccatagcaagctgtcttcctctttgctcacatacctaacttctaaaatgttgagagagattctttatggcccttataaatagaaacattaatttgttgaacgtaattgaacccacaaaatgatttttaaattatatgtaattttaatttgcaacacttatacaaatataattttaacaaatttactctaaatatattttatacaaattataaattgtgcacagagccattattacatatctttatttctttatcactaagtgttgttttaaaaaaaatcttacctttggaataatactgaaaatagcaataaacatttatttttctttttgtcacatcaagatttgtctaattctctcccatgtgtcccaaattgcttttatccaagcccaatctgccctgccatatcaattattattgtcaagtaatatgtaactatcttcataacagtatcaatctctgcttttaatttactcaaaattcatttcaagcatattttatttatcaaaaacatttcaagaaaattttatctctgcaatatgttctggaaaatgccaaccataaattgcttgctcattatacccataatatcttctatctatttctatatgaccattcattgttctttttacaccttcacaatatctctttctaacaacaatattctgccctttatattctacatttgaagacttgatggtgattggataatgttccattttattttcactggggcttatgtcttatgtccccttacagacataaccatgattctagaagacaggaacagtaatttacctagagaggaactgaatccataaccttactaacactttgcttttttaacaaaatggggcaaccagcaactgaaatcattccatttaaaataatttcacacctcaccgaaagaacttgaaaaatgaagccttacaataggccaatattctatttttaggaaaatagatagccttctctaacaaatacatttttctcttaaatccttacattagaaacttgaatgataaacacttcagtgaatagtttacaacttatagtgtaagatacaagattttattcctaaaagcaaaggatgggtaggtcttaagaaaggagatttcagaccaggcactgtggctcacgcctgtaatcccagcactttggaaggccaaggtgggcagattacctaaggtcaggagttcaagaccagcctggccaacacgtggaaaggcaaaacccattgctactaaaaatacaaaaaatagccagcatggtggcaggtgcctctaatcccagctactcgggaggctgaggcaggagaattgcttgaacctgggaggcagaggttgcagtgagccaagactgtgccattgcactccagcctgggcaacaagagcaaaactccatctcaaaaaaaaaaaaaaaaaaaaaaaagagatttctgttgattttaaaattatcctgagctaaccacactgtcatactgcaaatcagggtgaaatgtgtccataagaacaagcctgccgaactaaggtattgcctgccttatctcatgagataattatttgttctgtagtggggtgcatatatttttaaaatgtgttacaccaatgtgtctacaaaagaaacaaatgaaaagcaaaacaacaacaaaaagatcacatcatttcaacaattgtggtgatcaaaaccacagaatatttacttcaagtatgtccttgtccttaattagcacaagaattagtgctaccagaatactcttaaagactctcttctaataattctatcatcaagtcatcttggaaggaaagcttttaaagccagtcagccagcctgcttaatgactgtttctgtagaggaatacaagtagctcccagaattacagttgtcagcccatctccttgggtctgaaggagaccgagggatcattatcaaatagatcatttgatatggtttggctgtgtccccacccaaatctcatcttgaattgtagttcccataatccccacgtgtcatgggagagacccggtgggaggtaattgaatcatggggtcaattacccccatgctgctgttctcatgatagtgagtgagttcttacgagatctgatggttttataggggcttttgccccttttgctctgcacttcttcctgccaccatgtgaagaaggacgtgtttgcttccccttctgccatgattgtaagtttcctgaggcctccccagccacactgaactgtgattcaattaaacctctttcctttgtaaattacccagtctcaagtatgtccttagagcagcatgagtatggactaatatatccttatttgctcttttccttttgtattctgacatgagtaaactgtgaaattgtgctaaatagagatgtatgctaactgtgaaacactgataattatttcagtaaactatgatacatataagagatttaaaacgggtatatgcttctttaaaatagacgaagaaagtcttggcatacatctccaggataccccctgaattataggccacaattgtacctcacagcatttatggcctcaactctagtaacagaaacacaccttagtcctattctgtagttcctaataaagattgattctcaaaataaaaactgactaaagggcagaaatacatacagtaatcttcaagaattttttctctttatctgcctggagttagttgaagcaagctttgacaagtcatttatttaacagtttagcggaactcattcctactcttgaacctggaatggaatgtaagaaataaagagcagtggaatccaatgatgtatttcaggatataattggttgtctatactcaaggctgatcttatcacttgagatgaaaaaagaaaaacaaaacatggtagtggaaaaaagtttatgtttacaaaccctgaaaacttaattcttgtaaataacatcaccacaaatagaaaatatgtgtcatcaaactaatttgtgcaaagctataatttgtgtagcaatgattgaagtataaatataacactttagtgtgttttaaggagtttttttcagatatgctattttctctttacaataggcttgaaaatatagtatttttttctaaaacaagccttttgtctttccttctatggaaagatgcatgtctttagttatttctgctggactattatgtgtggactggcaggtattggcatacttttcataatcctaataagtatccggtgtagccagtctgaaagctcatttagaacaggacaaactctgtcttgcttgttgaaacaactccagtacctagcaatgtgtctggtacattcttcaggtgctcaacaaggcagaatggctttgtttattaattaaataatatagactcaaatccattcagtccctgaccaggactcttcataaaacagtggatctcaaaatcattccctgaacctacaatattgcatcaactgagaactcgttagaaattaaaattttcagaccccatgccagaccttctaaatcagaaactattggggtaggcccagcaatctgtgtttaaaaagccctccaggtgattataacgtatgctaaacttgagcaccattgatgtaaacaatactcaaatacattgtgcacagctttttagaattatgagagtggcttaagggtatattacaagaagacaattcctatggacagattgtgaataattttaatttctcaagaattttgttctaatttttttatgtataggatagttggaacgtatgttctacttcttacaagtatctttattttaactataggactactcccctcatgtaacaaattgtgtaatttgtataggaaggctgactcagtttgagttactggtacagatactgagacaaggagttgaatgcagatggcttattaaggaggtgttcccaggaagcacaagtgaggaagtggtgaacatgagagagggtaaggagaaaagccagtcaagcatgtgttaacaagaaagggttacaactgtgggcaaataggtctcaatcctgtggagaaccatctgagaaagcatgtgtggaatatatctcagaatcacccagtggagagtggagagactgaaacatttatgtacttacttccagctccactgtttgagagttgatctccagtggttctaacatatgccatattccaggttatatttgtgtatggccaaataagctggacaacgtcatcaggcagagaagatgagacacagcacttgaggtgggacatgtcaatacactggaaggttgaattgtcactgccttgagaatggaagaagagcagaactgactatatacagaaaaagaatgagggtcagctttaactaggggttagaagccatgaatttgcaataacaccaaagcacccagttgtgtgttccatttctaggaaaggtagaacagtgaattctaagacatataaatggcattcagagtaactctaattgttttataggaagtatgcaatcataaacgctgacagataagcatacatgtaaaatttttaagaaaggttatgatcactaaaatatagcagatgacttcgaatgttcttgctttatgtgatcacaaatgggctcctttgtcgaattctagaattctgctctgcaagtgacattttgtttgagcagttggcatctggtacctcagtttcaactgactttttgttactaaacacagttcgaacaccgtaaggtaatttttcaatggtaagaaaaggtagtttatacttcatcctagtgaaataactcaggcagggaagtcaattgcttggaattatggaaagtttccatgctatcaagcccaacaccatttgaaaacattttttacagtaggccacaaagctgcctttttatggaagaaactatgaaagaaattttagaaaccccagaaagctccaaggtcctgttctgattcagtaaaaatttcaaagactatacctcctgagcttactttgagaatgacaaaacacaagtagcttaggaagacggacatggaaattcaccttttgcatttccctgcattttcttttggatattttgcacagaaaaacaataaaaccttttgatttttgttttcctgtgaagtcttttaattttagtagaatcatcaacattttatgccactcttaaaattctagaaagcaaaatccccatgtaatactggaaaagtccaaggataacagaaatattgaactaggactgttttttaatgagaaataattagcctccatagtagcttcatcaacgatgagctacttataacagtatactaccaagctacacaaagactttcattagtgtaagaacagtagtagactaattaactgtctaactacagaaactagatgcttaattgccatgttgctttattggcacagtatctaagaatcgtcgtccaatttctcctctagaagcttttttgttttcctcctctggtggcaatgggaagtttcgttgtgatgaaagaacagtaacagataactgtttctctggttaagtgtcaggtgcaaatacttctctggttaaacatcaggaatatacatgtgtatgtgactgtatgtgtgtgtgtacatgaaatgtttaatcagttaaccagtgtagcaaatttctctcattctgaaaagaatatgaaaagtaagtcttactaaaggaaaagcacattttcttataccactttaaggcaaatagtcatggaatcacctgtattgttcaaagtcttctatggtttagtctctttctctatcagttatacaatggatgcacgtaagttaacacagtggagtataaataaataaaagtctagtgtatcccacaaaatgttctgcaacattcagtttaactgtaattctaattttgaaaactacataacaggttctgcaacttagaagcagagggctatgagaaaattttgtagaacatatctttactaattattaactcttgcatccactcctgtttcgctttatgatttgggtgagttactttaactttttgttcctcagtttcttcatatttaaaatgcacatagttgtagtgtttgcatgataaggatgttgtgataattaaatgagttattatctacgtgtgtgtgtgtatataaaaacacatagtgtcatacatagtaagcactcaacaaatattagcttatactattattattaatgacatactgtaaatagcattcaataagcatttactggacagaataaatgttgtcaaacatgaccatttatgagtactgtcaaaagtattacagtaacttgagtgatttttgaacacatgtaatgttccagatgctttagatacatttagccatttagtcctcactatgcctccatgaagaaaatgtcattcagctcatcaggaacctgagactcagagtatgtaacataccttgttacagttaaggaggcccagcatttgaattcaagcccatttactcaactttcattttatttttctagtatcagatagtctccaagtcctgaggtatttggctttgcagattttgaatttaatatttctatacttaattactatataaatagttaagatcttctcacttgagaaaatgtaaattgattcattttctgatttaattttttaattaaaattttttctaatgacttcctttttatatgagcttatcaaatagtttagtcctaggtgaggtatggatatccacagatgtataaggacgagttagggctatatggttctcttatttccgcaagcaacatttaggaaaaaaaatctgacccattcctagcaatccattttattgaaaccctactatgtgtcactcactgtaaagggatagaccagtgaccaaaatgaagtccttactaccatgaagcttattctacagcacagaaagagatggtaaataagtgactctgtgtgtgtttatttgtctcaggtgggataaatgctctaaagaataggacaaaagtaacagagactcatgggggagcaataatggatgatcatagaagtcatgcctgatgaagtcacatgcagagacctaaatgaaatgaaggagggagctatgtgtgtgtctctaatggaagagcaatccaggaggcaacataaggacaaaggctgaactatactagaggaccagcaggaaagtgattacagctgaaccagagggactaaggggttatataaaatacgtacaacatggccctcacagccacttacatagttatctacgatttcattaaggctgggatagaggttggctcagagtgtcaggcaagcataagggttgggataatactgcctggagttagagaggtaggatgggaagggtttgacattttgttcacaatttgagttatgagaaacactttgtcaaacagagaaactgagaagaggtcaaaaggaacaaagcaaagcatgaaagtccacagctgtggagagctcatatattgcatttagacgtgatgaatagacttgaaaaactttattttttctttattggcttcaagatagcaagaaagccttagttcataaatcctagcaattaagtgccaatttacccccaaatcattttaagcgttgatcaaaatccaactaagaactcatattcatttgtttgcctgtcatacttaagaattaatttactctgccaagggtcatttagctattaaaaaataatagctacaagaaaataaatattttagtgtaatttcctgatggtgccaaaagttaccatattagcatatggtaaaataggcaagggatgaggggtccttcaacaaacaccgcttttcctaatgttttggcataatgcaccttaaatcaccacagcaaacgcccaggaaaaccccaatgccagcagaaactcacagagaattaaagacagtaacacagtggtttctgacactggcaatgatttttaaatctttattctcatgaggtaaagtactgaaatcatgaatttgcttttaatcactgttcaatctttgttcaataatatagaacacaggaaagttggtctatgccacatgatgaatgcagtctatctcttgcattacacattaagaagcagagcaggtagcacagtgttggctaagtctcagcggtggcatattttcatctcccacagggtgtgggaagaccccactgcacagcagtaacaataaatctagcatatccgtttatgaaataactttggcagtaatggcaagaggatttggatgaaagtgtatttgtggtcttccagctggaagatcagagcagagattctaaagcaaaaaagcagagtggaatggcagatagtggctgcttggaaaagaacagaagacagttgaggatccatgctgagctcaaggggaaatgcaaacaagacagtcctttcagaatatccccatgctgcccagtgttggcgtgagggattactaatgccatctgctggatattcttgggatttaaaaatggtatctaaacaaataatactccagtctccctatgtcttggcttcagttctttaatgagaaaaacagcaacaataaccagctaaagaaaacaagtgaagaaaacaaaactcaggtcatgtacatgtttcctgtaccttgagaaggttggagtttcgtatggccactgtgtttcagacatagtatttataataattgcatttttttggttggtgtttgtttgtttagttttagcagaactctatagtagtgcactttggccatatgcaacactcaggcaactggatatagtttgaactgtaaatccacaaagcccttgctaaaaatatattatacactataaactttgtatactacatactcccttttgttggagagaacattgtggttttattttgtctattttgtttttaaatagggataaaaataattaaaaggaaagaagcacaagtatcaccatttggtcaaaaacattacataggccgggtgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggtggagcttgcagtgagccgagatcgcgccactgcactccagcctgggcgacagagcgagactccgtctcaaaacaaacaaacaaacaaacaaacaaaaaaacattacatatacatttgtgtcatataaaatacagtaagtcatcttttgtttttgttttgtggaaatattttcctctgtcgtgctctctgtaggtttattgtgggattgcaatttaaaatgacaaaattccttctggtatttcagtaaaattttagaacctttagaaatgtgtggctaaattaacattgattatagtctacatgttccaaaccgtactaatcccatgagacttgcagtggaaaaaaatggtttctgtggtcaaatccatctgaaatattctataatccaaatatcttctcctagagatcaataaggcacatgaactgaaatgtgaggagctgatatttactgacagtttaccatataccattatctcatttaatgttcattctgattctattgtgtgggcactatcattattcttactgacaaaaaaggaaacaggtttataatttgttcaaagtcacactcagaaaataaaggtactaaatctgactttagagattgcactcacaagcacaaagctatatgttccataatatcaatcagtgaaatagtatatattaatatgatttttatgttaattatatttctatattcatgttaacctgtttaaagctttgaggaataatgtggtaatagcatctgtttaactttgcttagcccaatatttctaaatctacttagctacagaaaactcattacttttagtggaactagtgtcctacagaatatagttccaaaaatgctgatataagtaagctataatattgctatagatgagaagccagaaagggagtagctctttagtgtttctctagccacttgttccagcgtatctgctggtgtcctctgcctatgcatgccccttgctgatctccacctgatgatttggaagggctagaaatagggaagcaaacacctgatatctttgctgctacaggtgcacagagcactggaactctctgcgtaaatgtgtaatatttagtacatcctgcaaaaggaacaagcttaatttagttaagccacaaggttgagtgataaacagcatgttgctgttattgtttagtcaattaaatcgtcccctgcacttgtaggaactgttccacatttattactagtgagaaacaagctcgggcagggttgttgatttccttgcattgggttgtgttatatttagcacatctaaagatttgagaatgaatgatggaagacacagtgataaattgtcgagcttttccaaagattcagaagttctaaagttcctgccagtgacagatggtctgtccttactcattgcttgtcttcctgacaggacttgatttttttttttccttttttgctcaattcccttatagtaagctcagcttcttgggaggtgggatagtttaatttgttataattacattgctatatttcaaagtggcatcaactctatatgaacatgtcatgctctttttagattattaatgtgcacatgtataatgacaaaagagaattataggataagaggaagagaggaaattcattaccaagggaaagccatacctcaatctttcctgttattttgataaccaagcatattattaaatagagtcctcattggatagtggttttttaaaatcaatattattttaataccttcaatattttataataatcgaaaactttttgaaatttttgtttaaacagcactagtgtttatgagcttgtaaaatatttctaagaattcacacaatgagcccaaacaactataataatgatgtgcctagatattaaacaggttccaaatgaaaaaaggaaaattgcaatcaaatttcttaattcctttcattgatttcaaatacgttcactgctaaaataggagattagaagatatgctaaatagataaggaatgtgggaaaagaaaacaatttcctgtggcagtaaatataaaggctttaaaaattctagcttgtcttcaaataacttctaaaatccagaagtaatttagccctcaagttagtaatgccactagtgtgatagagcattatatagctgcaagtgttaccaagtggaaagagatcaacattatttaaaactataaaaacaatcaggtgaattgatttgggatttataatagttgtcttctgttatctacacaaagagctcagaaattctttttaggtaaattatttttttgtaagtgctcactccatattagctcaatttgataatacatgagaagcataaacaatattatcactgctttttctcctttatttcctttaattctacttctactggagttttaaccactttgaagtgatatgcatataagtgcatatatgtttcactgaatatatatatatcatactactatacattcttttttgtgtgtgtgtgtatgtgtgtgtataatacactactcatttaagtgagagaactcaaagcttactggatttccaaggtctaggctattgaattccattttatctttttattccccttactaaatgctcctaccattactgatatcagttacctttttattcagtggctttttaacattgctttattttggtaacatttgattacaaaatctcagagaactcatgccagcccactggttatgcatgaagatgttaacctagacctagggaaattataacccttgtttagtgaatattttctcagataataaatggaagaattaactttctgtgtagaacattacaaaaaatttcaagcttctttaacacatgatgtcacaataatacatggattttagttgtgtatattacatatacattgatatataattaaaaagacaagacatatctgtttttttattcttaaggaccattctagtataattcgtttttcttctccagataaaaatgtgtttgtaaaaaagattctaaatattcaatatttttgaaaaggccaagaaatattgcataattttgaaatcatgccattataaaatcacagaattaaaagttactctagtgagtatgtttattaaaatttattaagattagaaaaagtgcatagctgaagttaataaaaatgctttgcattaaagataagatgggctaaattagtctaacaagtagacccaaaatgtaatattctactactaaagatttgtttcatgtcagctcagcactacagcatagagtaggaaaggggagtctgctccatgcactggagctactgtggcttccaaggtctctaggcgtgacgtcacaatcctactaagctggaatggacagagagcagacacaagcacatgggaggttttatgagtcaggtttgaaagtggcgtacatcactcggctcacattctattggcttagaactcagtcacatggccttgtaataccctgcagtggaggatgggaaatgtagtctagctgagtgtcccagcagaaggagagaatggattttgatgatcatctagcagtttctaccacatgaacccttgactttgcttaaaaattgaggtgactttaaatgattatgctattaatatagtctagtttttctgataaactttgtatccactcacttgtttgtagggcagggtattttttaaattcatttagtaacctaaattggagactaagtttgaggactaatgattttagaatagttggtccaatagaactcgtaggagacctgttaacttgaggacccaaaagagattcagatagactctttcttaaaaatgcacattaagacatacaggactcatactgaaggttcacagatacttagtacttgcctatggtgaagagcactcaatttagaacatgaagatagatgatttatttatttatctgtagtaatgtgctaatgtttgcttgtaacaaatttatactgctaaaatatcttagatgttaatactcatgaataaaaccaaagaccagaaggagagactatctccttgctgaccctaagcaacagaggatagtacagtgagtagaatcatggctttagacaacatgtttgtctttcttcttcactgaaatacaggatttgtgcctcaatattatttcttgcttttgcctaacatactttaagatgaagagccatgggtaaatctcatggtctagataagttaccaacaagttatcatcataactcttaccttctacttagtccataaatgctgttgcacaaaacaacttctcatttagtaatttctacaggtgatgcagagtgcttatagtttaaattttgccttatctgattacatagcgaagattattatttagcttcaaatgaggataacttaagctaaatagaatcactgtactactattgcttcagaagtattttacatccatgctgcctatctattggtattcacttctttttctctgaattctatttacatattttagtagtggtttacccccttgtacaacatatttctctttattttacccagaaacccactttccttatatcttagtttctagtttgaagtctttttaatctaatggagtctcacgtattttctgttactttttattgttaataaatttttcattatttgtctcttagatgtttaaagtaaaacaatcagaaaatttgaaataaggattaccattactggtataaagtgttttttttttatttttttttagctaaaactgaaaactgccataggttatgttttaattattaagtttcacctataagtggagtatacatatatttcaaaaatgataataatagtccctggagtgtgatggtccccttcccgtgtccatgtgttctcattgtttaattcccacctatgagtaagaacatgtggtgtttggttttttgtccttgcgatagtttgctgagaatgatggtttccagtttcatccatgtccctacaaaggacatgaactcttcattttttatagctgcatagtattccatggtgtatatgtgccacatttgcttaatccagtctatcgttgttagacatttaggttggttccaagtctttgctattgtgaatagtgccgcgataaacatacgtgtgcatgtgtctttatagcagcatgatttataatcctttgggtatatacccagtaatgggatggctgggtcaaatggtatttctagttctagacccctaaggaatcgccacactgacttccacaatggttgaactagttgacagtcccaccaacagtgtaaaagtgttcctatttctccacatcctctccagcacctgttgtttcctgactttttaatgatcgccattctaactgctgtgagatggtatctcattgtggttttgatttgcatttctctgatggccagtgatgatgagcatttgttcacgtgttttttggctgcataaatgtcttattttgagaagtgtctgttcatatccttcgctcacttcacaccagcatggcatgtgtatacatatgtaacaaacctgcacattgtgcacatgtaacctaaaacttaaagtataataataataaaataaaattaaaaatgataataataataaagcttagaagtagataacatatcctcaattatctgatcatgtactatctctacacctcaataaagtcacagggaacaatgtgatgtataatggaatagtatgaaacttgtaccaagtgttaaaaaacaaagattctgcaactaattacgtactttgaaaaaacattgagtcacataccaaatatatttccaattttattttttgtgatgcaatgcacctcttagcaggtgtttctcggtagaacaaagaatagccaacaaaatgcaattcaccttctataacaactccttgatagttatttgaaagcatcttcatttgaaacccaatcgctgagtattattgctaaaaacaacagaatgacctcttacaaaagagtctcacttattatatgcccatgccatgcataaatcagaagaacgtgtcttagaatatgtatgataagatttattagcgtagaaaccttcatatagaaactgcccctactacacacacacacacacacacacacacacacacacacacgcatgcacacatctgaggcttacttctttggcctaagccaagaatcatttagaataaatgtatctgaagttagtcaaacaaagagtgctacccatatatttttattcttccttttaaatatattttatttcttttcatcttattagcaatctaaaagctactaaaatttcctacccatgctttaatgctagtatgttgcctatcacttttggtatttaactttcagataattttagaatagatcaccttagaatacacgttacaaacattttcaggagaatacagagcagtttacttagtcaaaacagtagaaagcatatacacagagaagtagcagcagataagaatattaagttagagccagattgtagaagctatgtactttgatatttattaggtagatgataaaaagacatcaaagtttatttcgagtagggaatgtgatttgaaattttaactccactctccactctcagttaaatcacaaaacagtgtattttatttatgtatttttttctgttgaaacccatggttttctaggttttgatgaattatgttttcaaatataattagcaagtctacagtgcatctatatgtatgtcaaatgcaaatgcatctacagtgttttgctaataatttttccatcttcaattgagtaacaaagacctttctaacatacgattcattttttgtcatttgcaaagtatattcatttagttgggtttgttttgcatgattaattttgactgatagctgatttgttttctattctaggttgtggagactaatttggttgcttttgactgtcactggatcattataaatgaggtaaagccaactaaaccttattgttaactctgtgtccttttttcacatatataattgtagcatttccaatggccttgaatttttaagcggaaacaaaacttgaagtaaacattcaacttactgagtgaatgctgtttaacaaagatagaatgaagagtttttaaaaatgataaagggttttatattaataaaataaatggagaaagtctttctcactgagtctcttttagctctttctgttggctcattctgcctgctcaaggagatcatctttataaaaagtacagttctactttgtaagcaaagtaaactcctcccagtggagtgcttgtgttccatttatattttaatgttgtttctagaactgttatgtccaccctccttacatgagtattaaaaagttcagcatatgaatatgaataaacacagaacagatttttcccttttcataaggaagtacaactgttttcaaatctttagacttgtcaaattcttgtgaaagtcttttgatttttgcaaagataatacataagattaaaaatatattacaacctaaaagccctgggaaataagttgttccattaggacctgccagtcagaaatggaaggaacaatgagcaggtcagtcatggacaaataatgtgatcacatacatttttcctcaacaagatgtagtacttggtcatacctattatttatgaataaaaataatgtaatatttacttattcattatactaaatacagaattctagaataataagatttcttttagggacaaaatagtatttttggataagaatcctggttttatagtcagcaagataggtttgatcctggctataaaacttggtagctgtcttaacatggatatcagcttcctgtgcctcagtttattcatttggacaagtataataacaattactttgcatgttcataataaaagttaaatgaggtattatcaggtgctcttaacacagtgcttgacaaatgacacacaagaatggtactgcgataatgatcatatcacgttaaaattcagagatcattcccttatatattatcttatggaatactaaaccatattctctgaagtactgagggaatgaggtccatagagaataaattattttcctctttttacacagaaaagtgaaaataattcccagtttcaagttgtttctcctacactacacttcaatgatggaatgatcctttttatttcagagtaaagacgctgaaaacaccttacaagtctgtttttggtctgccaaacattaggtttctatgaattttagctgtatttctcatgtcaaaataagataggtttttctgagatttcctcaggcaatacgtatctggaggtctgcttttcaataaagttctggtaccttctaagtttctagtatgtcttaattttcatgtggaataactaaacgttgggatagagggaaagacaaaggaaaaggaacttaataaaccttcaaattaaatattttcatttcaatttttctccaaggaaactaagtttcaaagaaattaaacaattcagcaaatattacacaactattagtgatgataatggaatttaaaacttaatctttttcagtgtaaagctttggttggttttgttttgtttttgttttgtttttagcttttaagttcaggggtacgtgagcaagtttgtatgtaggtaaactcgtgtcatgggggtttattgtacagattactttgtcacccaggcattaagcctagtgctcattagttatttttcctgttccttttcttcttcctactctcttcccttcagtagaccccgaagtgtgttgttcccctctttgtgtccatatgttttcatcatttagctcccatttataagtgagaacatgaggtatttggttttctgtttctgcgttagttcgctgaggaaaatggcttccagctccattcatatttctgcgaaggacatatcattccttttttgtgattgcacagtattccacaatgtatatgtgccacattttctttatccagtgtactgttggtgggtatttatgttgattccatgtcattcctattgtgaatagtgatgcaatggacataggcatgcatgtgtctttatgataaaacaatttatattcatttgggtatatacccagtaatgggattgctgggtgaaatggtagttctgcttttaggtctctgaggaaatcaccaaactcttttccacaatgattgaacaaatttacactcccaccaccaacaatgtataaacattcctttttcttcacaaccatgccagcatctgttattttttgactttttaataatagccattatgactggtgtgagatggtatctcatagtggttttgatttggatttctctaatgatcagcgatgttgagctttctttcatatgattattgatcatatgatgtattattttgaaaagtgtctgttgatgtcctttgcccacttttaaatggggttgtttggttttgctttaaatttgcttaagtttcttgtagaacttaaggataaatagacctttgacagatgcatagtttgcaaaaattttctcccattctgtaggttgttcactctgatgatagtttcttttgctgtgcataagctcgttagtttaattcaattttgtttgtcgatttttgcttttgttgcaattgcttttgtcatctttgtcatgaaatatttgcccatttatatgtctaggttgttttccagggtttttatagttatgggttttacatttaaggttttaatccatcttgtgttaatttttgtatatggtataataaaatggtccagtttcaatcttctgcatatggcttgccagttatcccagcaatcatttattattaaaggaaagcgtcctttccccattgcttattgttgtcagctttctcaaagatcaggtagttgcaggtatgcagccttatatctgggcaatctgttctgctgcattcatctatgtgtctgtttttgtaccagtatcatgctgttttggttagtgtagcactgtagtatagtttgaagtcaggtagcatgatgtctccagctttgttcttttcccttaggattttgttttttgatacatgctttttgatacattttcacttagaattttgtttttgaccatgagaacaacatgatcacccactgtttaaggctcaatttgtactttgggagaaatagcctcttcatattatataggtgtaacctgaatagactagcatgtatttaattggtaataaataaatattttttgataattatctttatggtttatatttttgaaatttctactgcctcagttataatctgatgggagctatttatgtcactagcttttttgtattaattattttctagattactttttttgaaataaggattcttctaattttttgtttttatttcacatcctactttggacaggatatagactacacagatttcctgatgcaaaaccagcgagagtcattttacctattcatgtcaatcaaccttactagaaaaataaagtgacttcttacctctttagagaaatggattaatctggacaaattaatgcttacaatcactaaattgaaatggccattctcctgtattggttgataagattgcagaaggaaccccttaattaattttttttaatatccaatttagcttccacaagtatacctgaacttaaaagtataaactgaaatagagcttctgagaacaacatggtcatttacccactgtttaagactcaatttgtactttggaagaaatggcatcttcatattgtataggtgtagcctgaatagactagcatgtatttcattggtaataaatagtatggaaaaaataataaaaatttatgttttattgtatttttcataagcattatgattcatgtttttaaacttattaaattttatttcataaaatattacaaatgaaaatattgtcattaagtggatgctccataatttgggccactattttgcaaaataaaacatccatataaacaaagcaatctcactggtaaataactcaatacatgttagaagtctaggagataattaaggagacctcaattattttcttatccttcaaacttaggttttctactgtgaattgtctaataaaacttcaccatcaccatcattgaaaccgttatctctttcttacccacagccctactttcttgtcttccagcagaggtataatttcttttgggcaagccacactgcctagcctcttaaaaatacaatgttcacaacccataccatttacattacacaggttagcacttttatctgaacaaggttaaaactcagataatgagcaaatgttttctgtattttaacccataaaaaaataaacaaaaaccattattggctggtatatccaaaatcaacactcttactttcaaattattccattcacccgcatacttattctcattcatccactttattctgaaatatgcctcagaaaatgacttacatttttcttgcacacttttcatttacatgcttgtttatgggaatttataatggatgaattataattttccctagtttctataaaagaaaaaaaaaacatggatttctcaatattgctaggaagctactaaactctaaatgtaataataaaaaaaaccctcaaaagatgcaaatgcccgttttggctgaacgtggagaacatgaatctgtctagttttgtttgtgtagctattattttgttgctaattttaaaatgggttgcagacattgatttaatcttattgcatcaatagtttttaaaggagggaatataaatcaaagttggcattgtgcatcatgatagaaattaatgtagaaacttgaaaacaatatatttttttcatttgcattaagtgtgctataataatgagaggctgtgctagctcatatggtgtaatcaatcatatgttagtacttggtaatagtatttatcttctccccgcaatcagtggatccagctcagagcagcctttccgtgcaagtattgtcatcccttcagggccctgaagcagatggcttaacactttatttaagttttacaaaagttagaaattcagataggaagacgtgcactgttcagagctgcaagaagcacaatgcttcatatacccttctattgcctgataatatcaaatatgacctttgttgtcttgattgactttactggctttttacttaatttgaatagtgtaagacattattctctgttaatcactgctgagtattacatttaatgagaaagttgttggtttggttttttgttgttttttttttcttttttgacagagttttactcttgtcacccagactggagtacaatggcgcgatcttggctcactgcaacctcttcctcctgggttcaagcgattgtcctgcctcagtctcccaagtagctgggattacagggatgtgccaccacgcctggctaatttttgtatttttagtagaaatggggtttcaccatgttggccaggctggtctcgaactcctgacctcaggtgatctgcccaactcagcctcccaaagtgttgggtttacaggcgtgagccaccgtgcctggccagtttggggggttttgttgttgttttgagatttaaaaagcctatatgtgtaatggatgtttttaattttttctagtttaatgatgaattgaactgctcacttctaagctttcaagtagaaagttgccatcctgcttctcttcctgttggtacatagcctacagttggatttgttccattttttaacatttgcctaattgattcatattaatgttaaattttatggaagcatcaaagggtcatctttgctaaaatatgaaaaatacaaacaaataagaaacaaacaccacatagtagagggcttaatcttaatactaaaatcttctttatttagaattgtttaacattttaaagtattctggtgtctagaattaaaatttcaggtataagtctttagaagatgataaaatcttaccattcattcattaaataaattttgtatttatcaacatttattgaatacctactataagccaaaatatttgttagatgctaagaggtataagaatgggaaaaaggaaactattcctctgaaattgttatttttagtctaaattggcatctgatccaatggattttgagagtcttttcttcccacaatcttattcatttcaacctaaagctgatatactacaaggattcagaaatgattcaattctcctaagagatttcttctgggaaatggctgtttctagatggagttgtatccccagaagatattttagcattccttttttcttcctcggggctttcacagttcaggattcaaccgacattaaattattaaagcaaagtgaataagaatattttgtcggacatattgactttgattcttagtagttttcaagtatctaggtaaattatttttgggaaaaaaggcttccttagcctaaataagtaaaatagaaaagttaagtcgctaaaaaatacttaatcatttgttattgcaatgttaattctacttttatgaatatactcaataaaataaagaatataagaaggaaaataattttataatttgggttctttaaattacttagagctcaggaatactctatatcttttaaaagattaagatatttaatggtgctgggggcttgggagagtgagtgctttattggtaaactagttcttcacatgattattttaaaaaatctgacagtttaaacattttttaaaaaattcagagcattaggataatatagatcctagtacattgtataacattttaatacacaagtttatttctggacttttttccatttaaatggatctctttatagattaaatgatcacttgtctttcagtgtttatataactttgcatctgccactctcgaaatgccccttttgaaatgcgcaagtaaagttccgtaaatataaaatagctgcctaatcaagttttcatatcactgttaaactgtttttgagatcacatgtcaagactaaaattgcaagtgaattttttgagacagattgtctgttagtttctttcagaatgacagattctttcttcccagaaaattactttctcttcccttccccaaataataataggcaaaatacactcaattcaaactgacatttcttcagatatattttagttgtttaggtgcctgagaacttcatctttggaaacctataaaaggtaaccaccccttttccctttttgtgggtttgaaaaatgtcctcttaaaggatttggctcatgatagatgactacatcattccttccagaatcatcaggaaattaaatgctgaaataatgtatctttacagttttaatttctaccattcataaatattaatctaaataattcctgtaaggaaatatgggcatgtataacttcttcagagactgtttcttttgatgacatttataaattcatcctatgagtagagtattatgaatgaagagcttcaagtcttcctgaatctttgtttataaactgagaataaatagcatctgattcagagtatcatctgttagcagaaaatgagataataaagtaattagtattttgcttaacatatagtagatacttattaaatgtgaatttttatccaatatgctgatttgtagttcattatgagtggtgtagatagagatgctgctgtttgataaaatgttgataaatcttagtattgctaaagcaaaaaaaaataccatatacataaaacaacttagttaatgttatgagaaaagtcatacaattttccactgccttcaaatgaaagttcctgtctgtatcatttggaatttaaaaaattggaagacattgaatagcaatattaatattaattaactttaaaagatgtctggttaaaatcaggacttcaaatggagttgacaggataccgtttaatcctactttgtgagtagattacatagaatttaaaagtgacctgctctttgacagacaaagtttttggtggccagtgaaatgacacagactaaaggaaaaagacggcattttaaactgagaaaaaccatttttatggaacattaaggattgattaaatgcccagaaatccaggctattacactagagctagctgatgggaggcatcattttattttcagaaaaatctacacttcataaagatcatatataaaggacgatttttgaatctaacatatgctacaagaataatatgtaattaatctggtaagaaaaaaagaacatttacacctatgaattatctgttttctttcattttttttgtaataatttcttagatcaaacctcagaaatgctcactgcaacccaaaacttattttgtttcccatcttttatttctgttgccgtaaaaattgattgaaaccaatagtatgttaattacaaagacttcattcgttgtaaaggttccaaatgaacactattaagcaccaacttctctagtaaagactaccttaaaactaaaatttattttaatcacttttatcctaattccatttagaatagataaaatttgtttagataaaattaatttagataaagagcactgggtttctctctcatctcatcctgattcagattgtattaaacaacagaatttttcatctattccttaccaagagaaacatacgagttaacatcaacaattctaataaattattagaaaaacttatatatcctcttgctctacttgcctcagttaaaagccaaatttttcattgctaattatgtgtgtgtgtgcatgtgtgtgtgtgtatgtgtgcgtatgtatgcatgcgtatgtgcgtgtgtataactcttacatggcaattaccttcctagatactcaaagtaatagtattaattaataataaactataatagcaacttactttgtgacctttttaaatgttttgaccacacctatgtttctacaatgttcaacattataaattataaacttattgttaataaccatatgtaagacaattgctccatttagcattgtttaggcactaatgtatataatttaaagcatagaaagcaactacaaatgagttgataattttaacaaaaatatgttgctttcatttagatatgcactaagcattaaaaccaatatattacagtaacagaatccctaacatttacagataacaactcataataggtttgtgttttgtgactgtattaaagtatctctaattcttccacctcttatcttataggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggaggtatattataaatgacaggatatttcttccagggtgctttgttgggcaattgcaaggagagctttatgagttgcattggattcagaattatacgtgttatttctgaacaattctcctccagcaatttcataagtctaatggggagaaagtgctaagaatttgcgtctttgttctttttgatctcattatagaaaaatttctacttgcttaataaaaaaatataataagtaaaggttattttcttctaaacaagtaggtccataacatttcccacaggagaatttgtaattggtactcctttttccaaactctaaattattaaactaataaatgtgcttgacttttctggcctaagaaggacatagatatttattctttttaaaaagattggtctccagtttgaataactccaacaaaaaaaattagatatgaaaaaagtgctgtagaattgtatggtcatatccaactccgagaggatatagctgaaaccttcagcatccagaatacaacaaagaatttgaaagatataaataaaacctctgaacagcgaaacagagaacaccaagtccctgtagcttactcataagaatgccctttaaatacttacttgaagcctatttctttttcttaagaaaaagcctctgtggtttttttttcactttgctctggagatctcaatatgtcaatctgaagggggtgttacacaaagcaggcacacaggacaacagcagggagccttaaggagccctcttaagcaagagacgggaaaaaaatcaatcagataaactaactcatataacctgtcagtataggactcttcctgcaaaaacaaatctgtgccataaaacaactcctaaaggtatcactgcagtataatgctagcatataagttaatatttaaacaataaccctgagatattagcaaatattaaagtcatggccaatcttagaagtaagcaaaacctaatatattttagaaacttgttctttaaaatatttaccataggaaacattttagtacttagagattttcagttttaacagtttggaaatataaccctaggaaaactagttcctctctaataatactagataaataaggtgcttttgcaaaactaatctgaaaaataaccccacaacctccctatccttagtcacctttgaatttttaaaaaaggatttgccatttatccaaccatttcttctaattactatcactgtagtacgtggactggctccaggatcattaccctgtaactttctgttgcctactagattttaagctcctttagaataggtcctttccatggccaggtgcagtggctacacctacaatcccagcaatctgggaggtcaagggggagaatcacttgaacccagaagtttgagaccagcctgggcagcatggcaaaaccccatctctgaaaaaaataataataataattagccaggtgtggtggtatcctcctgtagtcccagctactcaggaggctgaggtgggagaatcacctgagccctagaggtcgaggctgcagtgagccaagattgtgctactgcactccagcctccagcctgggtttcaaagtgagtccctatttcaaaataaatagatatgtcccttcaagaacccagcatcataagtactcataacgtgcttctctaccatttcctccatcataattaccacagtgctttggatctgtgtgaatatatatgtttgaatgtaattaaggagaaggcaatagtcaaagtaaatcttctgaagccttaacaacatctctttaaatttcagttccacccttatctatatgtgtattagttcattctcacactgccataaagtacagggaagaggtttaatttactcacagttcctcagggcagggaagcctcaggaaacttacattcatggtgaaaggggaagcaaacatgtccttcctcacatcgcagcaggtaagacaagtgctgagcaaaaggtggaaaagccgcttataaaaccatcagatcttgtgaaaactcactactatcatgagaatagcaaacggataatcatccccatcatttgatgacctcccaccaggtccctcttatgatacatgggaattatgggaactacaattcaagatgagatttggattgggacacagccaaaccatatcaatatgcttataatgtcccatgtttgcattttaactggtcatggatataattgatgtgaaaatgatagaattctaaatagaaaaaaaggaaagaattttgatttagaaaattataaaatattaaaagttgtgtttgttaaaagaagtatcaggaaatgaaatacaaacttaagaaaaattattgactgtgtcatttagggacagcagaaattattttacagcatatttgcctaacaacataatctttccatttcagttgatgaggacttcaatatctgtgaacaaatattttatttatgtctatattcctaatcttacctgaaacaataaagtatggggaagcaccaacttcctcctgactcataccttcatcttggtcctgtcaaacccacagatggaagaaaacaagaaaactacttttgcgttgaggatttgttacatgtgaacatccctcttatgtatgatagaatttgatctctagactgttacctattttaatatacatagacagagaagtaaaatttagaaaaaacagaaaatgcatttcacaaattttttaattagtgtccaaagactgaaacccaggattagcttaagttgcaaaataaatattaaagaacaccttttagctagaaaatggtgtttttgcaacatatgtaacaagcaggaagtgatccatttactgcttagtggaactaatgttagtttggctgctaatggagagaaaacagaaacattctaatacttttgctcctttctccatctaagaaaaattgtcttcaaattgggaaggttagagtaaaattcattaaaagaaaatattccactggttcagaaggagcagggagatagcaagagtaggggcactgctttgaattaggcttgccaaataattgctcagagtagccaatcagccagcaggaacgatcaaaatatgatagctcagaaatactggagaaacacttaggaagaggaccaaggtacaagagattggtgtattgtcccaattactgaaaggaaggaaaaaagattctcatggagtttagcatattaaatgttactatgtagataaactgtagaatatattattaaatcaatggtttggagtacctcagataagacaacagggcttccttaaaaacaaacactgccaaactaagcctttatttatatatatatatatttttttagattgggagaatgtcataaatctatgtgttacatgttgatttttatgtggtgtttgacaaatttttacctgaaatccttaggaaagatattgaaaagtcttgacagagtgatgacactgaaacattttcaccaaagggttcctaaaggcagaagatagtgaacactctggcctcagacagaaagcaaaataaagctcaaaaatatttaagtctcattattacctttaaaagttataacatttgtgtatatacaattaaaagtaatacttcaaattatttgccaattaaactagttgtttttctccaaatattcaaacaaaattgatatctaaataaatcaatcaaatcttcaagcaatattgatatgactagaatatgccttagatgtattcggtggctttgagtacttcctgatatccacaacctaccaccagggtttcttttgtccagagtttgaggattgtagaaccagatgaatattcaaactgcagtgataaacattctattcctgaaatgcaaggaactgtctatggtcattcacaagattctattcttggacctaatatttttaaaacgtctatcactacgtgaatgaagatgaataaaacatgcctatcaaatttgtaaatggcataaagctagaagagaaagcttatgttgtattagataatcaagttccaaattgttagtgttgactgaataataagcctaaatttgaaaaagcacagataaagtataggttcaaaatcaattacatgaagaatcctggtttgacagctgttcagatcccttaagttgaaggtaaattcagtgtgtgtatcacacaaatcatatttgctgtaactattttaatataatcgtggtctctatgtcagaagaattttgctaagataaagagatctaatgtcttacactattctctcctagtcagatcacatctgtaataatgtgtcaattctggatactaaatttttaacagaaacattgaaacacaagagaaagacagagaaagagaactaagatgatcagcctagaaacgataccaggtgatgaaaactaaaagaaagatatctcaaagcaagccacagatggtgtcaaatattgaaagcttgtcatgtagaggaggtgagtgtggagatttggtgatgtcaaagaataagtgtagtgccagtaaggtagggagaaatgattggtcatatgtgacatactggagtctatgattttagaggtgatgtatgtttctgtccagtaaatggtcatttgtgttggttgaggcctaagtagaagtgaagatcatctgtacagaaattgaagtgaccttttaaaatgatgagagatagtttggtattattgtgaaggaggagtcaaaggccttacaaataaaataaaattaccaaaagatcagttaatgatgacagaaaaaagcaataaagtgtagcataggaaagagtgtgaagctcaaagaatgggcacttgcctgcaaaagaaaaagtgtcagattaggaggggtaatgaaaagctcagggaatattaccaccacttcttgatcctgcagtttggaatgtggacaaatgaggagacgtagtcatttattgaaaatgcctgtcatgtaacaggtacgaagcactcacctttaagactagcatagatgctcaaaatacatgcctcacggtctgcaaaagagaatgtgccccagcagtgtcaggtttggatagaacccaggttaccagatttttcgtgtctcaacgtctgccaaacacacctagctttaaaattgactttctttttttctcctctctccatccttcgtcttcttttacttcacaactgtttatcaaaacccaaatatgtgcgaggctctaggctaagtcttagagaaataaattacggggaaaaatggaagagaaaagatgtacagtatgagtccccatccaggaggaatttatttttttgtggaaaaggtagatttaaaaaagaatttagtattctgatatgtttcaaagacgtatgcactgtgtgttccggtagatgaaaagaggtgctcaaccttgtgtaggataaggaaagaaaatcagaagttggcagggtaggattctcctagcatgtaagctttgaaccaaatattgagaaatgttaactagttggagaaaggtaaggagatagtgagggatgctaccccaacaatcttttttttaaatatatatatatatatatttttattatactttcagttctagggtacatgtgcacaatgtgcaggtttgttacatacgtaaacatgtgccatgttggtgtgctgcacccattaacttgtcatttacattaggtatatcttctaatgctatccctcacccctcccccaaccccacaacaggccccggtgtgtgatgttccccatcctgtgtccaggtgttctcattgttcaattcccacctatgagtgagaacatgcggtgtttggttttttgtccttgtgatagtttgctgagaatgatggtttccagcttcatccatgtccctaaaaaggacatgaactcatcattttttatggctacataatattccatggtgtatatgtgccacattttctaaagacacatgcacacgtatgtttattgcggcactactcacaatagcaaagacttggaaccaacccaaatgtccatcaatgataccccaacaatcttaaatacacgttcaccaaagggaagagtaaaataaagctagaaaagtaaaaggaagcaagtttcaggcagtagaaccaggaggggttaggaaaggccagaaggttgtgtattattttgatttccctgggcatgtatccttcatgtaacttctatattttcctgttgggtctttactgcctaattccaacctgaatgttgattcatggactagttttagctgtatagcagacttcagccattcttttgtagtctatctagtaattatcaggcaaaatggggagtggctgggatagggagtgaaaatagccagtcctaatacttccttatgaaggacaaacttgtattgcacgtaatgcattgagtgttcaatgtctcttcaaaaaaggcctacaagtattatacatataaaatgatatttaacaaacacaaaggattgaagatttacatggtatgtaaaagaaaactcacaaggcactgttaggaagttcttattaaaagctgtgcattgcatcagactctaattatctcaatagccaaagcttagtaccatcctgtgatgtgggtagactattttaaaaatttcctccatgattaattataacccgaggacaatccatatagtctcctgtatgtttttaggaaaaaccgtgataacaatatactttcaaaaatctgaaaaacacaaatgctttaagatggaattaattttcatcactacattgattcctcattttttttattttatatagagtttttccttcagaggaaatataacatgaagcagcttttattgacctaggattccttttggtattatgttttccaaaaaatttttaacttctttgaaaaataagcacctttggtgattaattgacagtataaatagtagttctggtgaaacttaattgtaagaatacagtaaaaccttagcaaaaaattggctataatttatttttcaatctatgtagaaagaagttaataacatggttgtttcagaagaagaaagtattaatgtaaacacacattcacaaacagttaatagtttatggtatttgtgaaatcaatgaattgtaatgcatgtgtatacctgtataattttgtatagatccttgatcactataatacatataaaagattgtgttctttcattatttcatttaagaatctccatatacacaaaaatacacacagtagactacttcttttttaggtacctatgacattcatatatgaaatcaagttgatatttttccatctgaataactagaatgcaaaaacttaacatattcagaaaatgtattattcagtttgcccttccaatcttaaacccttagattcttacctcctcagagagaaataagggccaatgattttctaaggtctaacactaacagccttatctctgtcgaaatttctttctttccttttttaatcttctctttcacacctaaataagctgaaaaagcaattgaggcatacaatcagacaagacttcattctcaatgacaaaattgcccaggaaatgacaaaagaaaccttctgcttaataacccagtaaaccagccatgtatgacatgaacagaagcagttgagacaattattttttttccttattcctgatgactggtgtcaatgattctaatgatcactttctaatgtcttttcagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaaggtaacttcttaattttcatgtaaaaaggatatggtaaataattatttgacatattttagaaaaagggtttcctctttaatatttctacaaattctaagcacaaaacagtgtaatggggaaattaaatattgaaaaagaaaaaaggtgagagagtcatcaacatataaaaaggggaggcttccttatttatttataagggagttttaagcaagtaaaaaaaattgtggttgagatatacccacttgactatgtcattagcattagagatactgaaattgttttggtgcctgtcgcaaaatacaaaaggcttttaaaaaaacacacgccatccactaaaaaaattaacagtagacttaattagcactttttcagttagataatatacatggtaagacactggatgtgatggcctttaatttatctcatgataaggataggattcataagtagataatatgttgcagcatttgtgaactatttggggtaactgattgcattattcctcttcactgtccatgtgttgcttattccagctgtgaatctgtttggcttagctacctgttccattcccagaaggcagtttatgttgtttagctcctctcagtggtataagcattctgcagtttattagactctttgtcatgtcatccttcttgacattttccatttgtcttgtaccgcctcttggatttaaaatgaaatgattaataaaacaaacaaattctcctataccctttacacaaaggagacagacatttggaagtttatattctgtattttacccatcctttttctttctgcatgtattttcctttctttcctgaaacccaaagaaaaatagctagtcaattgaaatataaatgcccttaaaaagtcagagtaaaatataaaactttaatattagaagtgaactaggtgtacaaaaactagaagtagaggaaataaatattttaaatagagaatagcctggatctttctcttggtacttgtatcagtcccttttctgctgttctaactgattaccacaaattgggaaatatataaaaaatggaagttttttggcttatgattctcaaggctgggaagtccaagaccatggcacccacatctggagagggtcatctcatggcagaagagcatcacatgctgagcagctgcacaagatagagcgaaaaagggggccaagacttcctggataactaatccactcccattatatgggcattaatctatttacgaggtggcatcctcatgatctaatcacctcaatgtccctatccttaataccattgcaatagcaattaagtttcaatgtgagtttaggaggggacactaaaatcatagtattccatcctttgacccccaatattcacgtcccgctcacatataaaatatattcattctatccctatagttccaaaagttttaacttgtttcagcattaactcaaaagtccacatttcagagtcttatttaaatcagatatggaagagactcacatgattcatcatgacgcaaatttctgccagctgtgaaactatgaattcaaaactgattatctacttccaaaatgcaatggtgggacagtcataggatagacatttctattccaaaacagagaaataggcaagaaaagaacaataactggtcctaagtaagtctaaaacccaacacgaaaaataatattaagtcataaagccgagaaacaatatccttttacaccatgtcctcatttctggatacgctgagacagggattgggcccgcaaggcctcaggcaaccctgctcccagggctttgctggacccagcttctgcagctttcacaggttagagtcacatgctgttttagtcctacagttctgtggtcttagggatggtcccacttccatagctccagtagtcattgccctagtggaaactctttgtggcaagtccaaacccacatttttactcaacattgtcttagtacgggctctctgtggtggtttgaccctggagacaagtctctgcctgagtcttcatgctctttgtgacatccttggaaactttagtggaggaatccatagccagagttcttacactgtatgcctgaaggtgtaacaccatattgatgataccacagcttactacttgcactctgcagaatgacagcccaagctttacctgggtccacttgagccacaactagggcaggtgaagaatgttacactggaataaggggagaagagttgctaggtggccctggacagggagcccatgatgagtgccttgggcatatcccctgaaatcattttgccttccgagagactgtgagggcagcagcagcttcaaagacttttgaaattccttttaaatctttctcctattgtcctgataaatagcacatcgctcctttgtagccatgttaatatctttagcaaatagtacttgactgcacccttgatattctctcctgaatattatatatatataattttttttgacagtctcgcacaggctggagtgcagtggtgcaatctcagctcactacagcctctgcctcccgggttcaagtgattctccagccccagcctcctgagtagctgggactacagccacatgccaccacacctggctaattttttgtatttttagtagagacggggtttcatcatgttggccaggccgttcttgatctcctgacctcatgatctgcctgcctcagcctcccaaagtgctaggattacaggtgtgagccaccatgcctgtccctgaacataggttttcactctttacatagccaccctgtaagtttttcagattttttgtctgcttctgtctttaatataaaatctatctttaagtcgtttatttttctcacatcttattatgttatgtacaggtaaaagtagccaggcagaagcctgaatgctctgctgtttagaaatttcttcaaccagatattctagttcattgcccctaagttctgaattctacaaagtcctagaatatggccacaattcagccagggtgtttgttactttacagcaaggatggctttcaatccagtttccaataccctattactcatttctgtctgagacctcaccagaatgtccttttctctccgtatttttatgagtattctggtcacaacaaattaaataaactcttaagaagattcagactttctctacagctctcctcttccaagtcctcactagaattgttcttaaagctctattcacagcagtacagtttttttgctagtctgatccttcaaattcttcaagcctctacctttatgcagttccaaagtcacttccacatattcaggtatttattataacaacagctccacttattggtaccagttttctctcttgatttgtcttctgctgctagaataccatggacttcgtagtttattaagaacagaaatttatttggcacacagttctggaactgggaaatccaagggcttggagctggcatctgataagggttatcctaggtgaaaggacaccacatggcaagcaagcgcatgagacagagacaaaaaggggaccaaactcttgtgacaattaacccattatagttattaatgcaataacagcattaatccgttcatgaaggcaaaactctcatgatctatttatctcttaaagtttctacttctcaataccattacaatggcaattgcatttcaagatgagttttggtggggatttcaaaccatagtaatgctgtgtcttctttgccaaggataattttaatgagaattttggctgttatcaacaaaagtacttgagaattaaatgtattgaatatattggcagagaaagacttttcaactgaaaaatgaataagtctaatctagcctcaaggtgttgccaaaatcttccagccttatctatgtagagagctggcaggtataaatccaagggaggttgttgaacatgattctaatcctgccaatttattaattcatggtttggctaggatgcaggatcctgaatatatttcttcttctgaagctttcataccaagacaaaataatagtttaggaggttgcttagaaaacactttagtgagaggatcaggaggaaggaaagagagacaccataatatgtcagtatttttcatgtagaaattcaatatgtaagatattgctgttagaaaatttataaccaaaacaattatttaatacaataattatgaaattttattttgtgggactatgtgtacatttgtccctgtcagcttctgccccagtgtcacattttaaagaaatatatccattctttgtgtcaagaaactcagtttgaataatgtacatgattacaaatgttcaattttatatttttgtctcacatttcaaactgactttaaaaatggatttttagaaaaaaaaattggattactttttgcatcatatgagtgtttttggtcacctatttagatgtcaatgctggtgatactccacacattaagtgagaaagaaagttcattactcacatagagactcccaagaagagcagaatggccccagacagattcaggctggtttggacaaaacagagggagtggcctgggcctttttgttgactaggggttagggctggcaaaaggttcccactcatgcgggctggagatttgagaagctcaagtttcctacaggtgtcaaataagtagatgtaggatggcctttcttaatcagactgtacagatgtggggccaaagaaagggagggtaaggcttaaaaagaagtcagcagccagcaacacaaatgaggtcaggctctttattatgatgggaatattctagtgttgaaatttttaattacattcaaataaatacaaaatgcctatattaagggcacgctacatacacattaaaaatccgtgtgctgctgcacaaagtacaagcaagaagagaacaagtttctctccctaaattaatttctattcttattatggggaatgaaacaaaagaattaaaaataatgtcattgacatagtagtataaatgtctagtaatgggcaaggtttctgtttctcaggtactcttgtgtacctgagctttataatatatgaatcggtagaataagtgcctcctcattttcattctttttttaaaaattagcagttaatgcttgcctgtttattcctgccaaatattatcagcagccctgtgccattgttatttacgtggatgttgtatgatatttttgaaggaattatagttttaaaaatattgagtctttccatctataacatggcatctatccatatagttagctttttgtaatcctgattaaagatttatagtgttcttcacacatattttcattctatttatttctaaactttaataggatgtgtgtgtatgcgtgtgtgtgtgtgtgtgtgtgtgcatgctatcataaatgagatatgttccattagattttcaaactggttattgtaggtattaaaggaagatattgatgtttcatatattttttgactgacctgatcaactttccaaacttaattactggttctcttgtatttttcaaatatacattgatatcactgtcaaataaaattaatcactccaattctaatactttacgtattggcatagacttaaaaagcagcatgcaacaagtatactcttaaacataccaggagcattatctgaaaagaggatttttaaaaattttgtaaagaaagtattcttctatttttgttttattatattatgtaattaagttgtttttattagtaacttgtacagttatagagtagcaagtcacaataaagttaatctaacctttttattctatttttaggtgtacagaaccgaaattcagaaaaattaaatgatgtactaagtgttgcgtagctaattagttttaaataccaggttttttggtttctaatttggtgtctgtgtactttaccatttaccatttttcttgttcatggcaatcatttttattcactcctgtcaaagtcacttggctaaacatgcacaccaagaaatcatgggaataaacaccctcaattaatattatataaaccctatttaagttttaatatggcttgtttttcagtctttagtttattatgacaagttacattgttgtagcttctcatgaaaactatatttatatattgggaaagagttttcatgtagtataatttaatttgttagtgttatgtaacctagagcaagctttcaaactttttaactatataaatataatcaataaatttgagctgttctggaaaaaagtaggagaggatttccagagacacccaccacaatcagctcttagagctacaatttgaaaaccactcccctggggtatttataaatcaatttgcccagtgcagatctaccttcttggaatagtgccatgtcattgcaacacgagtagcctgtttttatttacagaagtgtactatatttaaatagaaatcatttttcatttttttcttagtgttaatatttttaatactgaaacaattttcaacagggcacttcattcatgtattaatcactcttttaacaggtatttatcaaatttctatattgtagaatgtactgtgcaaactcatttatggaattaccccgcaccccctgccaaaaaaaaaaaaaaaagaaatttagaggccagtagtgaatattgactaactatacaaagagctacactctaaggccagaaacaacaaaaagacccaaatgtggtaaatataggatactgtagaatcttagagaagagtgtaatgtgctgtggtacatactgagatacttgcttcacagccaagaaagacatctgagcctctgttcaggaattgccatggacgggaattgttccaccctctttctaggggcagcatgaatccaatgaacagtcattgcaaaactagaaatgtctaagttcatttcttcaggggacaaatatgaagggttatctacagactagtacgttggatgatctaaactggtattgtatttgcatcaaactttcatctcttcctctgtccagtccctcttccctcactccattgcaagtgctctctcagtagcacttcaaataaaccttctgcatacaagcaaatctccatctcatacctgtttccttgagaacccaacttagaaaatagattagaaatatttgcatggaactgatagcatcttaatggaaatttcaaaactagcaggcttaggatatataaagctatggaaggaggatatttcaggtggtagaatgctgtagctgatatatctattagactaaatcatttgtacaatgacaagagttgattaccagagtgcagagaacacataaaattgttttgactggaaagtgatttaggaaaaaaattattttgtgggtaaatgtaagacactaaataatttttggataaaatcagacctgaattttagaacacctttacctcttttatttaattttttaaaagctaagaaaaatcttagattcaaaattatgtgattgcacataaaatcactggacattttctatgtattctatattagtaagtgaactaaaatgtaatagatgtttaaatcaaattcttttgcattgtcttaattgaccaatttctgttaaaatttttgtaattatttttaatatggaatgtgggaaaatagaaaatatcagtttatgcaatatgtcaaatatttaagtaccagtacattttcttatattgatatatgttgagcccaacatatatcaatatgatatctgatagagttatcttgatatatgtattctatattagtaagtgaactaaattgtaatagatctttaaatcaaattcttttgcattgtcttaattgaccaatttctgttaaaatttatgtaattatttttaatatggaatgtgggaaaatagaaaatatcagtttatgcaatatgtcaaatatttaagtaccagtacattttcttatattgatatatgttgagcccaacatatatcaatatgatatctcatagagttatcttgatatatgttgatatctcaaaaagtattttttgaaatgataaaaatattgaaattataccatttcttacatggtaatttattcattcaacaaatatttattgaatactaccatatgttgtaccataagatcagagaataaggaaggaaaatagaaatatcaaaaataattacaagcatgatttgttctacaaaaggagaaataccaagtgttctagaaatatgtcattggagggcctacttaggcctgagagtgatagataagtggaaacgtttaggctaagtatgcattagccaagaaaggaaaatgaagagtattccaggaaaggggaaggaagaatgcctcatgcaaatgaaatagaatgtttctaggcttgtaggaaagagagcttaacacattgaagcacctgaaataagcccaaggcagccagaatagagacatggcttctaattagctaaaagggggaaagaccatcaagggtttgataaacgatgttgaaatttccaaattttattcaaggaataacgtgacactgaaggattattattattattattattatttttttttttattttttattttttgagatggagtctcgctgtgtcattcaggctggggtacagtggtgtgatctcagctcactgcaacctctgcctcctgggttcaagtgattcttctgcttcagcctcctgagtagctgggattacaggcgcgcaccaccacacctggctaatttttgtatttttagtagagacagggtttcaccatgttgggcagagtggtctcgaactcctgacctcaggtgatccatctgtcttggccttccaaagtgctggaattacaggtgtgagccaccacacccagccgacactgaggtattttaaacagggtggtgataaaatcagattatcccatgcttgccaagtagagaattctgcaactgccattgaaccagactgactgcatgacagaacaccaattaagaggctaatcttcttacttagagaggacctggttaggttgtgggccatgggatggatagaagtagatatccttgaggatatttacaggattgaaataagatttggtgatttaataagtgtgtgaggaagacaaagattaaaataatgattcctaggttaatggttgggacaaaatgaactctaataagttgtcatgtttggttttgtggccttttaaaacgtctgcatacttagagaaatggagacattactttttgtttaaagcactatgtatcatttagaatttacaaatctgaaggaaagagagagaatttaggaaaacataatctggcttaccacaaacagtattgtcttgaaatataaggtagcctttttacaaaaatgtgtgcaaataaactttttgtcatggggatttaaaaactgtcatccatgctctcggtataggcctcttgtcaattcaccaagatacactccagcttcaggtcattttgatcataaagtaggtaaactggaatagatttaatttaattcagttcaacatgcccttctgagcaattctctatatataatatgttatattgaacacacagtttacatagtccaaaggaaaaaatacgagacacaagatgaaggtttcagtttgggctcctcagttaaccggttgacttagggcctaagggtcccctaagatggagacagcatgatcacaatgcttgtaacttcctgtttacttctcagctggctgtgagtctctattatgaatgactatttgagtgtatatgtatatatgcaaatatatgtatatatacacacacgtaatgttacatggcaactcaaattttcctagatatttcacacaaactagattctttgtatttgtcgtcctcttttttttttttttgcatcttgtatcttagtttctatttacccataaaaatatttgtttgttgggtagaaaatgtggtatttttctggttaggggtttttctctctgaacctgatgctgatgaaacatgaaggcatcagggctccctgctgagtctggcacctcccagagtattcactgccttgctgggcccatgcttatattaacagattatccttggttaccacacacatctgcaggttacaaggaacctagaaatatgtataaggaaattagacgagtatgataaatatttgatgtcccacgtgatcctccaaaagtatctcttaagttcctttgccatttcaagcgtaggaaaagatccttcatcataaacagaatgacataaagtctcagtaattttttttttactttttccccaacttttcctagccataggtgaataatacattttgccttttagaaactcattatccagtggtaaattattctcaacctctgattctcttcttttaatttttctactctttgctctctatatttgatgtccactggtatttctatatcaagtggatggatgaaattaaaacaaattttatttcatattttttaaaaaggtttactctggcagcaatttttactgccaatttaaaggacgtttagaaattatctgtatgtgttattcatactaccaatgtcccattagcttatattgttgaaaatctgctgcatcaccaagagataaaaaataccaccatgcatgcacaaaaataatgaccattcattaccccttggctagcacacattttcaccaaggctctgttttcaaggttaatttgaggatagatggaaaaaagctttaaagcgctggaattttctaaggcaatccaaaatcagagaggttaagtctgggtgatataacaataggttttagttaaagggtttatttgctcgaaatactgacctctgaatcatccctgacatcttcatgagggaaggtttcactgattttacatgccaacggctcattaggaatatagcataaggaagataaatcacaaagtcataaagttgagcaaggtaagtaaatgctgcagcaaactaaatgcaagtcccccaatttattgttttctgtaccttcttcaagtaaactaagtcattcagtggaagataaagtaaaggataaaggcatgacctggagtggtcatgtgggtattgattgaaaataataacacaacaccagattagtctagtgctcaaatgtgtaaacattttagggatatagtagttttatgtagcaattatattgatatatgatatctttttcgtataaataagctactaaaacataaatttaagattctgatataattagaagatattaatcaggtagatgtgtgattatgaacaagaaaaacttgtataaaaatattctgaacacaagtttttgaacttacttgtagtaatataagctatatttgtcaatcaaattcctacagtatttgtcatttggagatactaatgataataagatgcactgcacttacttcagtctttaaaatataattggatgttttgagatattaacagtgagcacataccggaatagattggcaagaatcaggtatattgcccttatcaaaaatacaagcaatcaaagggaacaaaggagaaaaaggaggagacattctgcatggctccccaggttctttcttcccacactggaaatgctgattcggtctccaaggaaggtttcataggtttatttctcaccacagggaggatttacattatgaaacatttccatttttacccgagaaaatgtaaagcttcaggacattttctgaggagccacaaaccattaatccatagatcctgggtttatttactacagtattttttagcctgggatatcctgctaagggctttgtatagataaggaatcttccacctagtaaatattaccagtctgtttacctggagttccaattggcagggaaattagaccaaccttcaccctcagttgctgccctatacacacaccagtgaaaggagtgaatacatcctagaccagctgcttaacttttttctcttcaagtactaatcaatgaaatgtaactgagttgacatttgcaaaaatattttccaaagccatctaaatatttaagcgtataataatttttggcaaacccactgaattttaattaacaaaacaagattatgccaacgatttctaagagaactaaaaatccttcaaaaataaagaattaagtaacagtggaagtaatgatgataatagtatttaagctcttaccacatgtcaagaacttttcaatattctgtacatgtattataagaatcagaataatcttctggggtaggcactattattttcccatttaacagatctagtgtttgaggcataaatgaaatggcttagcctggtttacacatctagtagatcccgaagccattggtgaaacccaggaagtgtgacctatgttcttgactgctaaatcatgcatgaaaatccactaggatttttattaataaaactagataatagaaactggctgattagggaataatagtaaagaattaattttgttgattattactattataaaaatacaatagattaaatattaaaattagtgattcaggtaggaaaacatcaatcaaaaatagtttattgaactcatcatgaactttgcatcaggtgattgggctacaaggcacaaatgaagtagaaggaaaagcaaatagcataatattactaccagccagaaaagactggaaacggagttgcaggttatgtcaagtgagatatatttaaatatcaacatcttagaggtgataattaaaacaatttacaaaactgagatcatttgttttctaaataaatgtcattaccaggccaaaattttaagttagacatattttagcattgaagtgactcagagtgcgattttcatttgtaaaatcctaaataatatgaagactgataaactaaactgagaaaagaatgataaacaagaaagagagaagtatgacctacattgccatctgttggataaatgaacatctgtcatattgaatgaaagatgaagcttggaattcccagagaatctcaacagccagcactacccgttaagagcaaaaacagatttcaagcctaatttaactttcttttatttttgatttggaaaatatatttaaagaaggggcaaaaaaatcaccctctaataatctagaaaccatggattttaagatccccaggtataattttagaccaaattgaatggaattgtgctagaacaaagaagattgttgaaatctatcttatatagattttatgcactccagaagcatcttgttttcaagatggatccattcaagtcacaaggtatggtggcaaaaacttgagcctggaacttagtctgagctctaacatggtttcattttgagcagtcacttgacttttggggtctaaatttctgtttttatgaaaaatggatgagattggattaaggaatttccaaagttaggttcaactgtactcctgtttatgctgtgtacctattttaaaaagtagtctgttaaaaattgcttactttaaatattattttatagatagaagtagagttcctagaagttccttttatgtttatttatttatttttttacttctcaaattttacatcagtatctgttctctcctttagggtggagttagtgggttgactggagagctagaatttggagaaaatggaggcaatcccaatgtccactttgaaatccttggaaccaactatggagaagagcttggcagaggtgttcgaaaagtaagacaagacacactgattaatacgctttttcctatactatggttttgcttgattgttttccatgcagtatgatcacagtacccattaaagtcaatattgtagtgtgaaagagaaagcagggggtgaggggaaattaggcattgaaatgactttaaatatttaccagaagtattaagcaagaaattctatttccgacttagaataatgtaaaggaaaaaagtaatctgaatcttacctagggaaatagcatcatctttcatttgttacaataatagtttttataaaatagtaaatttaatatttatacactttgtagctgcttggtttttaacttgtaacatgtacaaaatcagaataagagcttggataaatttcatatagtaagacagaaagtctactgcaagatgtgacattacagtattttaccttctgtatgtgtcatgtaatatgtagaaaatagtttgcagaaaatgaactcttgttggatactactgatcacatgtaagaagaagctgagtgccaataatgatgtttcatgaaatactgggacaataactttctcaaggagaaatacaaacgcccttatataaatgatgtttctataattcggatttgctatatataaatttttgatatatatatcaaatatatatatatttatagcatttgatatatataatatatatatatatagcaaatccaaattatatatatacacatatacacacacacacatatagatatatttggtagggaaataaatcatatatatatcatataaatatatcaaatcatatgtatatatacacacacatatatatatgatttggatttgctatctatctatctatgtatctgtctatctatctatctatctatatttggtagggaaaaacctaacataattgtgtacgcagagctggtaactgtaaatttctaactgtctaaagttgatgacatttagggtaacaggttcttcagtaggtatttttagtgctgagatgtaagatgcaaaacaacctagacaaaatgaagtgaggagtaattagcaatacaaatttctcaataaattcatgctaatatggatgaaactatcttgatgcatttaaaatttttgttttatagtgaataatatgaaacatatagaaaactgcataaaacacaaagtttagtgaattattttaaaggaaagaaccactactgtggtcaagaaatagaaaatagccaggattctcaaccctcccatatgcttctctctgattaccgtcagaccatccttgtcaatagtgtaatatttagactgatttttacgatgttaatttatttgcatttaaaatatgtttttatcacctgtgtttacatccttatataattgttttgtcaatgtttcaacttatgaatggtctcaagaatgcgtatatccttttcttcttgcttcttgtgttcaacagtgtgtttatgttattgatccttgttgttacatggagtggcagtttattcatttatattgctgtattgttttctattgtatggatttgtcccacaccactgcagtttgtttccatttttagactgctataagctgctgttacaaaaattcttggatatacatcttggatacttttatgcttgtaggtgtatttctgtaggttttgtatccagaagtagaactgcctgcaatataagaaaccatatcttgaactttaccagataacatcaaacccattttcatagtaatttactaatttacataccaccagcagtgcaggcattgccccacattctaatcaagtcttgaatttgtaagacttaaaattttattaacttattgggtggatataatgatatatcctcatgatttcaatttacatttccctgattatgaaacagtctgcaccttttcctacatatttaggctcttcaggtgtttctgagttaattgctcattattttttttttggagaagggtgtcttttgctttttataattgattttagaagttatgtatatattctgaattttagtgttttatcatttaatttttgccagttttgttttcttctctgtggattttatttcaatgccatttatagtatctttaaatttagaggaactatgaattttcatccttattattattgctgtttagtattatctaagaaattactccctatcccccagagtcatgaatatattatgctcaattatgttccaagggttttacagttctgccttccaaattaaggtcttttatctatctagaagttttttttttatatatatacggggtaagaaaaaggtaaaattttactcttcaatactcttcatttgttttattgagatataatttaagtgcacaatgacttagagtagtcgcattcaccaatttaaccactaaccaggtcaagttattgaatgtttctgtcactcagaaagtgccattattcctgtttttattattagaagcacagacagtttgcttggcctgaaagtttatataaatggataaggtagtatttacacatttgtgtctttcttctctcaacatttaaggtacattcttattttcatgtgtcaataattttgcttgtttgtcttttaatttatattgctgagtggtattatagtctataaatataatatggtatcttctaaatgtcattttctgtttgctgctgtatatacaaatgatattttatattgattttatatctagcactcttgctcagacttttaattctgataattcaactgtagattcttgtgaattttctgcaaattgtcttgtcatttgcaattaataagagtttttgcctcttcttttgttattttacaccttctagggatgatgttgaatggaaataacagtagtaggcatttttggatcgttatcaatctcggagagaaaacattcaccactataccactatactactatatatttataactaacttagatcagattaaggaaactccatacgttcctgggatatgcataattttatataaaattgcttatacatatgtaaaattataattatgcttatgtttacataaaattatttgatttgctaccaccttgcataagggttttatattgatacttatgactgaggttgcctaaagctgtcctttctgttggattttgaaattaaggtatgctggcctaacttaaatgagttagcaacaaggcaaagcatccagaaccatgtctagtacatcacaagaagttgtggttaattttcattaataactgaaatttcagtagaggggtaatgccatatgtttaaatagcaacagtagaaaagtaaaaaaaaaaaaaaagtgagtatgtttgggtagtaattaaatgactttgtgaagttgttgggagagattttttacaatgtaagagatttgagtatatttgaatgctcacagaccaagccagtagtgaagaagaaaatgaagatataagaaagaaaggtgataattgatagcgatacagtaggggaaaagagaggattggatcaagaattagatggagtacttaaccataggcaccggggaacatcattttccagggtgataaggggtaggggtaagaaaagaatgctgtgtttgcaagcaagtctttatgtttgatgttaggaagttaagaaaattattaataaattgtctttgcttggagaaataggaggcaagattatcttctaattgggaaaatgcagcagaaggcattggcaataatgagactggaggtttaacaacagtggagaagtttcgaaatagctgctgtggcaaacaagagaggtgactagggaatattgaagaaatgccagggagggctattggctcacatgaggctagagatcaagaaatcactgtagtactaatctacacagttgtggatgtttgtccagcagcattgagcagactgaataaatttaaattaatgtaggcttgaagcttcatcgggttatttttgttttgtattgtgttgctttgtgtttgatagcagtacaacaaggcagtatggttaagaacattggcaaggcaatggttgaagtgacaaagcataaaatctaaactgaacatgaatggcaatgaagaaaggaagagtataacagagacaaagtatggctcgagaggttagtgtgtgttcagcacatctgaagagcttgtatattagtatggattaagtgagagagcttcagagccagaaattatgtttggggagagagagaactgaattcattatcctaaggctgggtaggttctaggcactcatcaagggatgtttgtgagggtggcagaggagagcttcatttagccttctaaaaccagtgtcatttaacggagttctgaggtcaatatagttgtttcaacctgctctgaattcagagtttgtaattgttaaatctctgctattaaaatgatagtgaatcatacacattagattacatctactttgtccttaagtaataactcctgtaattatttcattttttatgttcctatgtcccaactcccaaactgtattgaaatgttctgtgagctggcactatagaggtattatgaaaggcactataaatatttattccatggtaccttgtatacctttgacacttgaaattttttttgcattgttttacaaatttaagcattcttaattttgaaattttcatttttataactcaattatttttctactaagctgcaatttaattactaatttttttaaaactccagatctaacactcaagtaattttaaaagtattatggattaattcatagcttgccagctcattttataaatggggcagttcctttgtataggtattaacccatataataatgctttcaaagatacttatgaaaggaaaataacaccacgcaaacaattgcaatatagatttactagatgtgtgtccaaaatgaaggttccactcccagtttctccatgtctcaaaaggagtgaatggtttttcagttgacggactgtcaagttgtcagtgtttattctgctgccagtggctcagtgtatacaaagactgcagccttatcacctcaagcaggggtattgtcaggtctcataaactaaacagagttttgtctgctcaggatttgaatgtgtgatgtaccaaggattcataatcccaaattttggactagtctttgctctcttggcattgtatgaatgatggtttcatttttttgagtttggtgagaatgtggaagggattatttgattctcactgatgttcatctaaattaaggactttcttactttgataatttttacatgttcttctattttgtcataaggtggtacttatttagcagatggtatatcaacatgttagcacattgtatatacccttgaagataaattcaggtaaaactcaaagtcaaattttgaaatcgctaaggttttctatacccttaaattttgcccaagaatgtggttatttctgtttctgttagtcactatatagaatttctaaaaaaaaaattaatttgagcaaaagttattataagaagacataaaaagtaaagattaaataactctacgtttaaggaatcaatatatgtttttcattagaagagttttacataatgttgtttgcttatttgtctcatttttgttaagtttgccagtgctgctcacatattattgcagactgaattccagtattaaaatgtaatactctagacttagtgtctttgaactttatcacaaacggaataaggctaggaaaagctgattaaagctggtttcacaaccaatcttaattgcatagtaatgcttaatatcttcataaaagtgttttctcataagttggtaaaataaaatgtacgtcagagatattttacctcctaggtacagtggtttctcagatatacttagaatctttattcgggctctccagctttaaattcacaaagtctacaactttgtgttcttgggcaaacctaatgtactgcttcgcaaaggatattatattatataatctattaattaatagattatataatctattaattaatagattatataatctattaattaatagattatataatctattatatattaattaatagattatataatctattatatattaattaatagattatataatctattatatattaattaatagattatataatctattatatattaattaatagattatgtaatctattaaaaatacaccaatttttaatggactaaaatctttaattgctttgtacttataaggaggagagaacagctctgctttcaaatagccagtgattaaatattgcacttgtattcagcattttatttgtattctgattctggaatatctaaaatgacatttatcttttggtattaccctgttttatgttttcttaaagcactttttgcaaactgatattatatcagtctttgtaatataaaacccagttgtaatttgagcccataattggaaaatctgccatagttatttactgtcatagttctaacaatgaattcatgtcttggaaggtttatataatagagagaatctagaaaatattgtgaattgacaatataattatacatataactcttctatgtgtatatgtaaatataattaacttactcttttataatttgtctttcccattacaatgttacttcatgagacaagaactatgtttgttttctgttgtattcctaatgaatggcatataatagatgcttgttaagtatttaatgaatgaactaatgaatacatgtgcatactgatgtaagaatccataagattcttctctgcatctgtaagtttagcagccttgtttttcttctatttacatgaaacataattatttgcatttaaattaaccagaatgttagtgggtgttacactctttatcctcaattcctatcagagttgggcacttgatcaccaaaagtataaacaataattttaatggttaagcaagatatatgtataatttgtttgcaagaatttgttgtgaatagggaaatagtgagtacttaaattgattattccaagcaaaatggaaatacccataaaagtacaagtttattcggaccattagtatttgtacttttaagattattgtctcacagcgagactagatttaacaggctgtagtggaaaaacgtgtagcctttgctgttagacatacctgggttgaaattctgcctctgtcacttactgattgtttgatctttggacttcaaagcaaattgagtttcaagttctataatatgtgaatgtaacacatgtaacatgtgaatagtaatacttatctctcaggatttttgtaaggattaattgaaattatgtttgtaggttacacaataagggaaaattaaaataatacctgttcagaaatatacaggaattaacagaattcattttcaacccaacacaagaactacaaagtctagttgctattctgacaagaagctgctatgtgaggtggtgaaagtaacttgattttagatgtggttgacagaggattatacatgacagtcacagtgatagcatgaaacactaacttttttgtttcatttaatgtcctttatggctccaaaattctacaagtctgttaatcaaggcttggaaactataatatctacagttgtatggaaatctaataacagaaaatctgatggtaaacatagcctgcataaacccagtctttatagtttaagcccataattggaaaatctgccatcttcaattactgtcctagttccagcaatgaattgtgtcttggaaggtttatataatagagagaatctagaaaatattatgaagtagggcctggcatggtggctcacacctgtaatcccatcactttgggaggccgaagcaggtggatcacgaggtcaggagatcgagatcatcctggctaacacagtgaaacctcgcctctactaaaaatacaaaaaattagctgggtgtggtggcgggcacctgcaatcccagctactcgggaggctgaggcaggagaatggcgtgaacctgggaggcagagcttgcagtgagccgagattgggccattgcactccagcttgggtgacaatgcaagactccttctcaaaaaaaaaaaaagaaaaaaagaaaagaaaatattatgaagtaatagtatgttgtgaacacaatagcttttatttctttatcccattctcctttatttataatatataatcattatacatttagctccatcagcttttattctgatgtgtcttcaagaaaatagcttgtaccataaagtcatgagatggatatgcagtctaatactttctaacattaccattgagttagactctcaaaatcattgatcccagcagtctcttgatgggtaggggaaccctgcactcttgaaaagtatattctgtggaccaaattgtttcagcttcttagggagcctatctgatttcactgcagagtagagaaaataacccgtatctgctgatgtttagggttactctgagtttctggaagggttagcagctggttggttgagatcacttctggaggagttctacctcaggtaagcagcattcactgcctcttggagagaatgggagctatctcttctggtggttgggatcatgccaacctctccagtgtggagcaaagatgactgatggggtacaattctgtgtccaagtcttggtgaaaataggaacgacttttctagaaggactataaaatctgaactgtttgcttgttgtgatggttaattttatgtgtcaccttgactgggctaaggggtcccaagatagctggtaaaacattatttctggatctgtctataaggtattcccagaagagattagcattttaattggcgtactgggtaaagattacctcacccatacggataggcatcatccaatctgttggggaactgaatagaacaaaaaggcagagaaagggtaagtttgctccctgtttaagatgggaaattcatgttctcttgcgctcagacatgggcactcctggttctcaggccttcagactccagctgggaattgcaccatcagccccccagttctcgggccttacacccagactgggactgacatcattggctctcttgtttcttaggcccttgggtttagactgaaactataccacccacttttctggttctctagtttccagatagctaatcttggaacttcttagcctccgtaattatgtgagccaatctctcatatcaaatctctgtatatggcatatatttatatttaaatatatatttatatatacatatattcccctggagaaccctgacaataccttggtatgatatcttaccacgtttgagggaagagctaattgtgaggaatttagctactattggcatccatactctcagagaacattcacagacatgaatatgctcataaagagaccgagatagtctgtggtgtcatctgtagtccacatgcttaggattagttgggttaggagttcaagactgtgtctgatacagaggaggcaaagtttagtttccttcccactctactagagagcatcaacagtggggcacactggaatctgtgtcactccaatatctaacagatacacacacacacacacaccagtgaagctccagtccagctcaaattcaacaatatgatgtggtggtacttaacatccactgaacaacctaattcctagtttcagccactagtggtaactaatgttcaggacccagtactatggtaataattattaaaagaacttatattaggaattcacagaattaagaagcatttgctcatatgggtactcctttagcaagatctcattgtcatgatttaattttaagtgacagatagtgaaggtttatttcacagaaattgcacaagtgggcagacagtgataggagagactcaaagagtaagccattcacccatatgtgttggaagcctaccacagacaaatttattacatgacaacactcatgatatgataggttctgttgaaccaaaattccaggggcttttcattacacctcaaattttctgctttctctgctctctaaatttctctgtagtctgagagaaagatatatatatcttgttctctcaggcctatctggacgcctcaaggggattacacattctcttttagcagtaactaggttttatataatttaaatttgaatagttttgagcattaatttcacaaaaagtgctaatagaagtttcatagttcatttatttggcaggggggtgactctcattcaaactaatgaatattatgtccatgtgagtaatgcataattggaattgtaataatggctttaggttactgatgcttgtattgcctcctatgtctgttttttccagtaattttattttccttcttaatcaggacacctgacccattggagctatttagacatcactaagacattagtcctaattaagctattctgtagtgactgaaaattgattgatacttgttcctttgtttttggtacaaactatggtattaaggaaaacttttttgaaactttgggttggctgggatgcttactctttcccattttaagaattctgctttcagttttctgcatatggctagccagttttcccaaaatcatttattaaatagggaatcctttcaccattgcttgtttttgtcagatttgtcaaagattagatgactgtagttgtgtggtgctatttctgaggcctctgttctgttcaattggtctatatgtctgttttgttagcagtaccatgctgttttggttactgtaaactggtagtatagtttgaagtcaggtagcaagatgcctccagctttgttcttttggcttaggattgtcttggctatatgggctcttttttggttccatatgaaaattaaagtagtttttgttctaattctgtgaagaaagctaatggtagcttgatggggatagcaatgaatctataaattattttgggcagcatggccaacttcatgatatcgattattcctatccatgagcatggaatgtttttccatttgtttgtgtcctctcttatttccttcagcagtggtttgtagttctccttgaagaggtccttcacatcccttgtaagttgtattcctaatatccagagtcaaaaaggaacttaaacaaatttacaagaaaaataaacaaccccatcaaaaagtgggcaaaggatatgagcagacactgctcaaaagaagacatttatgcagccaacaaacatatgaaaaaaagctcattatcactggtcattaaaaaaagcaaatcaaaaccacaacgagataccatctcatgcccgttagaatggtgattattaaaaagtcaggaaaaaacggatgctggagaggatatggagaaataggaatgcttttacactgttggtgggagtgtaaattagttcaaccattctggaagacaatgtggtgattcctcaaggatatagaaccagaaataccatttgacccagcaatcccattactgggtatatacccaaaggattgtaaatcattctactataaagacacatgcacacatatttttattgcagcactgttcacaatagcaaagatttggaactagcccaaatgtccatcaatgatagactggataaagaaaatgtggcacataaacaccatgcaatactatgcagccataaaaaaggatgagttcacgtcctttgtagggacacggatgaagctggaaaccatcattctaagcaaactaacgcaggaacagaaaaccaaacactgcatgttctcactcataagtgggagttgaacaatgagaacacaaggacacagggaggggaacatcacacactggggcctgtcagagggtggggtgctgtgtgggggatagcattaggggaaatacctaatgtagatgataggttaatgggtgcagcaaaccaccgtggcatgtgtatacctatgtaacaaacctgcaagttctgcacatgtatcccagaacttaaagcataaaaaaaataataattctgctattgatttgggtactgtttactccaaggttttcttcttgacaaaaaaaaagtggtatattacaaaaaaacaagtaacacatattgttgccattccagagagcaaaacttttctactgaaatcattacatatatatatatatattttatatatttatatattttatatattatatatatataaaatgtgcatgcgtatatatgtttacatgtatatgtgcatatatataatgttatatatatatttatatatatataaaaaaagtgtgcatgcatgtatatatatacatagaaagagagagaaaggctgtgccaaaaccagaaacattctgtttgaaaactggccttcattttaaaaagtataaagtctattaaaacatggttgtgagtggatagtctgtttcttgttatagtcctggtttttgaggggaggttattcaaatgtgcagtatttttactaggaccttaaacacataccccctgttaatgtaaagatgtccttatttacctgatggcaaatatttctgaaaattgagaatgtccccctttagtcatgcctttctttcacaatatgtgaaactctgtgaccttgcattcaagaaacattatttctagctatggaaaatgaatggaataacatttattttctccttgttagttggatagttctgtatttaaatgtttcatatttaaaattatctgtgtattgtttatcagaagtgtgcaagtaatttagaccttgatgatgagtaatattttgcctgtgatttgaagtagctcctctctagcactagcactctgattatttctctctaatataacctcacatgcacaaaaatttttgaagctctatttttttaaatggcaaaaattgatttatttccagatatgatctataacactaggttataaaattcattttaagcagagcttattttaagcaaaactgtatcatgttgaattaatttgtaaccatatttgtaaatattccaattttttaaactttaaagttcaggagtacatgtgcagggtgtgcagatttgttacataggtaaacatgtcatgagggtttgttgtacagattattttatcactcaggtattgagactagtatccattagttatttttcttgatcttctttttcctcccacccaccaccctccacttccaggctccagtatgtgtcgttcccctctatgaatacacgtggttctcatcatttagctcccacttataaatgagaacatgcagtatttggttttctgttcttggattagtatgctaaggataatggcctccttccatgtccctggaaaggatatgatcttgttcttttttatgactgcataatattccattgtgtatatgtaccacatgggcatttaggttgattccatgtccttgctattgtgaatagtgctgcagtgaacacaagtgtgcatgtctttaaaatagagcaatttatattcctttgagtatgtaactagtattgggattgctgggtttagtggtatttcagtctttaggactttcaggaattgccacactgtcttccacaatctgatcccatttgtcaatttttgcttttgctgcaattgcttttggtcttcatcatgaaatctttgcccgtgcctatgttctgaatggtattgcctagcttttcttctagggtttttagagtttggggttttacatttaattattgaatccatcttgggttgatttttgtatatggtataaggaagggatccagtttcaatttcctgcatatggctagccagttatttcagcaccttttattgaatagggaatccttcattttttttttttttttttggttaggtttgtcaaagatcagatcgttgtaggtatatggtcttatttctaggttctctattctgttgcattggtctatgtatctgttcttgtacaagtaccatgctgtttttattactgtagtcctgttgtatagttcaaagtcaggtaacatgatgcccccagctttgttcttttagcttaggattgtcttgaccatttggctcttctttggttccataaaaattttaaaatagtttttcctatttctctgaagaatgtcaatggtagtttaatggaaatagcattcaatctgtaaattactttgggcagtatgaccattataatgacattcattctttctatccatgagcatggaatgtttttccatttatttgtgtcatctctgatttccttgagcagcgttttgtagccctccttgtagagatcgttcacttcccttgttagctgtattcctaggtattttattctttttgtggcaattgcaaatgggagttcatttgtgatttggctcttggcttgactgttggtatataggaaatattccaatgttagattagaataaaaaattctgaagaaactttatagtgtggcaattttacatataataataaaactcaggccggacgaagtggtttacgcctgtaatcccagcactttgggaggctgaggcaggcagatcacgaggtcaggagatcgagaccatcctggctaacacggtgaaaccccgtctctactaaaaatacaaaaaaaaaaaaattagctgggtgtggtggcgggtgcctgtagtcccagctactcaggaggctgaggcaggagaatggcgtgaacccgggaggtggagcttgcagtgagctgagatagcgccactgcactccaacctgagagacagggtgagactctgtctaaaaaaacaaaacaaaacaaaaaactcagttcttaccataaccaaaattatttttaatttatgaaatgtgtcttcaaattatctcctttggtgaaagtttgaaactaaggactctgaaaaagaacatttaaaaattatagatttactagttctaattttaaaaattaatattagatcgttttaaataaaatttattgctacttagattttaattataattaatgtaaaataatgtacagttaaagatttccacaatatcaaaaaggttttaacaaaacatgaatgtccacattgttcctaatccaaaattagtaaccatgttgaaatccaaagatttactaagcattaaataagtatataaataactgaagaagtaatacagactaaaaaacaaacaacaaacaaattaatccatgtctgtagtttccgtaagagcataagtgaacacacacataaaatctcaaattctatcaaaatttctgtcaaattccaaataattctgaaggaccctttttcaaggtgatatttaaatatttttattccaaaataaggccttatttttaagatgcatagtattactatcaattattatgttcatgacacttaaggttgtcgatataggttccccgagtgttactatttctctacttcttttccctctgattttgttgaagctacaaatattttgaggacctgttattctgattttaaattgtcagcatttcttctagagtgttaaatgtctttctagtaaattctctatagatttaataaataatctaccaaagttatatagaaagctgagtttttatagagttcttttcaataagataaatgtttggagatggagatgctctttttgagtaattagagtcacttttattaatcatagtaattcaggtgcaaaaaatggcttttacttactggtagtgaattttgatttttaaaaattcaataaatacacttttcagggttattaaatcctgttataatagtaaaataatatttctggattttgaaaaataatcaaaagtgagaaatgaatctcatttttaacataattccacaaacagcttggattaatataggttgtgctttgaaatgtttaactagtaaaatgaatgcatctagctgagtataatcaccctgagtaagtcacttgatgctcatgaagagaaaaccacttatccactgaaaacttttccaagcaattcttaatcagaaactatggggagttttattgctctggagtacctgaatcaaagtagttttgtggttttaaatggaattgtatttgaaatgctttgcttgagaatttcttcttttgattctttcaaggttgttatgaatctatatcccaaaatgagatgagaaatctatcagtgacaggcttatgcattttagaatgtctgattatagccatttggagctgtaatatgatttgaataagtgcactttcattaaataagagacagtcttttttaggattgtgggggaaattgcatatttctttctctcatgtaaagtgttacgtttatgtatacttttttcttccaaggcaaattggaaattggataattattcttgggacaaacaaagtaattacaatgcaggggttgggttgtcattccaacgtgatttttatttattgaaagtcatgaaataagatttgtttcaccttcttttcctttccgtggttgtcacattctcagtcttttacaaacaaacaaagaaattcaggcctcctaaatgctatttattttctagctgttggtgttagataacctaattatacaatagtctcttccagatattttctttttcttatagcttatagctctcgtgttagctgtatctactttaaaaaataaatacgtgaacattttattcattcatatacatactaatgtttttccaagtaggcattattttttctgatgaatgcgaaacatttctgaaggaccatacattaagaaaaaaattagcaatcatttggtgaaacatctctatcttacatatatatagtgcctaagttttgtgggttgaatggctttcttaaaaaaacctttagtttgttaaaagactagacttctagttaggtatcttttccatagacttgtcttctcccaattccaaaacctttacttattagtgataaatagtaaaggagaaaacgtttttgttttgtttttgtttttcatgtgtttgctatgatgtggattggtttgtccccacaaaaactcatgtttaaatttgatcctcagggtggggatgtgtttggttcatgtgagtggaccttttatgaatagattaatgccttctcactggaataagtgagttctcactctcggaaggctggattaattctcatgggaatgggttagttcttgtgcgaaggggttattataaagccaacaccttgggtcttgtctctttggacatgtctacttcccctttgaacttctgccatgttgtgacacagcatgaaagccctcaccagaaaagatgaaggtgctggtgtcatgcttcttgaacttcccagactaaggaactatgagctaaatagacctttattccttataaattacccagtctcaggtatcctattagagccccacaaaatggactaagacacactgtaagtacagacaatctctatataattacagttttatagttatgttatagtttattgaagtccaagaaaaaatctattttaaaaaaccttacttataaaaattgctcacatttttctataaggtaaatcaattctttcatgcttttctcttgaaaaccctgattgctgaaatacaaaataatttttggctacacttcttcctattcttttgactttctcctacaatattttatgtaatatttaacttttagcctttttttcactgtccacatttttgatggtagaagtaatattcccgttcattttttcaaggctttccttttctttttttgaatggcaaccatgttttaacttactgaggacttcatattcagttttatcttattgttgctaacagaaatatattttgattgaaaatacattggtgcactagagagtgaattgtaattttggacgaagtattttcaaaattatgttatttagacaaataatcataagtagggttttttagcgaaagtgtgatttttaatttttggtttttttttttggtcacaatgtagtcacacaaaaatatgatggggctgttatatcaatccccttttccaagaagccatttgggtgaatcatggcatagcaaggttagacctatattgaggaacaaaagtcacaggttgcttcaagatcatatagcatcatccaaaggttttgagtacttactattggtaatctttttataaagaaaatatgatagatagatagaaatagagataatataaatatgatagatgatatggatatagacatcatccacttgagaaaagaaagataaataaatgtaaaaggcaatatagaccaaatacattctatattactaatatgtactgcgagggaaaagggtcaaatatttttgaattgagttattctgtacagtgtgctatagttttgtgacagacatacaaaacaatttgaaactgcttgggtcttatgcataagtagtgacatagcaggagataccaaaatctaaagttattcaaaacattagaggattgtgacatacttttatgttggctgtatagttttattaaagcatctaatttaatattatttgcttattttttgatgcacgtgggacaaaaaagaaatagcagtaatagcaggagagaagcaagaaatctaacaacttaacgtttaagtcaataataagtagaaaaagaaaaatgaagctcattccgaatgatctgaaacacagaaaatgacatatatgtagtgcctagcattctaatcttgtttatctgatttacttaataatatcagcaatagaaattgcctgcaaatataagagatatccaagaaatgaacagaaattttgattgtttgatactgtagcttggttatagcaatttaaagatcattgaggtagatgaatgatgtagccctgttacattgtaaagagtgatgcatttcacttcagtgcaatgacattgggtttaagataccattcagtagaaaatgaaaaccaaaaatttattgattagtctacagatagtgattttttaaagaaatggcataatttaagaaacattttaatcattttccttatacagactattaactttacaaatattgagattgtttctatagatagaagacatttaagcctacaagtaataaactgaaaatatatttctcttatcttcaagaattctgttaatattaaccatttatcaaaaagaagtatcataaataaaatattccaatgcattttgtatttttaatgttaaaatgtcaaataccttcctttaattttgacagcattttatgaattatctttctcatataatataatgaaaatatactttttgaaagatagcatgatgtgtgagtgccctacttggtaatatctatttattatttcctgatttcctaatttattcctacttcagcaacgcataggaataaaatataattttattcactgcttattgctgaataaaggatttaccacataaaaatattttatttttatagaattattacctctggatataaaatatgtatatatacatatacacacaatatgtgtgtgtatatatatatatatatatatacacacacacacacacacacacacacacaatactggtaatactaatatacacaatactggtaatactaatacaacacacaatactggtaatactataatcaattgcagaccatacattaaaaaattttattctcatggaagcatgtaattcttgattaaaaagatatagttttgttgtgtttgaataattaagttttcagcattaataaaagagcagtgaatgtgccttaactaacaaaaataaattggatggaaataaaagacaaacttttcacttgcaataaggaaaaaaaatgacaatgataaaaactagcaaagatatttaagtttgggtgaaatagaataaaaaattttagtggaccataatgtcagagaagtagtgttacctctcccaaaaagctaatgaaaattactgaaatcattaagaaaattatattggaggacaaactcatgaaagaattaaagttatatcaatattactttcatgtatataatgacagacacatggaaaaaatggaggtgttttatattatttcaaagacatgttttgaaaaaaagactcagagttgtaaagagacaaatgtggctttatgcattactcctttagtgcattatgataagatttgaaaagcagcaggatggtgcttatcttgacccaaaatatccataaggtgctaaatagtttgttattagttatgcagtgccataactaatattaaatgacagcttttaaaataatctgaacctgaaggattgtcatttaaagctataattaaccactacaactaatgcatggatttatttattgatctattctttctataaacaacatgaaagtaattaacaaacacaactactgcaagattcatttattatcctctcttttccataaacagaatgaaagaatcagaccacagggctctactgggaaaatctggccccaggtgaggaatattaataaggactgatgtgctgactagagtaccactgaggcagcgaagtcaggaaaatgagtcttcacagaaagggaaaaaagattaaagaaaaaaaagtattatagagatgctttgcctatttttcccttttgctttaagttgatcttggtgacattctcagagtgtaaatatttgctcaattaatcctgtgtgaatagatgaaaaaaatgcatgatgataggacaagtacctaggagacaagttggttggccttacaaggattgccctacagcaccatgcagaattaagatcccaaactgtgaagggatttaacttgtcactagaatatcatttaatggtattgctgtaaatacacagctccatatcaatcatagttaggcacttacaatcccggagtatccagtctttgaatagttagttttccagaacccaaagaaatcaatattccttttcaaaatagtctcgactgtgttcattaccttgattttttaaaatgatttcacaggtgcatatatatgtcaaatcttaccaaatgataggctttttacatacatgaaatttatactgtcaataatttaataaagagattttcaaagccaagtgcacagctaattaagtaaataaataaaatagcattgatcatcaggatttatatttttatttttatgcaaagcctttgactattcagttattttttaatatattttaccccatatttcacaagaaatgtgaatgtaacggttacatgtaaagttcaaaaactatgttttttcaattcattttataaagaaggttaggctaaatagcccttttaaacatacatatcatcattcaccttggttttaagttgtttttcttgactatctgaagatggctatacttaatattgtctaagtgatagggggcatgtgttaaaaatatgtacatttctactgcctttgctattagtaaagcacacttaaatgagtaagaagagagagaattttttaaacatagcttattgcccatgtgatattaaaatttggttttctctcttagttttcatgggaagacttaggtaaattagtattttacgtaggaggtatgtacaaaaactgtgtccgctattaaattattctaccttgaattgtgattttattacatataatgcatgcttattttggaagtgtgttataaaaaccattgatactttgccctactggagaggatgattcttactagcattctgataaactgtaaatccatggagtttatcacaaaagcaattttacattattttggaaacaaaatttcctatatagtttaaattatttttgattctatatgttatctttataagaaaaaataataaagtttcttaatgtcaaattttaataatcaaaatacatctattaggcacattgcgtacatttttaaaagccaagtaaaccctgtagtaaatataaaaaaaaatattaaaataacaagataaatattatatatttatttatttatttgttagaagttggacacttaaaagggtgacagcctttgcatacgactacattaaaacaatttaagttaatttaagtaaaggaaagaggcattcaagcatcaactgttatttatactcaaattatctgacagctttatgttgtgacatttggtctttgcaaaacactcaaaatataagtcattgctctgtaacctcacagtcagctttatattatggtagtcatgaatgccagtttgtacccaacgttcataaatcctactgcctttttcaacaggccaatcacaggatgatcatagggtttctgattcacttatagtgaatttaggtgaaatggaatataaaccaatttctctgaaatcatctaactataaagttgtgataaaagagacatggtgtggcaagaattatactgcagagatctttattacattcaatggttgacatcctgggctggtcctaattaaaacattggcctgtagaagccaaaagtaacttccaaggcctaacaagcacatcattctgtggcctatggcattcattcttgagagtaaggaataatcagtagtagaatgggcatcctcttcatcatagttccctgggactgagggttagatgtgcatgatatagtatacctataatgaatcaacaaacatagatctttctccaactttagttcaactaaaagtcacttttgacacatgttaaaaaaaaacatcaatactcaagctcggttcccagagattataattgagggcttttcgaaaggagctcaaaaatctgtgtttttaacaagcagtatctgtagttccaccacactttacgaaagtgctttataggaaacttgcaaagtatagggaattaggaactgtcaaaagacatacaatgtgatccttgcacctaagtggcttacagcctctttgtgggacaagtcatgtacacaatctaactcagtattagtgacaggttcttacaagtgccacattacaggttgtgagttctagatgaaatcctataattaagcactcactcaggctggaattgccagggaaaccaggaaataatagaggaaagggtaaagaaaatttcaagtggaatgacctgtatatacagaatagagagatgcgtgggcctggcatatttaagaggataactcttggatagatgcttgaataaactgatataatagattgaacaatatattataaagagaggagtatatattgtattaacagaggaatttgtataggagtatgtattcctgtagtggaggattttgagaaactctaaagatgtagctgactaaccatctagccgtctatttaatctagggtttggcaaactttttctgtaaatattttaggctttgtgggccatgtatgtctcttttgcatattcttccttgtttatgttttctgtatatatgtatgtatgcatgttacatatatatatatgtattttaattttttaaatatgtgaaagaattcttcactcaaatactgaaccaaaataggctcaagggccaaaccatagtttactgacccctgatcttatccgtccagcttctggcttcttccacaaagggtttaaagaaacttggagaaataaaatatgtatattataaatattaaatgtataataaaaaattagcaagtaaaaaaagtcaatacctaataagggaaaactaacaaaaatatcagttactatatttgagcttaagaatttggtttcaggctttcagaaacccagtcaaaaatttgaccagttacttaggtcttatatattagggcaataagacaagccagtctcccttcttagcattcctttctaaagcagtgcctcacataggacttcactctcttcaacagcttctgtaaaccaaatgcaaataagcctgttttgaaataattttttgatgaaagctgagaacgtaaaccataaatgcccagggaggcagttatgaagaatattaaggattgtggcccaaatatggagtcttcagtttctaggctgattcaagaagaaaacataaaatatgaattggatatttgtcaaatcattatatacatatattttccactttgatttacagggaattttaaatcaattgcttctttttgtctaattatataaacttacctacttcttatgcaaaacttggaaaagaaaaagaaaaatcattcgtaatcttactactttgaataaaattcctgttgatattttgatgatttcctcttattttacatacgttttataactctataaatgtattttaatgttatcatttaacttacgcaaatattccaataactcttcattttttggccttttccatttttgcccttttaagtgttggaataaatgcaataaatagatttctaaaaaaaatgaaatcgctatactaaagtctgtagcattctaaagtatttaaatgttatttctgtttactattaaatttttttttccgttttactctttcaccagaagttatgaaagtgcctatttacaaaaatgtaactccttgttccacttatcactactaaggagttacattgctgtaaacttttgataactataggaaaaaaatagtgccagtttccatttctgttattactagtaccaaataattcatttttctcttttatttctaattatgcatatttttctctcatttatattttaaaagcctagtatttttaatcaatttttcgagatctttccatgccaaggattttaatcttttgtcatattttttaatcatgtttatctaatggatgatttactttttagatttattttgttttgacttagaaaaagtagtaatttcaatacagtcaaatcactttccttatgatttcttctactgacttctaaagaatgaagccgttactcagcaagatatcagactcataccatctgcttcctccatcccccattgtgtggtttgaatatttacaattatcttttcaatccatctgagatttttttttgtatggcattctataaagaattaagtggacattttttccaaaataattgaataattttctatatatggaaaaatatatccttctcattgatttatgatgccttaaattatgtattatattttaagtatgcttaaaatcttagtatattatatttgaattaaatagatgacttgctttcatctttgtttcacaatatagttcatttggcttataattagtggatcatcttgacagagtctaggtgactgatggtcttatttttaatttgcagattttcattttcttgtcattctttaggggttagagtgggtaatttgaaaagacatgtcagaaataactacttagttagaaacctttgtgaaaagccaaaagttttatccttcgaaagcaggctactactggtcagtggcaatgactctacatcattatagagaaatatgcttatcttaattgctatgaaatgggagcatagaagtcaactgaaagcagtttcaagtcattgaaatgaatttgtttgttttagggcagttcagaaaagagttgcattttgcatagcttgaaattatcatctgatctctgatgaccattcttgctgaacttgtcttttgcaatgctattaacacacaggttatattcaggcagctaattgtagggcttctatgttgaactcaagtttagtgcagactttttgtccagaaattcaaaaacctagcagtactcattgacacgtgcaaagaatatgttatttttggcttatttataactttgaccacatacaatattgaaagcagtttctctaattattcttcattaatgattgcactaagaatccaacaggtaatttataagcaaaggaatggttttgtcatttcaaggaagatgacttctttattttacttaaattatagtatgagtttttccaggtaaggtcacagcaaaattacagttaccaaggtgacaataattagaccccttgaagttttaaacaatggcaaaataatcttaattattgtttcaatgtaagctttccagcaaaacaagctatttgaggatagatttttaaactttagactgaaaatctcttgggtatgtgaaatccaaagcacttacacgaagacatgggaaacctgggaaaaataagctccatggatgacttttggtttctgtgttcctacaatttctcttctcctgaggacataatttcagtgcctaggtttaatctcattattggtcctgagtcccccacaaggagttatgtttgagttttgaatgatatatatatatatatcatttgaattatatatatatatcatttgaatgatatatatatatatataaatatatataatatatatttattttttgagatggagtcctgctctattgccaggctggagtgcagtggcacaatctcagctcactgcaacctctgcctcccagattcaagtgatactcttgcctcagcctctcaagtaactgggactacaggtgcccgccaccatgcctggctaatttttgtatttttagtagagacggggtttcaccattttggccaggatggtctcgatctcttgacctcatgatctgcccacctcagcctcccaaagtgcggggattacaggcatgagccaccgcgcctggcctaatgttataatttttttataaaattaaaattgcatacgtaactggtagtcttttcaggattctattttggtttttttccctcatgaaactatttaaagctcatttgtcaaatcaggaactggaaagataaggtgtacatttacctgcagttgagacataaaaaatctgttttaaaaccaaaaaatgttttaaaatatttataacaattggaggcaggtgctgtcttttacttacaagatttaggaaagcttctctccatttaattctttacttcctaatctcatcaatctaaccaagttgtggacattctgaagagccaccttatcaaatgagtggaaaatgattaatttagaaactatagtaaatccttacttaaggtcattgctgggttcttggaaaccgccacttcaaaggaaattacatataataaaaccaactttcccataggctaattgatataaacaagagctaagttcttagggcatatttctggtcagagaaacattaccaaacttctaaataaagacccagaacaattctaacatgaaacattgaaataaatgtgacctatgcatacttttaagaaagataaataaaaacaagtaaggtaattatttactcaattttggtgaattagtgagtgacagtgattgtggtggtgagtccactgaaggaataaaggtttacaaagcgaaaatcttaaggagcaccccttcccaccatgcagttcaaaatcaaacaatgaaaaatatggcagactagaggagagctttagtaccccatcatttcttgttgcatttgtaggattattatctcctttaagaatttttattttacaatcatttgtattcattcatttattttccaaccagcttattctagttcagggttttgggtggctggagcctatccctgcagctcagggagcaaggtgggaactgactctaataggacactattccatcacagggcacacacactcctacacactcactcagacggggatcattcagacatgtcaattcatgtaatgtgcacatctttgggatgtggaaggaaacgaatattcagagaaaacccatgagagaagtacatgtacactccaaacagacagtggctctggccagaaattattttttttctcatcaacattataataaaacaacattgaacaaaacaattttattcgaggacctactgtatactaaactatatttcatagaaggctaattaaaatgtagtctgtaacactgtttgctaaaggagagaaaaacagcactataatccctagacctactctataagccacctgtgttgttttatatattcagaacataactactattatttttacacacacacacatccacctgttcaccactcccctcccacacacacatacacacacagcccaaaaggttgagtgtatgacccaagctagaccagccaatcatggcatcccacacgaaccccatcaattggcccagtaatgaacatgtcacttgtatttttagtagagacggggtttcaccacattgaccaggctggtctcgaactcctgacctcaggtgatccacccacctcagcctcccaaagtgctgggattacaggtgtattatcaactggaatccttttccagggtttttataagggaaacttgttaaaaggggatctctttcctcttgagtctaggctttatgaatgaaagcccagaagtacgtgtagtgttgggttttggagataaccagactggtagaataaagtcaatgagaaggtgagtggcatagaaagattacaaatactgttcgaattcttggaccgtgtactcatcacgtaatttctcatttctcacccctctcccaccctcccacccttctgatctccagtgtctattattccacactctatttccatgtatacatgttatttagtgtccacttgtgagaacatgtggtatctgacattctgcttctgagctgtttcacttatgataatggcttccagtttcatccatgttgctgcaacaatcatgattttattctttttatgggtggatagtgttccattgaatagtacacacatttcttttttttttttaattttattattttttttattattatactttaagttttagggtacatgtgcacattgtgcaggttagttacatatgtatacatgtgccatgctggtgcgctgcacccactaactctacgctgggctgggctgggaaagcctgcactcaagtccaatgatgggcacaagtgctggccacaatggggatcagaggacagtcctcgggcctctggagaaatgccccagcagggggtggagcaaccactgctgtgtcaaagacccagcatggagaaagaggtgcagcctggtttccacagcctagcaagtgatattgggacctgatgcactgtcatactgccaacctggcagggctttctcccgccacccaaagctagtgctaagtcagaatacttagctgagtcacacacaatttgccttcagaccacgtaactgcccaaggtccacattcgccacccgggtcaaaaccacacctctcaggctaaaaccctctcagtccagtcccacaaaggggaagcacacaacttgagggcccatgctggagcccatcccacagtcacctctcagttctggctttgggagttcctccctaattcaagacaagatcacaaaacccagcccaagacactctgaagcagtgactgtcattcctgctagctgcttaggttcccatacagccctctctgagctaggattggtgtggcacccaggtgtgagatccttcctagtgtcattcctgctccgtctctctgctactccccaagtcagatctggggtgtggtagggtcaggacgctcccctgcggcctggattgcctggctatctggtgggaatgtgtattgcagagacactcacctgctctcacacactaggaatttactcacaattttctgctggatctcaccacaaaggattctgcccattttcttttttctgttatccaaaattttcttttgctttaatgttgaactcctgtgttccttcttggataaaagttcacagtatcaatctctacacactattttgctgtttccaattgggtgaggggtgctaacaaagcttccattccaccatctggggaaaaacactcaagaaagagaaatacctctgtcttcattgtgcacttgtggagagagagagaatgagctttttggtctcatcttatagggacaccaatcctgttgatcggaaacccacctcatgacttcatttaacctttatcacctcctcataggccccatctccaaatatatttggggttagagcttcaacatatgaatttttgaggtggacacaaacattcagtccataacaaaaactatagggtaaggactctgttaggataaattcaagcctttataggactacatcattaggtcaaatggggcctcccacaatgattttcatgaaataaaaacagatttaaagaaaatgtagatttcataatgtctgccacctcttacatgttacattttacctaactcaggctagagggatcacagaagatataattatataaatgaatatatagaataactgtgggtcaaagatttattaaattataaccacatatctaaactgactgatagcaggtatcttgtctcgaaaaatataaaagcactgagctaaagcacatctatcttctcggagagctgaattaggataggaagaaataaatgcttgttgtatgattctggtagcccacggccaattatgttagattgatggagaactgagtgaacgagtctccctttcctgagcctatttttaaatgatggagagaaatacaagttttatgactggacatcataaaattatgataatgactgaatctatttcctgaaaccatatgtcttacagatatgtaattttgaaatacaaaaaattttaacatgtcagtatcttttaattcagggtcacatccaggcatatttcaggagaattttattaaatgctaggaagactagaatatccatgtctggaataaaattatagtcagtttaatgcagtgattcttaatctttttgcacattaaaatcacctgggaagctgttaaaaaatgccaatgtctgtttcccaccccaaattaataaaatcagagtctagaaataggatcaggcatttttaaaaaaagtttttggttaattttattttacagaaaatcactgtcctaatgtggagaagcaattaagtcattgtctaaggcagcaaatagtttaattccttggtctaaaattagaaggtccagcctgtgtagaccaacatattcttgtcagccaacttcatatgaggtgcaaagctcactgaagtgtcaagacaaatcagtagtcaaaaggaatcaaacattactgagtggcaactgaaaatctcaacccacatttggaatggtcctagagaagtgttatttcctggaactaaatggagattggagacattcagtgtggctttctgtttgtaaaatccattgaggggataattcttactaattagctccctttggaaaagtaattgggagatttagtcataagcagcaaacacaggaaattcactgcaacttagaacctgaactttaatcaaatatcccttcagggacttgagtctttataaaagaatatcctgttttttcctggacactaggcaatggaaaagagcatcacatcctaggatgccttttggtgcactaccaaataaggagtaaaatttgtggtgaccatttgaaatactttctttacctatttgcatatgatttctataatcctttaggaataactttgccataatcatctcctgttaaatacttacaataaggcaaagacatagggatgctgaagtgttcagttttttccagtaagtaaagggaaccattaaaattttctgagcaagtaacttacatgcatagagaagttaaggaagttgactttagaaagatatagttgaagaaggagaaaaaataggcaaagagatcagctataaaatcatcatagtaactataccaaagcagataggacttcaatataatctctctctctcacacacacatacacacacacacacacacacacacacacacacacacacacacacgaggttgcaggattttttaaatacaaatgtaaaagggtggcaaatgaaaaagtttaagttgtagcaataagatgcaatgccgattacactctaaaatagataaaattctaaaatgaaaaatcatcaaaggaggatatagtaactgcttatactattctcaaatgtccttacatcaagaacataagtctgccaaaggttagagacattttggagaagacttctctgtaaaagctcttaatgtgttacgagtcttactgttacagcacatcatcctatcctaccaaggagagctggagaagaattcagcctcacctcgaccgagagaggataacataatatgtattttcttcttcttgtttttgtttttgttttgttttgtttttttttgaggtggagtctcattctactgcccaggctggagtgcagtggcacaatttcggctcactgcaacctctgtctcccagattcaagtgattctcctgcctcagcctcctgagtagctggaattacagatgcccatcaccatgcccagctaatttttgtatgtttagtagagacagggttttaccatgttggccaggctggtctcaaactcctgacctcaggtgatccacccacttcagcctctcaaagtgctgggattacaggcgtgagccaccgtgcccggcccataatatgtattttctataggttggaggactcagaagtgtagtgactgattttttcatacctggaaaatttatgcatgattgactaagtgcttttatagctaattaaaggaaagattgaggctacattatatgatttgaactcgcagtgtttatgtggaaattatatatgtgtcccatggaccagatataagccatttagaagacagaatatctcttgtctgggtcaacctggtcccattctgaagcacgtagacatatctcagtagagagaatctgaaggtcctgatagaatgccaggggttcaggaagaagctagcaaactggtagaataaatatgaactctgtgtaatgagaacatccataaaaatgtgtgcaatgctgggaggtgggggaatgtcatggtctccagagaacgcatgaaagttgtaaatctaggaccaggaacaatgaaggggttttcctcttctgcctttctgtgctccaaacctgagggagccagcaatcccggttaggaagctgagggagcagaaatcatagtcatggcctgataatgagagaaaaagtcaactatattttcccagctgtagatttcccacctgcaaaaggcccagattagaggagggtagaagcctcaatatctaaccagggccagagtttgaattttcactaaggttagaggtttttaaaattgttgaattttaagaatgtgatcataagtcactctattgcttaaaaatacacagaaaggtcataggacctgtctaaattttttgaaaagtaaggaaaaattaacccagcagaaaaaatttgaaagtactctgagatgcaaaaaatatgattatttttattgtactttatgaatgttgcttatgcaatctaacattaacaaagctaaaagtcaagaattataaactactaagaaatacacagatgaataattacattttatgtctttgtagcattttataattttacatgtattctcttatttgatcctaaatattctgaagataaaatagaaataattttcttcattttatagaagaataacctgaagattaagggtaatgagtgacctattatatgtgttgaagtaggttttaagttaggaccagaatccagatgactatctataaatcttacccaagggcacagctccttaggtaagaagtagcctttgcaattttcctgaaagctgttttcattaattcattcagtaaaaattattgaccttctaccatgcctcaggcattgataggaattcattagggaagaaatcagagaatcccacttcttgcatcgaactttcattctaatacagaaaggcaggcaataaacaaacagaacaaataaaaggatatgtcaggtggcaaactttgtgaaaatataaatatggcatgttaagacagacaacaagacagagactattaggaaccagagctgctgtatgttatgtaggccatactagagctgggctgagcagaagggccagaggtgggtgcactttcaaaaagcaaagaggctattgcagctggagcagtgagcaaagaaatgtgctaggtaggagatgatgctctagcgcaagggagtgcatggtctgagaaggaggtcatatagggccttctaagatcttccaaagacttgcaactatgaactattcaccgtgaatgctatgtgaagccattcacgtgctttcaccagaggggtggttttgcctggctggttttgattctgttttttaagataattctagctgatatgtaagaatagatgccagcaagccatggcaggagtgagaagactggtgtggagactactgtaataatggtccagcaagagctagggtggcagtcgacatgcaaaggcatgttttctacttttttaactttttattctgcaggtggtccttcgctggtctcatactgcatttccttaggtcacattggtgcaatctgtaataaaagatgcctcaatgacaaaattgtttgctacatggagggattcctcactcccatgtctggaaatgaaatcttgcaggtcattaccagttaagataacccttgaccatcctttgtagttcactctgcctttgcaccatcatcctgtcagcagatttctctatcactgaatgctatttattttctttatagcactcattataaattgtaattgtacatttatatatgtatttatgcagttattgttcatttttctcactagactctatgcctgcagaaggcaggatctttctctattttatttctatttatggaatgcctagtctacaatttgacacaaagtagttaataaaaattacatatgaatgaatagaaatagtttgacttttactttacttctaaggtatcccagatctctttctcttatctctatctaaatgaaaaagctaaggaaaatatctgaatgatttcatttttaaaaagaaaaattatttaattgaggaagaaagagaataccctcccctcatttttcaactacattgattatatttttgtggtagtcagaataatatccccccccccaaaaaatatccatgccccaatcctccaaacctatgcatatgttacattcctgaggaatgtaatggggaaagaggaattatatgggaaagaggaattaaaggctataattatctggctttaaaatgagggattgaggattatctgggtaaggccagagtgataacatgggacctaaaagggaaaaaggggagacagaagggagatcagagggatgtgccctaagaaagacaggccctgccattgctgaatttgaagatggagggattgggccatgagtgaagaaatgtggatgcctttacaaggtggcaatacctctcagtttaaagctagcaagataacaaaaacctcagagaactgcaaggaactgaattctaccaacaattgcaattatcaaaagataaattttccttttcattcccaaagaatgtagctgtgcagacaccttgattttagcctggtgagacacatttgggactcacttagtattcatttagctatttcactttttataatgcagaatctgccgatattataatgcaaattaagatctttatgattagcatctttgaaaaaatactttttctttttttgtttttaaacttcatatatttttgtaactattttgaaacataatagctgatgttatcggaatatatttgcacctgaaaactgtttcctcatatttttatcataatattaatattcttaaaatcctgcagtggcattgatagtagccaataaaatcaagatttaaattttaaaaatgttctagacacagttaaatcttaattatgccatttgcttaacaaggcactttgtaacaccttcggttacaccaaaggcacttcggggttttattgttgtattattgttattactttacactttctgtcctacaattataactgaaagctacgagactggatttcaggaaatgagaaaagttgaaaagcaattttactgtaacttctcagaagaattactagcagatttaagaaaaaagaagtaaataatcactaccaaaattaggtaatggtctcatactgcatgtgggtaattcatgaatttcatttcatatcacttctcatttctacaaggttttaggtacaatatgaaaaatgctcatagacacttaacatttgcccgagtgacagagactatatcttcttgtttctttcttccatgtaccagtaggaactaagaaactttgaagcatattcaaagaattctgtttctttggtaggaaggctggctgtgcataaaggctggctcctgctgcatggttagaatcttgagatataatttagcttttcagaaaaagacatcatgtacgtgtcacaaagtctagtctctgaattttttttgtttcttatttgctgaaaaatacctattctacttcctgaagcaagttcatatatttaaaaatataacagctttattgagttataaatcaaataccataaagtttatgcttttaacatgtaaaattcagtgctttaaatatatccacaaagttattcaaccctcagggctatctattttaaggatattttcatcactctaagaagaaactgtacatccaatagtagtcacccccgacttcccccttttctcagcctctgacaaccattaatctactttatctttctatgaatttgcctattctagacatttcacataaagggaaacatatgatatgtgatctttgtaactggcttcattcacttactattatatttttaagatttaccactgttgtagcttgaactgatacttctattcctttgcattgataaataatattccattgtctaggtgtaccatattttatttatccattgattaattaataaacatttcagttgtttccgcttttcctccattatgaataatgctgttatgaactttgtgagcaagattttatgaggacataatttttttcatttctgttggatatatacatatatatatatatatatacctaggaatagaaatgatccttcctttggtaactctatgtttaccactttcaggaactaccaagttagtttccaaagtgaccatactgtttagtgtctccattggcaatatacgagggttcaatttctccacatcttcaccaccacttatttcatgttatttgttatcattcttattattattgctgctgctgctgttgttattattgcaatcctagtggatgtgaggtgatatctcattatgtttttgatttgcatagttataataactaataacaagcatcttttcctgtgctcgttggccatttatagatcttctttggagaaatgtcctttcaaatttttcgatcattttaaatcgggttatttttctatatttttaggttgtaaatcttctttatataaattggatataaatcctttatcagatctatgatttgcaaatattttctgcccccctctgggttttattttcacttccttgatgttatcatttctagaataagagttttatattttttgaatctatactttttctgtgcttagaacttttattgtatctaagaaaccattacttaacccaaggtcccaaaacttttctcttacattttcatctaagatttttagagttttagctcttacatttaggtctatgatatattttgagttaatttttgtatgtgatatgatatagtggcccaagttttttcttttgcatgagacatccagtttattccagttccatttgttgaaacatctattctttccctatggaatggtcttggccctttgttgaaatacaattgactataaatatgagttcttatttctgaactcttaattcaatttcatcagtacatatctctgtcctaataccagtccccactatcttgatacctgcaacttgtggcaattttgaaatcataatgtgtgagtcctccagttttgctctttttcaggatcatgttgactcttctgagtctcttgcatttccatgtgaactttatgatcgtctgtacgataagcagtaggattttgatggggattgtgttgaatctgtagatcaatttgggaagcactgtcatttaaacagtattatcttccaatacatgagcatgtctttccacttacttagatctttaatttctttcaaaaatattttgtagtttccagtgtacaagtcttactcttgttaaatatatttctattttgttctttttgatactattgtgagtgacattgttttattaaatttatttttgattgttcattgccagtatgtagaaatataactgatttttgtacattgaacttgtgtcctaaaacctgtgtgaagcagatacctttttttatatgtactgtattgccacttttaaatcaaatatggagtggctagtaaaacttttactcctaagctttatttctttattaaagcttataataatttctttaagcagaggaagtatttacctaataccttctgcttccatagccatcaataaatattttaataaggtactgtacaaagcaaaatggatttaagaagatatttgatatgctccctagtctctataagcttattatctagtggaaaaggggatacagatgcataaatgtttacatgtagtgttacaggtcccatagttgatgcataatacaaactagtaagttatctaccttgtttgaaagtagatttacctgtccttttatgcttagaaagaaacttattgtattttgttttgcttaactcagaattttaattaagtaagtaatctttgaaaatagaataacatgtccattattttgcttacaaaatactgataattgtaacacaatgaaacataagcagggacctgacactggcaaagttagcatatttgtaaataaaggtttaacagttcgcatactttatctttccactataaatgttttaagcacctttctaacttattaaagatatttcaatttaattttatatcaaaaatcacaagacatttgggctttaagactttccatcgtcttattgtctttaataatatctctgtggtcagttaatattttaagtactttttggctatttgctatgaaaactttaaaataactatagttaattttaatatacagtgattattttaaaatgcacctattatgtaattatttactattgctttctaaatttaattacacattgaacatattagctaagtgtaaatatgatatgcatattttcattgcatgtatttaagtaaagcaactcttatttaaaaccaccactcctatccccacttcacccctttcacacatttgtcattcctaaagtatctgcccctctttgcatctgttagtcactgtcatagtgtctggaatagtaagtatttatagtgttttcaaaggaaggaatgaatgaatgaacagagggaacacgtattgaattttcaaggaagtataaatcactatgaaactgagtattgagagaagtttctaaagacactataagacacaaaaagatttataggatttccataattagagaagaaaagacaagggatttgaggtatgaacaagggtatggaggtgaaaatgtgattgcatctgaagaaaatgagcagataaatttgactggattagacacagacatgggcagtatatggtcctaccaaattttacatgccagaatgggaggcaatggatgggaacagggaaacatcgataatgatttcaagtttccatagtaggttactggaaggatagtattgctcatgttaaaaactgagaaaaccacaggataatttggctttgaagaaataattttgactttaaaaaaaaaaaacatgttattcggtgagacaagacacctcaatagaaatgtctggtaggtaatcagaaatgtgagactggcgcttgaaggcaaagactgaagtagtggtatgggtttgagagatagtcgttaaaactgtgagagtaggtctcagaggaagaaatggttatggtgcaacacggggtggaggaatggctcttagtgctagggaaggctaatgccgaatgggcatgaggaagaaatggtgacacaggatgagaagcaagagtgtatggacagaacaaagcatcccattatccacaaaatagtttcaggatgaaggatgcaattcattcaattaaaccttatttgagtatataatgaatacacaaaaaagattttaagcagctcatagtccactgaagaaaacagaattttaactggaagaaaaaagagctttacagatataggaaaactcttattataagatcataggaagaacaactttgcataaagaagttaaagattatttcataatgactttctgatgtcttcaaaggtggtttttgtgaacagaaaaaaactgtgtaggagtttctttgcctttaaaaattaatgtataatatattaaaattgcaaatcaaaatatctgctcccttattaaacctctaacgttataaacctttagtctcagtctctctctccctctctcctctcctctcctccctctccctatccactcattgttttaacaaccgcttttaagtctttgaataatattggtatcatttaaacaattaaacaccttcaagtataaaaactgcatttataaattaattatatttgattacccttttaaagtactgcactttagttacataaataacaaaatgtcccaaatattttaataattccaataaatgtttaagtatatggcatcttgagtttgtttacaagttccaatactatatatataattaataaaatttttactttaaaattacatatctaaattattcagttgtatattacttcacttaggcacactacgagtacacaaaatactgtactagaacataaaatggcaatatatctgacatcaatatgttaatgtctttggttttattctcgtaaacatttctgttactctttaggtttgaaagaagcttatccatcaaaacaaaaagtaggtcatcctaagcaatttgagggatactcagccatgatattgacaggttttttttcagcattattttggaacatactgagatctagaagtaattttaatataattctataaattggaagaactcaggtaatacataatctattatgagtcgagaaactacccctacatttatatgtttgcttgaattttagatatttcgactcctaagatataaaaatgattttgctccgtttaaagacctttgaacttcatgaagacctttactttttttatatatcttcagaatgaacagagttattatgggttaagaatggcaggttaattctgaatatatctcattggacaaatacagttagaaaacagagtcacattaaatttagggctctgtgatactttctatcaggatcttagtatgagtaaagcaagcatagtatacatgactggaaaaattagtttccattttgaagggcattgtatgcgaaactgcggagtttggattttaccccatgtgacaggtttttgtgagtgtaaagcaagatgtatatggcagcaatgtgatggatcgcttagagaagcactaatgtttggcagggagctatgaagttgttgcagaagtacaagcaaaaaatggtgagtgctaggtttaagactatggaagccaggagaagtttggtatctgtgataggattttgtgacctattgattgcaaggttgagagatagagaacaaacaaaacaatatggaaatttagattttggaagatttggagcattatatcataaactgggccctctttagggagtcctcaatggcctttcttcctgccattgcactggtcaacacgtttaatagttaccactacttagccatgcaacacattttatttctagtttaatgcattattattgtacaggcataaacaattatatacaaatacatgagaagtactttctatgttactttctgccttataggcttctgttgaattatgaaactgataggctataaacatgatcttaagctttggaaaatgttttctaagaaagataaatggtgaatttaatattaaataaatttccccaggatataatgcctttatctcttttttattttctgtactctttggttttcataaatcttggtttattattctgtattctcttgagtatgtggtttacatcccacttattgggtaggtgatttctattttatggcttaaatgagggaggaggatttttgttatctggttaatcctgattatgggaaacagattatgtaacagtcaaccacttttagtgatctcttaagaatcttgaagaaaatctaattttcaaagatatgagtaattattcaaatataataatattgcaatttaaactggtttctctttattgtggtttattggtctgaggataataaagtactgtattcagtagtcaacaaatatttgactcctactacatccaaaactctgttctaggcacagaacacagaatgtacagaatacacaaaaataaacaaaaatccctaccctggggatgtggtttacattcaggtgaaggcagacagacaaataaaatttacacatatgcacatacacaaactaaatataaatatatacacacatatatgatacattatactattttgataagtgctttaaagaaaaataaagcagagaagaggaataataataaatgaggggcatgggggcacgaggggagtggagagtcacagtataactagagaaggcctcagagaaaatatacaggtatttgggaaaaattggaaggaagtgagggaaataaattacagtgatcagaggaaaatacttgacaggtataggaaacagcaaatgctaaggttctgcggtggcctaagaaaagtgtccttgagtaacgaagacaaggatggcagtatgggtgtatctgaagagggcagcaagagtgaaagtcagagaaaaaacagggagagaacagtcattgcaggaatgatgggccattttaaaatgtcgactttaagcgacatgttgaggcattggagagtttaacttgtattctttagcagaaacaaggctacaaaatgaatggaaaaactaggtcttgaacctaagtaacctaagtctctaaactttgccagtgcaattcacataatatagtgaagcaatcttagagaattggaagtttgggaaatttaggtcttcatcttgcctttgaatagttccaaagctgtatagttggctgagtattttctctgctctgagtgacctaaatatgtaatataagaagttccttcttgcttaaaattcctcattctacattctcaaaactttgaccatatatagagaaagctaggaatcatgtaaatctttttcctatagataagatttatgattatctttgtaatattacgaaataacagcaagttacaaccctctagaaaattaacagtctattctataaaagattaatgctaaaaagcaagcaaaccaaactagccccttttattcactagtcttaccataacatttgaagtttatgtatacagttaaagttgaataatagaacaaaatatattcttgtattttcattctattgctcattagtggagaaaacagaagaaaaatgagttgtatttatttctttccttttacttttttgaacgtcacattattctttaatatgagctctggaaattgattctactgtatagagtaggccacaaagtttaaaccaatctataagggagaaaattcatgttcatttcctttaaggatctctttgctttaaaaaatcttggcagcaaaatgttaacttttgtgtaagtcttatctcaggtagtaaaaacaattaaaagtacctgccttagtccattttgggctgctatgacagaataccagagatggagtagtttataaaatacataactttatttattgtagttctagagactgggaagttcaagatcaaggagtctgcatctggtgaggttcttcttgctgcatcatcttatggaagaaaacataagagcagaagaccgtacaaaaaggggatgagataagggtcaaactcatccttttatcaggaaactactctccagataacagactaacatttgtgataatggcattaatcaatgatagcagagtcttcatgaactaattacctcttgaacatcccacctctcaatattgttgcattggggattaatattccaacacatgagcttttggggacacattcaaatcatagtactaccctgtgttaatctgttcttgtgttatttataaaggaaaacctgaggctaggtaatttataaagaaaagagttttaattggctcatggttctccaggttgtacaggcccctcacctgcttttggtgaggggctcaggaagtttaccatattggcagaaggcaaagcgtgaacaggcatgtcacaaacaagaggggaagcaagagttgagagtggaggtgccacactcttttaatcatccagctctcacatgaactcagaggaagaactcactcatactgcaaggagggcaccaagccattcaggaaggatctgcacttatgacctaaacagctcccaccaggccccatctccaacattgggaatcacagttcagcatgagatttggaaggaataaacatccaaaccatatcatacccaaagcagttaacaatcttgggcaacctcttaggtccatccacaaccacttgccctacctaatttcgcaaagcatttttgaaatttgtgttcacagtatatgagaagggaaaggatgctatcttaaatgttatgtactgtttcattttattaatgtaatcatatatgacccaatatccacagccactgatgtcaattttgatcaaagttgcttttaaaaaatacaaatgaaacttgttttctttctggaaacaaatatggatttatatataattctagctcccaaattctttccgtctctgctcaaaatgagttaccaatgcctaacatatcagaatcaccttagaatttcataaaaattacaaattcctgaatacacaacccagaaaagataacaaaatatctgagaatgaagcctaggaatgtgtatttaaaaaatgccaaatttttataaattttaagaactatcagcttggagaatgtgtaggtgcagttaatccttattgtcccaggaaattggcacactgaccctgagtagtcggggctctaggatggtacactggtgcaatgagaagaacttatatactacttctgactttcctgatttattgcctactttttcaaaatatgtaaatccccataggtggctaagcgagcactttcaggttatttggaaaactgaacagggagtttagtgaccactgaacttcactactctttcagaaaacaaatacattccagtggccttagagaattcattaacattccaaaacttatctgcgggtagtagtttacactggaggacctagctcaatctctataatattgtgtgtcatagaagtatattaatggttacactatgtagttccaagtgttaaagattttatagttaggtttcactgttcattacttttaaactaacaatcattttttcacatctagtttgattttcttttccttacaagatgacagattttctactttttcttatctttttactggcagcttcttgtctccttttattaatgtttaaatcttcaatttacagccctaatatacctatataatgatagcttgattcttttgcatctaagggtggaaatgaaaacataacaacattttttgctctttttacttcccatttctttaaatataaattgaaaatattagaagagctagatccaaccactaaagcctgtcatcacatggacacatagaggggatcaacacacattggggcacacattggagggtgcaggatgggaggagggaaaggatcaggaaaaacaaccaatgggtactaggcttaatacctcggtgatgacatagctgtacaacaaccccctatgatacacatttacctatgtaacaaacctgcacatgtacccctgaacttaaaatagaagttaaaaataataattaaaatatataataaattaataaataaaagcacatttttcaattatgtgactacaacagaaggattatatcttcaatttccccactccaccttgtttgaagatagcatgaaatcttggagtctataaatgtacattattttgtttgcagaattataccaaattttaaatatataattatatggtgacagaatgtatacattatatagaggaaaaatataattaatttgtatgaaatatatggataacaatacagttagaataataaagaacatattttattatatttcggtacatatttagcttttcagcgagacttggttccttcaaaataaatcagtcattatatctacaacatctgggccatatagatactcaataaatattggatgaatgagtgaatgagtgagtgggtaggtgagtaagtgaataaatgctaattgcagaactggaaaaactgatacatcagtgatgttggaattttttaatttttttaaaccaaaggaagcttttggtctctcaatatctcatctgacttcatatactataccagcaatcacaggcaaagtgttataattaaaagcaacctatgttattttatatccaataggtaatacctagttttccagagagcattttgtaataaaaaatatttctcaagtaaattcatgatgacctgaatagtatttttcacatcactgcatgagtctgtgcacttaagttcctttaaagaccaactttttcatagaacattagaattcaagtttgagaaaccctatatgccctgatacttctgcttttgcaaactatgtataggtacttcttgttattttatatttctgtgtaagaaaaatagtgaatcttttctatataaacctttatcatgaaaaaggaaaaaaataaaacatgtgcattaaaaaataagaaatatcaagaagtacttgtttaaatcccatgtcttaagataatttgcctgtcctatttgacatgttagaaacaatactaaatagctgacactgtgaaattccagtgatgtttaaaacatagatgattatacacttttttctatgtgtactatttttatagaatattttatgtaagaaagggaaagtaagtataaactctcaatttgtctaaaagcaaatgaagtctttaaaaacttgtttaaaattagcaatatcataatatttcaaatgctaaaatatgaattaaaattctgtctttttaaataagcatttggagtgatacaaaagtcaagaattgatggtaatagtataattatttatactgctataggggtaagattgcataatttgtaatcatacaatttatgttgcttgaaaataaaatcctgcactctgaatttgatctacaaagacatctttcaaaatcctgggaaagtgatttttagtctacttaaattattttgtgttaagattttaatacgctgtaagtatcaataagctgtgtagtttatttggagtgaaattataatttatgcctacatgtatcaaattttcaaataacaatacatgtcagaaaaaaactttttctgcatatagaatatgccattgattttatgtaaactatttcagtaagttgtgactgatgtaaaaatcaaacataataggattattatataaacagaaagcttatatagattataaaaatagactgagctagttgttctctgaagtcattatttgtaaatgaagatgactagaacgttgacctgacaataataaatgaaccaattgtagcctattaggaagatggattaaccagaaaatttagattaagccaataaaatctataccaatgattggctcccagtattatcaattttatttgtcccatgtccaagcttagtacttatttacaaattcatcttctatttatggactgaatctgcattctagttttaagaactgcatactccttccagggttcatatcacccttcctcacctctttgtgctttgccattaacttctcctgggagcttccttgccataacttccccaagcctcactcaccaacaaacactaatattgtcttaccaaaacacactgtatcacttaagaaccatctcaaagaccatcacctccggaaacttcaattgtgagcccctcaatggggaaaagcttttgtgtatgtgtgtgtgtgtgggggtgtgtgtgtgtgtgtgtgtgtgtgtatgttcccacattagttgtggaatttatcttaatccaaccagaattatatatatatcatcattagataagccccttccacaggactattctttgccttctgaaaaaattattttccaaattatattcttttgaatgaagttcagcattcttctgaaattaataattaggggactaatatctatatagaaaaattagaataatattatacaatcagtgttttgacttcattctagctgaagtgtttttattcttaaggtgagaaaaatgatagtattattgtgaaatcaaggtaagaaaaaatatatatgatacccagcgttatccttcaatcatagtagataactcagtaaaaattgttctccttctatttcttataacttaagtgagaaaaaaatgaaaagaaaggtaagcagatactgtagcttagccaccaagtaattgattaagttgattaccctattgggaaaaaatatcattatggagttgtaaaggcttatgaagaatgttggaaaaattgtttttctgtcatttagtttttactatttatgagagaaagtctggattagaaaggtgggaagaaggaagtatcaggccttacctgaattacttgtttatccaaggcaacagtgatagtagaagaactgggagcctcactttaggcaggtagaaagttgcagaggaaagagtttccacagtgctatcctgaggcacagtcagacaaaccctcaaaaatcagtttcaaacaaacactctgttattattatcataactctagtagtgctacagccactgagagaagagactatgtcttcggagaattttctatgacaaggagaaattcagaaaaattatactgaatttagggagtattagaagagtttaacttaatgaaaggacagttgcttcttttcatcttgcttcaaatgacattttaaaatattttcctaatctataaacatgtgacatcagcattttagccaaatggctatgttaatattttattgtttaactaggaaaggctaaattcacttgataaagagagcatgttcactatattcacttgataattgttctgatactgtattgccaattctggaggcaatacctagatgggatttctccattacacaagttccattgataccagtctgtcaatattattagcataaaagctcataatgcgttttgagtaaacagttgaaaggatgaaggcataaattaggggccactattctccctttctctaccttgctctccctaataattaaacctaaatgacttagaaatagagacatctaaccctgataaattatccccacacatcaatatttcctaaaatttatttttaagatttgtgtttctgccaataaatttttaaatatagatttgctgtcttttcaaattatattttattgggatatccttaaatgatgttaaattgttcttcatttaatgccttttacattagagacagagatacaggcatcaacagcttgaaattatcattgtttccagtaagatactgttgagatgatgcagcagttggattgatagaaatataaaaaagttccaaaataataatgtgcaatcaaaattattattaaaccatggacttgagccaaatccaaatagagcatttctattcacacaagtgtcagctgggtttctggtgcttggggtccaagacttcagaactcatatgcacttcctggggcattcatgatgctgttggtgatggacaggtggtctcctgcctctgtgtatccatcactgcccttagatggccactatcttgcaggagaaatggagtctaactgcctcaggtgctccatctgtccaaagagaattggcttgctaataactctgagtttcctgggcttcctcacctatatactttttattgcatacattgaaaatgagactctatccttttatataagtttgcatggggctgctaaccatacattgatatgttgtatcagagtaaaaatttgtgtttctaatatttctaacatattcttgtgaaggtttaaagataccttttccattgggcttccaaaatttgtttcctgaattccctctaataattatgttttctatgcttaatttttatgttttccctgtattgtgtgaatagcagtcttgttaaagtgagaagtagtttcactctcttgaaatactaggttgattttctattctttgactgaatctttctcagtgctctaaattttttcctgcaattttctttcaagacaggtatagtatttgttttattaagtgtgaaacaacatgccttattttgccaaaaggctgtaatataataagaaaccttttggaaaattgggtaagactattttttaaatgataaattcattgtatatgtttgtcagtcataagtggttgttgatgatcctgcagtgttttgtacaaaactggtaaatttggtgccaagaagcttcataggtaggtgattaactagtagtcgttttgcttgaatgagaacataatcaaccttttaagtttctattatcatactgactatcaaataaacttctgaaagaaaaaatgatagttgaagaaaataggactaaatatttctcctgtcttttttttaagagactggattcagtgcaaaagcaaacaaatagctacttattacatcataaagctgtttattggaatgcattagggcatgtggcaaatccagaccttatcgggatgccgtagggagaactccttaaaggatgctggctgcctggcttttcccattgtataatagttaattaggtttcctccagttcaggcatacacacatattggtactggtagggattttctattttgataatttaaaataataaaaatggctttgtttctataatgaaaacatatacatatgtaggttgtttatatgcaaatatacaatgaatataagttgtaatattgatttaaaattcctcttagcgacacagactaagcagtcacccttagtctgtgttgctaaggcctattttcttctgtgtgccccacagttagtgttggtatgtccgcttcttgttcccaggccattattgttatttgtgggtacgtacatataacctacattgatgctgaaatatttaaaaggtcttacaaaatgttcgtatgttaaaacaactaacaataagggaaaaaaattggagtaaagaagtccataagataagaaaaatataaaactaggattatggtttgacatcactctttctggcagccaagatagagttcagacagttacatgatttccagtgtatattaaagtgcttagagacacaattattcctggaactgagagaaatgtgtttccttttgtcttcataaagaatataccatgtaagccactgaatcacttacaggtttaaaatctggcaaaactgcccggtagttcataaaaatgacaatctctttacagtatgttaaaaataaatttcatgttcaagttcctcaatgtagctaaaggactgatactaatgttcggtttagtaggagcaattctgtgccatgtgattgcttatgagtgcgtgtttatgagtgtgtttggggtagaaagaggtgttcggatagagctggggttttaggagatgattctgatttttaacagagatttctctggaaaaattagaaaaaattttaaaaaattagaaacttcatgatatctagaggtcactaaaatctcaacctttgcttatacctatgtttatatttcatctttaatgtcaggtgatgacatcaagtgatttatttttcatttttcttttttgtacttttggctttgttcttatatttctttaacactttagtaagagtcatctatgcatgcatttttatatttattctctcttgaacacacctacacaaaaagttacataaatgagattaaatattatgtgtttttatctggtagtatttgtggttttgttgttcttctttcttttttcttttttcatcccatcagcatcccttctcttattcttggcttctatcttggtcattttttgtccacagtaacattttcaaataatattctgtgttttgcaattctgaatactctgaacacagggtaagatgcttcatttatatcttaccatcaaagggttcaaaagcatacaagttactttttttttttttttttttttttgagatggagtcttgctctgtcgcccaagctggagtgcagtggcgcgatctccgctcactgcaagctccgcctcccgggttcacgccattctcctgcctcagcctcctgagtagctgggactacaggcgcccaccaccaagcccagctaattttttgtatttttagtagatacggggtttcaccgtgttagccaggatggtctcgatatcctggcctcttgatccgcccaccagatccaaagtgctggggttataggcgtaagccaccgtgcccggccggcatacaagtaatttttaaaatattttatatatatgtagctacaacctctagagcattacatcatttcatctttctcattccctatttgatcttatgtcaaaaagcatcaggccagaggataggctttagggtcaagggacaaggttgcaattttgattttgccatgtaataggggtttagtttagtttgggcaagttatttagcattactaaactataattcataatatgaggaaagcagtaggactttctacttggttttgttagaattaagtggtcatcacagtgtctgacgtatagtaaacactatatattaatccaattacaattttccaaaactaggttcaaaaagtgaattaattaaaaaatacataattgtgtggcaactaagataaactactagtgggctttttaacactgataaagatcacttggctttccagatgctttaaataggttaaaactgagaagcatgtaaatccaagtatatacttattttgttagtgtgacaaactcatagattttgtatatcctctcttcaacataccctgcctcaagatggcctttgtaaatttgtttatgtgtgtgcacgtgttttcttttttcttttttcttttttaattgacaaaaattgtatatatttattatgtaaacatgatgttttgaaatatatatatgtcatggaatggctgcatcaaattaattagcatatgcattaccacacatagttgtcatttttgtgatgagaacacttcaaatctactttattggcatttttcaagaatacaatatattgttattaattattatgtaaagttttattgttactcataagatggttgaaatggggccaagagagcaccatgtgatatgatggtgataagtcacttattccacaagatgctgctcagaaattgtttttgctcttggtgattaaggacttgtgattttacatactcagaggacaaatttgaatgaaacttatgttgtacaattcatctggtgtttgctgtagtaaaaatttgtagaggaatagctgcagtccttctccccatatcttctggcataaatataaggggctggggtactgtcttccccatagtcctcagccctgtgtcttgcacattatctatgctctactgaggaggtactatgtgctcagcatgctgcttgacactgtggaccatttaaataccaggagaaatttagaggtttggtaatagaaaaagatacaggctatgaacagaactaagaagtaaggggtcacagaaggtaaagtcttccttctgttattgagggaaaacatagctattcttttaggcccttttctttcccaggtagaaactctgaagttacaacaaagctggggacaatttttgaactcatataaatttgtgccagcaactaaatgagttttgctgttcaaacaaaaaatgccagtcactccattcttgccaccaaactgtacatagtgagaggttttaaagacttaagttataaattttaaaaatagtggtttttatcttaaaattatgttggcctttctgagatttaaaactgccacattgttaagaaagagaccattactgaaacataaagtttggcttgcaagttcacaagtcctttctctgcttcctttcctccttaatataggtcccctgagctacattggaaggtgtaatcttctctcttagaactgtataaatacagtaagccccagtaaaaacagacggttggtgtgatcatttttaacagccccggagatgtccatatgctattcagtaatgtggcatctgcatagccctttagctgtggagtgtactttaaacataagcaatttttaagcaacaaggtgtcaaactattcatccatgtgaagcaaatcagtcctgctgcacccctgagtacaatcagtgaaaacccttagagtgctcttaaccacccatcctccccaggtgcacggcatgttcttttaatacagttacattattgtgcctccaagtcagaaaaaaaattgtgaggtaaaatattcattcaattaacactggagtcactaagtcactactgtgctggtgttctccaccagtcacaggagcatttatgtggctggacagctatctacatccgctcccatacagttatacgctgctgagtctaatcgaggcacattcaatactaataagtaaaaataaactttatggaataagagaaatttaacgaagttaattataaaaatgttcaagacaaaaataagtgaattaaaggcaaaataagtgaattctttagtcttgaatatctaactgaaacaaagtgttacagtgttgttctaagacctctcttttttaatcctcctccatccttagacctttaacatcaagcagactaaaaagagatctaataggtagtcatatatcccgaaagacacattattgaaaaaaaaaaatgcctacaaagtagttgttgccaaaataatttgcgggaaatcaacccaataagcaacactacaaaaataagataaaaaatggctagcctctcaaggtgtttttggctgtgttattaaatgttcttttatttgttcatattggcttatggatccacccaatcataagccaaagctcactcagtcatccattcattcatgtactatttattgcgtgcctactatgtgccaggcactgtactagaccccaaatgatatggcagtgaacaaaaaatgcttggtattaaggaacttatattctagtggtaggagacagaaactaagtgaacacataacatatcatgtactgatcacagacggcgattatgctgtggggagaagtaaagcagggacaatggatagtgaatagatgaagggaaagtcattataattttgactagaattaacatggatgacattgttgatgaggtgatactggagcatatgactgagataaaagtaaaggaacaagctatgtgggactaggacatgggtgaagtgagcagaggagggatcaataaattccaaatccttgcattttccttgtttgctccacaaaaaaacgaaaagatgagtgtggttgtgtctcagggaggcagaaaaagagtggcaggagttgaaatcagcagtggaggtgatccatatcaggctagtcattgaaggaactttggcttttactctaaatcaagaagcttccagatggtttggagcagaagaatgttgtaattttatttatgttttacaaggattgctaactagcctatggagaataaatgatgcatttgtatgtgtgtatgtgagagagagagagtgtgtgtgtgtgtacacacacatggcagcaaggacagaagaaaaaacatctaggatattaatgcaataagtaaaatattatggcactttgttttttgattctgtttgctggtttgtgacagagtctcactctgttgcccaggctggagtgcagtggtgtgatctcggctcactgtaacctccacctctcaggttcaaacaattctcctgcctcagcctcccgagtagctgggattacaggcacgtaccaccatgcccaggtaaatttttgtattttcagtacagatggagttttgccatgttggccaggctggtctcgaactcctgacctcaggtgatcggcccgcctcagcctctctaagtgctgggattacaggcatgagccaccgtgcccagttcgtactttggaacagggtaggagaaagtgtccctgtttgtgataactttcaaaaatagagttcctttatttgttaatttatcggatagggtgtgaaataaagggagaagtaaagtatggtttcaagatcctggcctgagcaacaggaaggacaggtgtcctttactaagaaagggaagactgaagaagatgagaaatccagatttagacagaaatctaaagatattaaatcttatgttaaaatgcctagtaaaagcctaaggtggagatgcaggcaactgggtgaataaaatgaaagtttagggaagggatccaggctggagattaaaaataaattcaaagggatcagcacatggggaagatttaaaataaatcatggagtgagtgaaatcgagaaaaacgaggtccaaatgtggagtcttggattttccaacattaagaggtaagaaatatgaagataaaagagtacaggagactgaaaagaaacagctgttcaaataggagtaaagccaggaaagtgtgatatcctcaatgccaaatgtatcaatcggggttcaaccagagaaacagaagtagtagtaaatgtatattaagatatttatgcagagaattggcttatcagattaggcaaatctgaaatctgcagggcaggctgtcaagaatggcaggctggaatttttggggatgagtgaaggatacagtccacaagtggaattatatctcctcttcctcctcctcctcctcctctccccgctcctcctcctcctcctcttcatccttctcatttttcttcttcagacattctcagttttgatattaaggctgttcaactgattgaatcagacccatccagatgatcttggataaagtctctcttttaatgtcaattatttataggctttaatgacattttcacaaaaacactgagattggcattttattggataactgggactatatcctagttgatacataaaactgaccatcacaccaactaaaggataaatggagggaatgatcaaccacgtcagatagcatagccttgagtatgttggatttagctgctaattcatttgtgaatttgactacagcagatttttattttggaatagagctgtatttgtttcctatggctgtcctaataaattaccacaaaaataggtagcttgaaatagcagatatgtatgctttcacagttctggaggccagaagtttaatactggggtttcactaggttgagataatggtgttggcaggccatagtccgtccagggcctctaacctgcctcttccagtttattgtggctgccatgcatttgttggtggccactcaaattcaatctgtacctttattttcacattgctcctcttttcttgtgtatatcaaatctcatctacctccctctaataaggaaatgtgattggatttacggatccccccctcccaccccacagataatccaaaataatctcccatgtcaagatccttaatttaatcccatctgtagagacccattttccttgaaagataacttatggttccacatggtatctctaggtggctatctttcagcctactacaagaagcaaagcctaactgaagtggatccaggaaaggtacctatttcagaatgtttctgtaaaggtgagcaaagaaagagagcagcagctgaggcaagggtgggaactgtatctcccagtcaaactcacagaacttccttcttttacatgcaaacatccaacaaacaaacatatatgattacagtttcatatatttcactctctggccatgtatatctattcatttctgttacatgtttaaccaaaccacttatggtaggttaatttgattattttgcattgaaaaagaaacttgaatgaatctgaccagcaagagatagtttcctgagtctaaatactttttgacaattttgttattttgtttttacctttgtctacaagggtaagtcgttgttctcaaaaatcacagtgaataaattttcaaagcattgcatacatttgtccagtttgacttacaagtcaaatctcttatatctgaatgtgattccccctatattgtattccaaaactttgaattactttactattacattctttaaaaacatatattggtattgtcaattaaaaaaccaattcccatgtgcttgtctctttatttgctttccaaatcatttaagccctggtcatatctatggcatacattataaaaagatcagagggaaaagagagatgatagaaaaaagtcttacttttttgtcctgtaatccatgacaaggtcaaggaaacttattctgaattcccatttctattacgcatgggctgtctgacatagtaggcatcaagagcagtacgtgatacatgtgtaggtgctcaataaatattgatgaatgaataagtaaatgaacaataaaattaccgataagaccttttatgttatgtttattattctatcgccattaaaggcatttataagcatcataatttttaactggcatatatatatgaaaatgtatccttttatatgaaaaaagagtaattactcataggattgatatagtgtagcagcttaaaagagaatatttcttttgaggaaagcatatggtcaaagatcttgtctgacagcatttggctgcacagtgaaattcgggctctgcaatgagacatgctcaatgtagtgatccctaatctgggcttttttagatttataatcttgaagtaattattttatctatctactcatctggaaaactgggctatctattccatatgattttgttaattaataatggtattgcatataaagggcctaatgttgtgccagctacatagtattggctaatatcatgatcatgatcacaggcaaatatcttttcttcaggtttgatagtacaacttgtctttttaactttttatacataaatattattctctttcacttgaccaattttctgtacaaaatttatttaagaaccccttaaaattcacttaggaaatcagatggagcatacataggaagtatataacacaatattatcagattctgttcactttcttttgctttttttctatactgtaccatgtgcagataatcaattgttatttaagtcctagactttggctctggaatccagatccccttatctaattaccttcttgggtttaccacatggatactttaaaagcagtatgtttaataatgcttttaggatatttccaccccatctttgcccaaatatggtccttgttagtcttccctgttcagcaaacaccatcatcatccatctaactgggcaaaccatgaatctagcagttgttcttgatgtctccttcttcctcagtctctgtcttagttagttcaaactattataacaaagtgccataggctgaatggcttataaacaacagaaatttatttctcacagttctgaaggctgaagtctaagatcaggaggccagtgtggtcaggttctggtgagggtccactttcaggttacagaccgccaactcctggctgttccctcaaatgccacaaagagcactagcaagctctctatggtcccttttaaaagaggctaatttcattcatgagggcttcacctaaatcaccttgacctaatttacctcccaaagacccttttagcacaatcacattggtgggtaggatttcagcatatgaattttgggtggatacaaacattcattacataacaccctccatgtccaacttctcacaaagatattctctctaaataagccatcctcagaatttactccaacccttcttcaaatttcagcttaatcaccatttcttgaggaagcctccccttactgttcctcctccctgtctccagtgcagatcttcctgacatatcttcttaattccatgtacctttgctttgcagcaattacagaggtaactttcacattaacttttgaaatgatttgatttatgtttatctaagattctttgaagatacatggcatctgcttttgctcatcattttatcttcagaagctagggtttttcaaaatgtcagttgggactcattagtgagtaatgaaatgagattaatgggtaatatgcagtattttttcttaatgaaataggctaaaataaaataaacttttgtcaaagagaaaaaatgtagttatgatagaaaaataaaggcagccaataaagaatttgttttcaaacaagtcactgctataaggaattggaatgtaatcctacagggaactctggaaggcagcatagaattcatttaggttctgtacctgacaactttcaatcagtcgtgggctattcccagaacctttaattctcaggcactcgtagcccactatgcattcaggtagttcaggccctgaggaaaatagatacagatactatttgtatctacatataaatgcagtagaaaggcaaggcctgaggaagttacagtaagggcaagaagtagggaggagacttaaccacaaactggctgttttaggtttcactttatgaattcaatttaaatgagtatgtaagcgcattttgctgtttgaaacggggaaaaaaaagtcttagttgagtgatctccgtttaattatctttctctgataagaattgaatctgaacaatgagaacacatggacacaggaaggggaacatcacacactggggcctgttgtggggtggggggaggggggagggatagcattaagagatatacctaatgttaaatgatgagttgatgggtgcggcacaccaacatggcacatgtatacatatgtaacaaacctgtacgttgtccacatgtaccctagaacttaaagtataataaaaatatatatataaaaaaaggattaaatctggatttctttaaccttctcctcttgcaatctgtatttttaaatcattgaattattttcaaggtatttaattattttattcctttgtattgtgccttctgtaagagtcccagatatttaaggcataagaatacaagtatgcttcatgcatacacataatattagaagataactgcaaatttcccttgttatctacagcagattgtttctaggacctctgcaaatacccaaatctgcagatgcccaagtcccttatttaagatgaagtagtatttgcatataacctacatgcattctcgtgtacactttaaatcatctctaaattatgtaaatagttgctatacagtatttgttctttatttgtattatatttctctttctcttccttttgtgtgtgtgtgatggggtctccttatgttgcccagactggtctcaaactcctgggttaagtgatcatctctcagcctcctgagtttgctgggattacaggcaggtactcccatgcctggcatatttttcattgttgtgttgcacatatatatttgaaatctttttgatccatagttattgaatctgcagatatggaacctgtgaatatattagggctgaccccatcaagggtcaagatataataaaattaataatgttcactatttcttcaaggacattcttaagtgaacttagcttttattttctttcatactagcagtgttaagtagtgaagaatgcagtgtccaccagtaaagtctgtgcccagccttgatctgtgttgaggtacagcacttttacccatgtcagcttttgctccatcagtacaaatatcaacatagtgaaggcaaatatatcttactattattaggaaaaatatttggccttgaagaactccaaaaagtcttggggtgacactttgtggactattggcccataatactgtagcaggacgagccgcagacaaaacctctcagacaccgagttgtagacggtagggctttattcagctgggagcattggcaagctactgccttaaaatccgagctccccaaatgcacaatttgtgccccttttaagggctcacaacactaaagatttcacatgaaagtgttgtgattgatttgagcaagcaggcagtacgtgacaggggctgcatgcaccggtggtcagagagaaacagaacagggcagggagtttcacagtgttcttctacacaatgtctggaatctatgaataacatcagtttctaagttatgagttgatttttaactactgggtttaggccaggcaggcccaggcctgttttcgggcctgacaccgggctgcctgtctttggttttactgccttgttgttttttcttaaaacaggtactgagtataaaacaatataaaacaatatgagaaggtctctctcttccctcaatacacaaattttctaaacatatatatgaagcattttataataggaaacaaacgttatcattttaagaagatattaaatgtttaattgtaaactgtctttacttcccaaataagctctttttgacataccatttatcaatttatctaaactagtctttaaaaagtgtttatatatttaacctataattatgtggggagtaacaagctccacactgtgggacttcctaaattaaaaagtagttattttctcatattttttactttcaagtttaaactgggattcgttaaaagttaacatgaagaacaacatattatgaattagtaaagagactaaaagcattatgtagttttaaacatctcttgccttttggaatcatttctacactaaagaaaacagatgttaatgatgataatatcaaaaaaacagaaatggtgatcatcatcatattaggcttgttttaaaacagtaactgtttaatttgaagattccattttgtggtttatcaaagtaccacacaagttatttttatgcttagttacataatcctacgtattgtgggtcagtgcttacgatatcagcaaagttatttaatatatttacaatgtctcacattatccacctatttattattgaattagagtgattacagccacttcattttgttttgttgttgttttgaaatgtgttctgataaaaggaggttcattttgatcgtcaaccagaaaacaaaacatgataaaataaaaataaaactcaggaaattcgacaaatttcttgagagccacctacataaggcattttgtaagaagctatgaagtatacaaagatgtcgctaagtaacctgtaatctagtaaagataattacactgtagtgtataagaggaactatgaaacacaccaataaaatcttatgagagctcagagaagggaaaaattactttcaaagaagaaaaaatatgtattttcccttaaatgataaaatttgttcttatgtttttgctttcaaccattctttaaccatcagattttttcaattctcttatcttcgcattattaaacattttatacatgctgttcaaagtattattatcaagtacagtacaggcttctaaaaatatgctaaagccagatgtaaacagttgaaacagttgcaatactgtcttctctataggaaataaatataggtaatcagtgaataaagctagaattttaaaccgtttacttggaataaactgtggctgaaagccccatgggccgcatgaatacagcagccaggggtcttcagaaggtcctgtatgccagttatgccccatcactaacaggcagagtaactctcactgagcaatgcgaacataatattcatgttttccacttataatgtttaatttgtgtaatacacatacatatgtacgcacaactgaaaaatttggaattacaggtaaacttcattttcaagtaatttgaccattcatatacattcatcttctgtacacttgcaaaggtaagtataaaaacctaattttctgtggcagtttcataggctactttattgaaagtggctattatgcctgtttcctattttatgctcatttcctaataaaaccaacaatatatccaactacacagtattttaaagagagactaattataatgattactattgtaagaaagtgattctacatgaatatttccatgtttctgtagagcctgggcttttttagcaaaagctgatgaaacttggttaaagaatgtatattagtccatttctcacattgctgtataaacaactacctgagactgggtaattttaaagaaaagaggtttaattcactcacagttctgcaggctgtacaggaagcatggctggggaggcctcaggacacttacatcatggagggaggcaaaggagaggcaggcatgtcttacgtgaccagagaaggaggaagaggaaacagggggaggtgttacacacttttaaacaaccagatcttgtgagaactcacccactatcatgagaacagcaagggagaaatccacccctatgatccaatcacctccctccaggcacctcctctaacactggggattacaattcgacatgagatttgggcagggacataaatccaaaccatatcagaatgactgaatatcaaaatatgtcctagaagctacaaacggagcattgttccagagagatttacaaatatatcttccccagagccattcatttatattccagtgtgatagagagagaacttcccctccaatttccagagaattgtttacattctagagtagggtccttgtcattcttggggtaggatgggctgatatgccactgtccttcgtgggcttcaagtctcattctcctgtttaacaccactactagcattgagtaatatcaggctctcatcacatcaccttgtggtgatcagggcgcaggagccaatgctaaggtgctgtgtgaataataaatgctctgttctctgattcatagactcatgtttcctgtcagggtatctgtctgcctctgtgtgtttttttgtttatgtatccatacacctatccatctatctggttagccagcaatccattctaccatccatccatccatccatctaaacttaccaactatgacttacagaactggtttagattactcatacatcttatgagtttcttctcttcttagctttatcaaacaacactcaagctatgacaattgaaatggtattaccatttcataaaacaaatattgctttttaatttttacaaattttatctgaggattttaaaaataatacttctctgagtatactaattgaattatatttttcttttctcattgcttatattgcattctcattcaccaacctcagaattattattaaatattgcaaagcaaatattttaaaaagtactttaaaggaaatttttaaaaatatatattaatacttacactgatccacttagaagaaatacatatcaattacactgatccacttagaagaaaacctgtgtacttaactttattttcgtaaaatctgaaatttaatttaaaatcgagaactatttttttaaattaagacaatactttggaaataatattttaaatatatatatatatatatatataagagaacccactgttatctatgttacattaacctggaatttactatatcaaggaaattgtagaaaaagaatgcagtggagagagagttaaaacactagtcaaacagacaagacaacaccacaaatataggatttttactagaggtgcttttttccccccttaggaaaagtatggcttctctttgggaaaattgagattggtcacacttcagagcctttgataagtactttgatgttcaataagaatgaaaaaaacaatgttgcttttgcaaagagaatcaagaaaataataccagtttcagcaaaagaacattgttttgtgtactttaacacacactacaaggaatgtaaagaggccctttttattaaactggggaaaacattttttgcttaaaaacaaataggacaccagtagaaaaaaaaattaaactaaaacaaaacagcatgcttattgctttgtgtgtaataggtagcaaatatttttttaattgaatagaaggagtgcaacaaataaaaagctacatagaggataccattttactggaaggccaaatcgtgtccttctagtaaaaatgtatagttaacagagagtgcaatttgatgtgtgaataaatgaattattttgcaagaagagatattttgctaaatttgaacaatgacatccaagaaatgagatttctttgttgttctgctgggtttttcttttaatgtaattttgacaattttgattaaatgtccaaattcataatgtgataaattattgtggatgcaaaaatgttagtaaaatatttttaagagttttaatgaacctggtagatttagacagtaatagagttctgtgactccccaaaatgaggggacttgcctcttgatatcagggaggaaatcatggggcaaagctcatagaaatgacagctgtagctaagagcacctttctcctctaaagctgactgcagaacaaaaggttaaatgtagttgtcaagtttatagacagggaaatacttgtagtaaagtgaaagtaaacaagcatttaaaaagcttcaaagagagtcaaatccacaattcggggtgatttggatgaatttctctaatatgctaatctgcatggactaagtccatgggttagaggaaagataagctgaatttagggtgaaggggataggaacctctggacaaagggacaactttggctgatgatgcttagggtagagtaaggatagttttaggaggttctttcaatattgagagaggtttaattgaagaatatgcaaaccaaactagtgagattatgaaaaagagttcctagaaatagcacaattgtttgggtagggaaatattggacagaaaaagaatatggaaacaatgcaagaatcgttggaatttagagtgcaaataaaaagaataatctgaggaccaagtaaaggctggttaaaccaagtcaatggaacaggagcagccagcataatttcttattaaatagtttggatggtgtatcaggcctttattgcctcttgcctggattattttaacaattttcccatgaagttgtctgccttggacataatacatctctgatctatatccattagactacttccagagtcaaaagtctataaatcacaagttaacgatctatgtgattcaatggccaaatcctcacgcttccccatctgaaattaattcccataggactctacttggatttctatttccataactaaattacctcaacatacacttgttacctgattatatacatgtctgcagcatgaagttggaaactttgttaacgttacgatttttcttttcaatgtttttttctttttcttagtttgccaaactaaagcacagcagaacaacaacaaaatgttctttccctgaaacagagagagcccaggctaagccagagataacaaggagttgagactaccaaaagaatgctgacttctaaaggttgggctaagagaagagcttttatgtttaggtagaaacaggatgctgattttaaaaaaacttcttcattcattaaacattttccagatgtgagattgctcatttcattcgtctcagaagcttattaaattcccctacactatgttggaaattgattttcacttctggaatacagtgatctggaggcagagatgtgacatgggagaggaagggaaggtggaagaaaattagatattttcctaaagtgctattagcaagaaaaggtaaccaaagaatgagattaaacaaagcctttctggagaagatgacttgtgttggtggtaggggtattgagatgaaagaaagataggaataccttcagcagactgataattgtatacactttgaagtgtattttaaaaatagctgttccacgtttaatagatggggattatttactgttattaaaaataatatagagaagcagattaattgatgcatttatgtttattgagttgatagaaccaatattatggaaacaaactggcaaaacttttcttcccttttgggcgttcttgttctttcttgcattcttttgtgattgtttccaaaccaatgacttcttggtaactataataaaggtttatattttacttgataaaatgtaaatttaaatagtgttttttagaaataacctactgtggggccaggcgcggtggctcacgcctgtaatcccaacactttgggaagccgaggtgggcagattacgaggttaggagtttaagaccagcctggccaacatgatgaaagcccgtctctactaaaaatacaaaaattagctgggcatggtggtgtgtgcctgtaatcccagctacttgggaggctggggcaggagaattgcttgaatggggacccgggaggtggatgttgcagtgagccgagatagcgccactacactccagcctgggctacagagcgagactccgtctcagaaagaaaaaaataaaaaaaaaaaaaataagaggaaaaggaaaaaaagaaataacctattgtggtattgtggtatttttcagactcagaatttcagtccaggaaagggaataatactaatgagtgacattaaatgctcttttttaatctggaaaataagcagcaaatggctttagcttctaaattttctcgtcattttttttttcctttcttaccagtttgacctaaacaatcttagaatgtatagtagctcacagctcttcacagctttgtttatttttaaattttttttagtaatccctctttgaactgacttttacctttcattgtctatgattcttcccagactcctccatgcagggatcttgatgcagattcttccatcagtacctccagatattaacctgagaatggaaaatattttgcaaataataattttaattctccctcctctcaaaaggaacatagtttacccgaaatataacttaaatttaatgataataattaactttccaaattgccaataattccattccaaatatttcataacttattattaacccaaaccattttctctatactcttatttccctaaagtgtacacaataatcagcattcacaaggaaaggggtaaactgtttgactttactaccacttttaattctagctgcatttttaattttttcgagatagttttacaaacacaaatacatacctattgtattaatttctttctgatttttttttttaaaaacttttattaccagaggcctgttcatattagacatcaggtctgtgaagtagatatcaattcaacatagggatctatgtactgccaatgaataattgatccatgaagaggcaaaatcttcctaaatttcacagcttactatcagagaaaataatgtaaatagccataataacaaaaatggactttctaccctcagtgctcctatgattggagggaattcagttgctctgcataccccctttccttcctttagaaagaagatctggccggaagtgatggttcagtgtcgagtcctttgacaaagaccatcttaacttatttttattgtttcacctaagctgtgttttgtggtttcgaaagtgtctagcatgacctgtgaatctattacagttcaaaatcaattctattcctgtttccatagttcacattcatttccgtgagtattagggtcttcataaaacagcagttttttctgagtgttgatcctagctgattgaacgtcttcaagaacaagccactgatccttgttacacaaattgtaaactcagtcgaagtgagcttcggctgcaggttcaacactgcttacttaatgaaagcaaggaaaagtctcttttttccacatgttagtaaagggtttcaacaggctaaaaaaaatattgaataactctacataatggagaaaggcagtaataagaaaggaaaaacagaaaaatagaataagtagtctgtgaatcctttggagaatttactgaaaactagaatttcttacaatgtacacaaaatggctgtcaccaatgcaataagactttttccaaaaattgttctcacaactctaagcaactgaagtgttgcttccttcatcacatcatgtaatgaagtcaacagagtataaaatattccttgtgaaggaaaacttgatatcactataactttaagaaatattttgagggtgggtgtaagtttgtatctgaaataaataagtggttactaagctacaaacagatttttagccaacagccacactatctaaaatgttcaactctcctccatacatagacacctcctctccccttctctgctttattttcttttacttttacatactaaatattttatctagcagtaagtgtatataatacattatatatttatcatgttggtttcctgaatctcacatcagactgcaagctccttgaaggcaaatatgtattcctttaggttcactgttgtttcctcacctcctaaaataggacctggcatataattgtgctcaatcattttttcaagaattaatgaatgaggcagggtgcggtggctcacacctgtaatcccaacactttgggaggccaaagcaggtggatcacttgaggctaagagttccagaccagcttagccaacatggcgaaaccctgtctctgttaaaattacaaaaattagccaggcatggtcagcatgcctgtagacccagctactcaggaggctgagacacgagaattgcttgaacccgagaggtagaggttgcagtggctgagccaagacagagccactgcactccagccttggtgacagagcaagaccttgtctcaaaaaataataataataataataataaataaaaaagaagaagaattaatgaatgaaactggagagtctgctgcaaagagaatcctgaggttttatacttctcttccaaagaataaaagctgtctatcaattctagaataaagcactagcttttgaaatgagtaaagggatcaagaaaatctagtgctacctactggcagctttcccaatggtgggagtagcagttttaaagattcaataaacaatctccttgacataaaattcaacaatggcaaagttaagtgcaggaagagggcatgagacctattccccttatgaggaagagaatttattattaaaattatgtacaattattgtggtgtaatgataatgataaaattgatgggctttgctttattaattgtttatacatattgtgcagggtgtatatatgcttactgccttgtgtaggtggggtgggacacagctctccactgatacctcttcttctggctcccctgatattccactagaagggggtaatgagagattttgatacaacaagcattatcagttttatcttgtttgtttattccacagatatttactagacatgcaaagcaatactatttagtagatgcaaaaatagataagtaaagacctataagtttttggtttccaaagtcaaatgtttttatggtttattaatattgagaacactgagccgggcacagtggctcactcctgtaatcccagcactttgggaggtggaggcaggcagatcacttgaggtcaggagtttgaggccagcttggccaacatggtaaaactctgtctctactaaaaacaaacacacacacaaaaagttaaccaggtttggtggcgcactcctgtagtcccagctacttgggaggctgaggcaggagaatcgcttgaacccgggagatggaggttgcagtgaactaagattgtgccactgcactccagcctgggcgcagaacgagactccatctcaaaaataaaataaaataaaataaaattgagaacacagaaagatgagcaggtttgtgtggaaaatccttaaatctgtttgacaaattgagttgaaagtgttgaattccccagattacaaaagaacaacctgttaataaagcaatgctaaatgtattggaacctaattgcattcagaaactactggaaagagttttattgtctcaaaaagggaaagtcagaaatgagattttattaaattttggggtctgggatccaggagtttaaggtggatttttcaaggcagactttttcaggtgagcagactgttgtctctaaattgatctgcaagaatttcctgaagcaaacagtagagttatttataggattacagtcttatcttttctgtgtataggtttactggaacaaacaagacaactgtggtcccagttctcagaggtagcttttgagacctccacatgcacatgttgaataaacaattggaactcagagggttagtataaaatttaggagtaatcactatatagattatcataaagatctggagatggttctgttcaagattgccaagggatggaactgaattcctgtacggctgctccccacttgaaaagccagacacaagaatcaagagttggtgggaagaaagaggtttattgaagtgctagcagctgaagagacagctggagtcaggtctcaaaaagccatctcaaattctcaggctggctaatggggtttgaagaggaaggcggcatggaaactatgtgcaggagtgatgtaggttgcaggtctgcttgtcattttccagtggctgtcttgaataatgaaccatctggaggccttggtgtcaacttgcttaggtcagggtatggattaactgtgcaccaatttcttctcagaagggagaaaactttaactgccatctccactttacgcctgagttgctttaagattagcctttggaattctcaagcaaacacgtagttagatatatgtatagcaagaaaaaaaatgaggcagggattactttttaaagcaagctagcaaattggctgtactggttactgggagagagcatcaatgagaaaagaaatagattagcacagagtattgagaaacctcaacatttaacaggttattgttggcagacgagcattcagtggagattgtaaagtggttagaaatgtatgaggatgaacaggagagggtaaggagggtacttcaagaagcaaagagtgatcaacaaggccaaatgatgctttgtgttaaaatcatatgaggactttgaaatattcatttagtaacttcaaggtcattattaatcttagcgtgagcggttttggtgatgttattgaggcaaaaaacagagaaggttgaaaagtagtgaatggataaaaaatgaaggtagttcaataatttgggatgagaaagagaagaaaaagataaattcataatgtagaaatgtgagaagtaaaatttttaggcaggagagatttgaatatatgtatattctctgcttccattatcactccataattttataagaaaaaggtaaatacaccctttcatcctctgtgatttcttccttccttccttgtgtctattgattctttcatttactataatcagcaaacagcaggcacagaccatggccctaaggaacttacagaagttaactcatagaaggccaatatgttgggaaaaatgtgaataagtatataaatatcctatcattgcataattagtatgaatgcagattaagtttgagtttttctgtaatactccaaggcgaagagttacgctgccttctaatgcaagtatttggctgaaaattggattgtgttttgaagtctctgtactaaatttcctccagacatagctggcatatacagggacaaaaacttttgacctggagctcattagtgcaatgaagcattcaagtgaactagcaggtacaagcctgaaacaaacaaacaaaagaaaaacatcaattgtttgattaattgtaaatgcggaagttgagggtagggaagtaaaatttcaacccatcaaggaagtagtcactttaaaattcacctgaaatgactatttcaaaacctgcttccatttcaatgctaaaaatatttcttttccccaaaccccttaaacggaaggagttataagtgaactagaatacacataggaagtcatgctgcattctcatgttgctaattggaattttgatgaatataatataaaagcaaaacaagagcaaagtgtttccattagttcactacccatgtttctgcaccttaatcagagcgttgttaatatttaaatatgcgtttgaagccccaagtgtatagggaggcatggaagtttcattaataactataatttatataaaagaatatatgccaaagacaaatgctcaaatatggagtttcataggaatttttcaaacgtattttatagctcagacatggaaaaagaaattgcagcaggatatgaacttatgcttagctactaagatacactatggcttatcatttattgagaaaagtccagatttttgtcttaaagttatatttctccatcagttatataccacttttttttttcacataaggctgtttggaaacaggcaaataggaaaaaaatctgcaggaaaaagggacattgacataatctgaaatgccttgtattctgcagatttcagaactatacagctttcaaaagggacataagggagcagagagaactgccactctagagctgtgactcttttctccttcagtagtcatgctttcaaatgggtccttctgcagaggaatgacttgaagtaacaatcaccattccctcttcacagcagtctgccacagaacaaaacttcctggaataatgccagttgaaatgactaagtgtgtcttttctatacatccacaaggatacttacctagtgccttctgggttctaaaggagaggatatagttcattgttaacaacagctctaagtctctcttactatgtgaaacttactcttttattaaccagaggaaaggaatcagagacttccaacacattacaattatattcaaacatacttccattcttaggatgagctctgactcaaatattgttttatgctaagtactagtatggagtatgccttcaacattaaattcactgtgaagaaacatttttaaagtaatatgataatcagttatgagatgccactagatatcctcaaagctattatgcaaagagcgagaggaaactttaaagcaaaaacagattaagttcttgcagttttcataagggggttggtttagaattcctacagtcaaataagctgtgactgtaatggttctttgagttgatgcacagattgtgcaaaatcagccctacacataagcagctagcatgtgtaaaaagtctacctgactcaaaatatgagtcccactaggctatcacacagtattatatcttggaactattgtataagaatgaagacattggccaggcacaatggctcacgcctgtaatcccagcaatttgggaggccaaggcgggcggatcacctgaggtcagaagttcaagacaagcctggccaacatagtgaaaccccatccctactaaaaatacaaaaattagccaggcatgatggcatgtgcctgtagtcccagctactcaggaggctgaggcaggataattgctagaacctgggaggtggaggttgcagtgagccaagatcgtacaccgcattccagcctgggtgacatcgtgagagtctgtctcaaaaaaaaaaaaaaaaaaaaaaaaaagaagaagaagaagaatgaaaaaaacacattcttccaatgtcctacaagacccaacatcataagtactctctgctccctttcacaatgaatttcctacacattgtattccattcctggatcactctactgcaggtagaagctactttgctgttcactggaacattctctttacaatttcatctaaagacctttgcctgaaatgttctcccaggcaaaatagcctggctaactctgttagctctttcgttgtttccttgaagtttatcttattaataagcctgccccgattgtattattgaatagtacaactacccctctcctcctttattttttcttttcctttcatgcaattttattgagatataattgccaaataatttttataagtttaagatgtacaacacgatgatttcacacacacacacacacactacatcacacatagatatatattgtgatatgattaccacaatcaagttagttaacacatctatcatctcacctatttgccattttttgtttttttggttttatgacaggatatttaatataatatctactcccttaccagatttcaagtctataggagtgttattaacaatagtcactgtattagtctgttttcttgctgctataaaaaacttcctgagactgggtaatttataaagaaaagaggtttaattgactcaccgttttgcctggctggggaggcctcaggaaacttacaatgatggcagaaggggaagcaggagtgtcttacatggtggcatgtaagagagagcatgtaagtatgcaggaaaaactaccatttacaaaaccatcagatcttttgagaattcactcaccatcacaagaacagcatgaggggaaactgcccccataatccataatccaatcacttttctccctccacacatgtggattacaggtccctcgcttcacacatggggatgagatttgggtggagacacaaagcaatatcataagctatggggatctaatgtacagcattatatataaacacattttataatggaaagtttatatgcttcgaccagcatctccccatttccctacccactgtcccctggcaaccaccattctattctgtttctaggagtgtccccctcctaattcttctttaatctgagttaatattttttgtagcacttatcacaatctaacataaaataaaatttccatgtttattatgtttattattgtttgtctcatttcctgcatgagacaccacctccaccatgtaatctctcttcgtaggaatctttgtcttctttgttcactgttgaatcccaagtggtgaaaactctgcctgacacattgtaggcacttaataaatatttatggaatgaatgaattaatgaaaactatgaactatctttttatctcattaccctgaaatgcactagttacatactctcctatactaagtgttaaaaagaattgatttattatagtaacttaatttcctattaacagagttcctactttaggttcaggcactgacaccaggaggtccttaaagtaatgcattttgataagtgaaataacccattgacatacccactagtaactacttgcatattgaatttatcaaattacctaatttgtattaaagagagcaaggatctgagataatcaaactaagaatgtagtttttgatgaggagacttgagaaaaagtttgctgctggagtgtggtggaggcatacctgggtgattccagggcacatccaaaaggaaggagagagggctaggtgttgactttggttttggaagctggaaagaacatagttggggaaaataatctcaaaaaggggaggtggaacagaaagaaaaagccattccctttttacagttgtagtaggtccagcctggcttgttgcatttcaacaaggcaagaaaaaaaagaaagaaagagaaagaaagaaaagaacgaaagaacgaaagaaagaaagaaagaaagaaagaaagaaagaaagaaagaaagaaagaaggaaggaaggaaggaaggaaaagaaaaagaaagaaagaaagaatagaaaaggaaggaaggaaggagaagaaaagaatgaaagaagaaagaaaaaagccttttgttgtcatcagtgtattaggaaatgggaaacacacatatcaaccacagggaaaaagaattacccaaacaggaggttcattttaccctgctcctttcagtgaaagaagagagaattaaaaaggaggattaagtaggcatgtgcttagagctctgatggaaaaagcatttaaaggcagaattcacattccttaaaaggacaaatacacggcttttttctcccaaattatccatcaaggtgattttggtcacatgtgattcattagtttagagaaccaagttacttggctgtatttcagatttgaaaggagagcaacagtgggctgtgttaaatacatatatgtatttgcaccatttctatcctgatgacaggtggcaccattccaagagccaatgtttcctttcaaactatttctgagtacatttaatgatttaaatatgttcttaatcaatttattttttcctcccaaggtatcagaagtcctgactcaattcttcatattaacatatgcattccttactaagaaaccagaccataactaagaagggatttaggtatgagaagtctaaagctcattaccttaatttccttttttataggttaagcattgcaggatcatttttgagattctaatttttgatgtaatattttttaattaccgaatgtgggctttttatatctgaggtgatttttttcttttaaatcaatgtgtccattaaagaatgtattattgcacaccagatggaattaaatgaaccattgtgtgaacttggcattttcagatcgggttacctgaatgtaattacctgcaggcagtttccaaatctgctgttcataagggattagcttgcgtatagagattctcttccattctcctcaggttttttttttttccttgaaatgcttttagtcattttggcttattgtaccatcatgctctgccactgataatagtgaaaattaatcctgaactaccagaattgatgatacagaacaagtcgacagctgtttaaaaaacaaacagacaagggacagcttatagaagagaacgttatgattttgtgccacataaaatttgaattgtctgccacaattctaataatactgaaatttggagaaatttctctatctattaaatagagtttctttcagaaatttatccccaaactgcaatgctgcatttaatttcctgttgttattttaaaatcacatcagttgaagaatatgaatgtctacacattttgaatcacattccaatttattttctttgcgagtgagcagaattatatttcctgtgagtcatctcttcatatagggagtataccctctgggtggcatttattgctggtgtgtcaatcaccttcttattttatctctttaagtagtgaagagaggttatgtgtctgtttcctgcattgatgttaagtgcacaattttctctcactaaataaatatatatttaaacaattggaagaatgggatttcaaaattccattttaaattctcagcagtaaatcagttttatctttccctttaaaagtgaaatatatatatatatatatatatatatatatatatattactactttcttcaagcagttggtgaagagcatctaacctgagactgggaaacatcaagttaatagaaacaatataatttataattttacatgatttcatatattatttttctgttagccttgtaaactttccaatgactcaagtgatttaaatgatgtgtgaatttttttagtaaggagttgaataattagctttcagagaatttaactagtatcattctaaaatacatgatgacctggaaaaatataataataatgaacataaccttacagaaatgaattatggaataatgatagataatcaaatatatgccaccagtttgtgaattaatgttagattatgttgaaaataggtcacttccaaagaagccattgttttcattgttattaatgtagacttgaaattgatattatatagttagtttctaacttgcaagccacaagataaagatttaggctacttaaagcaaaaagtaatttgctgaatgtatgctggactcattaagaggagtctcaagaattaaacctcgaaagccaaagggagcataactgctctggaagactaggaagcagggatggcaggaatgatcacatagtatctttttttaaaaaaaacagctttattgagatataattcaagagcataccactcatccatttaaagtatgtttcaaccattccttctatccttgtgtttctcattcaagagtccacatcttagagaagcatctgttgtccaggcttatgccatatctcctccttctgctggtgtcagagctggtgaggggcaaggcatggctggagtcacagcatgagatgagatatccacaggcagccacctggatttactattctgacaagcaagatataaaaaattaggcaaaatttatttttagtaatatgctgataaatatgttgaacaactcgttctctcccacccccaaaaaaccctgtttgttttgttttggatttacagatttccatcatgtaaatactccaatcgtaatagtaattttaagctaccagtgtgacagtatgtggagttgggtagggatgctaatcattggttcttgtgagctggaacaagctgattacagcacactacttagtatctccccaaaagaacatgggtactttcaggaaggggaaaatgaatgctagccattcaaaatgtacacacacacatgtaatgagcaaagatcttattgaccttaaacacagagccattcaatatgttgtttttcataaattagtgactcagtagataagaatttgggtgcagagatgttagagactactcttacgttttatttcataagaaaatagaggctactgtcccttgtcaatttcttaatttagctcaggaactcaaatggacacattaaaaatattaatagtaaaattgtaaactgttttggtagggagaattctaagatgacctccatgacactcacctttgttttttttcccccattaatatgttatattcatggcaaaagggattttacagatgcaattaaggttactaattaggtgactttaaaataggaagatcacacaggtgggcttgacctaccatatgggtcttttaaaagcagagaattttctctgactagtagaggaggaaatcagagagactcgaagcattagaaagactcagtgcaaaagaggcatgcattgcatgtgggaaggacctgagagcagcctccaggaaaggcgctaggagagccagaccaactactgactgaaattcatcaaggaaaacatggcctcagtcctacaactgaaaataacagaattttgccaaccgttagaataagtttggaagtggattatttcttagaataccagataagagtccagcctacccaataccttaatttcagttttgtgagtccctaagcaaaccatccaggctgcccagacttttgacctatagaactgtgagataacaaatcggtattgttataagctgctaagtgtgtggcaatttgttatacagcaataaaaatctaatataactatctataaggaggtgccttaaataaactttggcactacaagcatctgaacaaacaaaaggatctgtatggaataaagcgaaagaaaggcttttaaagaacattaagtcttaaatcaattgttagaagaagacaattggagtaaggaacatgaagtaagtggaggataaggggtggacaggtaatcatgtcagcgatgattattggcataaaaaagaaaccttactaacggaaatataagaagacaggcaagattgcattagagagtcataaaagataaggtcaaagagctgaggttggtaaattgatgaagatctaaaattctgtgtcaataagtgattctcaacactttgaggaattttaacccatgaggacattttagaaaatgaacaccagaatagcacttcagaaaaactgaatcagaaattctggcatatgtgacagcatctacatttttttaaacttctgtaagtgatttttgaggtgcagccaaggttgaggtccactagtgggaattctggaattcacagatatctaaggactatctatggactaaagctatgctagaaggtacagcctctctccctccctccctttctttatttcttctttctcaatgtaagaggaagacatgagtcaaccatagctgaattataatattgctgggtttttttacagcaaaaaaatgaagaatattataaaagtcaaacaatagaaggtgccaaacatgattcctattgtaatggaaatttatgccatattatttcattaatatagtttttaatctcatgcaaactgtttaaatgtatatatctgtgatattttaataatgtcccaagtttgatttccctagaagcagactctgagatatatattaatatataagatatttattagaatgttctcttgatatccacatggaaggaaggaaagatgattttgcagaaagagctgtggagcactccaaagatagatgtcacccttcatagttgccccaaattgggcaagctgatgtggccttatattcctactgtgatctataattgaaggtaaactctccttgaaaaaagcagttttcctcacctgaagccatccacaatggagaatgtccactgagagccatcgtcacacggaattcttggcagctgggagaataagatttttaatcctgagaaggggtggtcaggactgcacatcacagagcccactacaaatgtctacttctagctggtaaacatacaggatgcatttgcttttaaatgtatttccctaattataaaaaaaagcctgatatctacaaatttgttcaaaatattttaccaaggatcctattttcaaaatatgtttgaaactagttagcaactagttatacaggtgatggtataatttaatgagataagaaatatggaaagaaggatatttttagggaagaggatgtgtacaatcgttgataagtagagtttgatgtatttgcataaaaacaaaacaaattttaaaaatacacgatttcatgatttcatgtgtcattttagattcagccctatttttgaaaagattgccaatagttgaaactttttaaacctaatatattcttacctcacacagttgtcagtttttttttctttgaaatactttttttattcacttctgggatattatattctctaggttttcattttcctcattctaaatatctttcagatggaagtgacagattctttctatgcttttagatatcagaaatttcacatttgtgattaactcagttctacaattgacatctttaccctcctcccaaacaatacagggacctagaatattttaattccaattaaagcgttgttacttataatttctattcagtgatttattttaatttttacttaaatattatttttatataatcaatactttctttagatttatccataagtttaatatttttaattaaacaatctttcttcctgcattttctgggatattttttcttatttctttttttttcttttttttattattatacattaagttctagggtacaagtgcacaacatgcaggtttgttacatatgtacacatgtgccatgttggtgtgctgcactcattaacctatcatttacattaggtttatctcctaatgctatccctccccgcttcccccacccaacaacaggccccagtgtgtgatgttccccttcctgtgtccaactgttctcattgttgaattcccacctatgagtgagaacatgtggtgtttggttttctgtccttgcaatagtttgctgagaatgatggtttccagcttcatccatgtccttacaaaggacatgaactcatcattttttatggctgcatagtattccatggtgtatatgtgccacattttcttaatccagtctatcattgatggacatttggattggttccaagtctttggtattgtgaacagtgccgcaatagacatacatgtgcatgtgtgtttatagcagcatgatttataatcctttgggtatatacccagtaatgggatggctgggtcaaatggtaattctagttctagatccctgaggaatcgccacattgtcttccacaatggttgaactagtttagagtcccactaacagtgaaaagtgttcctatttctccacatcctctccagtacctgttgtttcctgactttttaatgatggccattctaactggtgtgagatggtatctcattgtggttttgatttgcatttctctgatgggcagtgatgatgagcattttttcatgtgttttttggctgcataaatgtcttcttttgagaagtgtctgttcatatcttttgcccactttttaatggggttgtttgtttttttattgtaaatttgtttgagttctttgtagattctggatataagccctttgtcagatgagtagactgcaaaaattttctcctattctgtaggttgcctgttcactctgatggtagtttcttttgctgcgcaggagctctttagtttaattagatcacttttgtcaattttggcttttgttgccattgcttttggtgttttcgtcaggaagtccttgcccatgcttctgtcctgaatggtattgcctaggttttcttctagggtttttatggttttaggtctaacatttaagtctttgatccatcttgaattaattatcgtataaggtgtaaggaagggatccagtttcagctttctacatatggctagccagttttcccagcaccatttattaaatagggaatcctttccccattttttatttttgtcaggtttgtcaaagatcagctggttgtagatgtgtggtattatttctgagggctctgttctgttccattggtctatatctctgttttggtaccagtaccatgctgttttggttactgtagccttgtagtatagtttgaagtcaggtagtgtgatgcctccagctttgttcgtttgaattaggattgtcttggctatgcaggcccttttttgattccatatgaactttaaagtagttttttctaattctgtgaagaaagtcattggtagcttgattgggatggcatttaatgtataaatttccttgggcactatggccattttcatgatattgattcttcgtgtccatgagcatggaatgttcttccatttgtttgtgtcctctttcatttcattgagcagtggtttgtagttctccttgaagaggtccttcacaacccttataagttggattcctaggtattttattctctttgaagcaattgtgaaagggagttcactcatgatttggctctctgtttgtctgttactggtgtataagaatgcttgggatttttgcacaatgattttgtatcctgagactttgctgaagttgcttatcagcttaaggagattttgggctgagacgatggggttttctaaatgtacaatcatgtcatctgcaaacagggacaatttgacttcctcttttcctgattgagtaccctgtatttctttctcctgcctaattgccctggccagaacttccaacactatgttgaacaggagtggtgagagagggcatccctgtcttgtgccagttttcaaagagagtgcttccagtttttgtccattcagtatgatattgtctgtgggtttgtcataaatagctcttattatttttatatacatcccatcaataactagtttattgagagtttttagcatgaagggctcttgaattttgttgaaggccttttctgcatctgtggagataatcatgtggtttttgtctttcgttctgtttatatgatggattatgtttattgatttgagtgtgttgaactagccttgcatcgcagggatgaagccaacttcattgtggtggatatgctgctggattcagtttgccagtattttattgaggattttcaaatcgatgttcatcagggatattggtctaaaagtctctttttttgttgagtctctgccagcctttggtatcaggatgatgctggcctcataaaatgagttagggaggattccctctttttctattgattggaacattttcagaaggaatggtaccagctcctctttgtacctctggtagcattcggctgtgaatctgtctggtcctggactttttttggttggtaggctattaattattgcctcaatttcagagtctgttattggtctattcagagattcaacttcttcctggtttagtcttgggagggtgtatgtttccaggaatttatctatgtcttctagattttctagtttacttgcgtagaggtgtttatagtattctctggtggtagtttgtatgtctgtgggattggtggtgatatcccctttatcgttttttattgtgtctatttgattcttctctcttttcttctttattagtcttgctagcggtctatcaattttgttgatcttttcaaaaaaccagcttctggattcattgattttttgaagggttttttgtgtctctatctccttcagttctgctccgatcttagttatttcttgccttctgctaacttttgaatgtgtttgctcttgcttctctagttcttttaattgtgatgttagggtgtcaattttagttctttcctgctttctcttatgggcattgagtgctataaatttccttctacacactgctttaagtgtgtcccagagattctggtatgttatgtctttgttcttattggtttcgaccataatattttaaaatgtgtcttctttcttcctacatggaacttattaagatttctaattctgaggacttgcatgttttactaattctaaaagtttctcaatcattatctttttcatattggttctgactcattcactctgctctaattctggaaatgcagttggttctatgatagactattctttctagctgtacatctcttaacctgtttttcatatttttcatttcttatctccctctgttgttttctaggtaatttcttaaattttacaatatagattattaattttctattttgttatatgtattatactatttaattaaactacagtttctaattataacatttttcattactagaagttctccctcttattcagtttcaattattcctggtaaattttgatagtatactattttttagtcatatttcaatttcctcatttttcttctttaaacttattaaatgtgcttactatatgatcttatctgatgaaaccattattaacattctttcttattttgatactggaaccttttgttcacttttgtttttttgctggctatcactcacagtcattgatttgattgtttctttagagatttttaattgtgagttagttgaacatttttgtggatttatttgaggcctgaagttgaagtgagttctcaagagatacattttgtgttactccttttcttcactggaggaggtcatgattaactgggtaatcttaaaacttctttggcttgtgtttttggatgcacagatgttgcgaagtccagctgccaaccataaggtatgcgtaatataaataggtatttctaaagcagtttttaacagtcagggtttagtagaggaaataggaaatactttgtatttcaagcagtaaagaatataataaatggaactaggtgctcagaaaattattggaagtgccgaagaagtggaaatcagggggcatgcctagactttcaaaatcaccccatcatggttacgatacagaggtcctgaataacttttgttattgccccaccactgggctgctacagataccttatcctcaagaagctagtttctagacatttaaacatggactgcagttgctgcaaatattcctggtgcttgtgtgaacgttgcatctgccacaggaagagtgcttcatttctgccttctatacctggtataaattgacacacaggaccatggcttccagagaatctaaaaattgagcttttagattctccaatagagaatagaaggagagtaaacttctccaatagaaggggagtaaactgaatgttgagagagccaatccaattattcatcactttttttttttcctttttcttctatgtgaaggcaagatagggagacaggcatgtgtacccgccactttatctattgtttgtattacacctcatgcttctttatatgcttttgatcccagctattttcttctgttctgtcctaagcagttaaatctctaggattgacccaaggaagtcactggctttatcattcagttacccttacgaacttgacttttcctatccaatacagattttctgaaatccctttatgtttcatcaggctcaactgtgtatatagaagatgttttaaaatactggatctggtagttttacttatgatatacagaatgggtttctatcacatctgtttgctaaatgtacaactatgtcttaaggacatttttttctttttatattttttgatatcttaatggccagtacttcttagtctcctttgctaattcctcttcttcccagctgctaagtgttggaatttcctaggaaccagtcttcaggcctcttctcttatgtatttatattcttttcctaaatggtcttattcagtatggttttttaaatgtcatctttatatgctggtgacttccaaattaatatattcaagttagacctttcccttttgctccagatcatttatacaaagactgcatgatattccttcctagaagtttataaaacatttcaaacagacattaaaggtccaaaatataaattttactttctccaacctacccacaatggattttccctcagtctttttcacctcagtcaacaatacagtaatgtgttcagttagtcatacaaaaccctaaaaattatcttattctcttttcaggctgtctagtatccaatccaggaacaaatcctgtcagttctatcttaagtagaatcatttctcaagactctcccttgtatagtcagtatacaagactattgtatatatatacaatggaatacattcagccataaaaaagaatgaattaatgtcttttgcagcaacatggatggaactgtaggccattgtcttaagtgaaacaactcagacacagaaatataaatactgcatgttctcacttataagtgggagctgaataatgtgtacacatggacatagtgtggaaaggtagaaaatggagactggaagggtgggggtcaagtggggggatgatgagaaattccttaatgggtacaatgtacattgttctggtggtggtagatatgcaaaaggccctgactttactactgcacaatatatttatgtaataaaattacacttgtaccccataaatttatataaatagacgtgcccactatcatactagtctcaaccaccatcatctcatacctgtgcttcaataataggttaatagaaatccaagtaggtgactgaagaaaactaactagtttctcctctactgtcctcctttaaaacgtgtcctggccgggcgcagtggctcacacctgtaatcccagcactttcgcgccactgcactccagcctgggtgaacgagcaagactccgtctcaaaaacaaaaacaaaaaaaaaacaaaaaacatgtcctttagcaagcaatatgcacttttaaagatgtaaatgagataatgccacttatgagctaaaacctccaatgtctttccaccttatttagaatgaactacaaactctttatgtgatctgcccctgtttatctctgcagcatatcagtgatatattttgaatttacccctttgcatgccccattctagctgcactgacattattttcattgtatgaaaaagaaagtccatttcatctgggatactctttccccagttctttgattttcccactccagtactttattctgatcctaaacaaatgtcatcttttaggggcatttccttataacactatctaaaataaccactcttgcacagctacctaatatcttatacatatgagtcctttatgacatttatcacaatctaaagctattacatatttgttttcttttgtattatctacattttcaaatttattccaaatttcatgagaacaaagttttggttttattttatttacctttatggcctatatatatgttgattaagtgcatggatggatggatggatggttggatggatggatggatggatggatggatggatggatggatagacaaatgatactcaggtggagctgctcaggatcagtaggttatgtgggaataatgtatatcaggatatatacaggattacagatttgaaaggcatgaattcatcaatcattcattggactggatgaaatcgtccagggatagcacagcaaggataaaactctagagaaggccgatacttattttatgctttctaaagataaaaccatgttgaatttttttcttgctgcagttttagtacctactatagtccttcatataggagatgttcaatcaatttgacttatttaataaatgaattaaaaattggaaagaatatcccaccaaagggaatatgaagcatcaattagagacttaagaggagagctaaggaagtatgagttagttgaaactagaagataaaggggtttcaagaaggaagaactagtcaggaatctgaaaaactacagaagagtcaaataagataatgtctcaatacaattcattacacatatcaagaaaactggaggcattgacattatgactattagaagacatttgtcgctatactaaatattaatacattgaatttatatcagtaaacacccttagtctatagtatttaaatgctcccttcattgcatgctggcatttcctagttttgaagaatgtctctatgtttttgatatctgttaataataatatgtctaagattcttctttagattcaagatctgagtcatgttatcaatacattaggtcatgctatcatgaaagaaaactaataatagtttctcaagatcctaattaaacatttggaaagatagtatgaaataactatttggaaactaataaagagatgactctgttattactgaatatcaaaggatggcaaatttgtgaataagtccccagatttgtctgcaacagtcacagtaaaaatttagaattaacaacagttaaatctcaagaggataccacattaagtgcaactgttaaatattttctcaaggacacagaccttaacagaaaatggtggctactaaaagctgactactatgcaaatatcttggcaagacattgggtatctgagtcccctacaggacacagctgtgataatctttacaaacgtaggattctgctagggataggaaaagagccaggctcactggagacttattgcgaaaaaaaaaaaaattgtactttttgtgcagcttctgctctctgaataatctgattacatctccagggcaatttatatggatcactaaactggccataaaatattataaaattataacctattattagttctgttcctttactcatataaacatttattacaggtaaaatacctggtggttgtgttagacccagataatactaatatttaatcgcattaggtttaagaagaacaaacaaaagtgctttctcctgctcctttatattcaggcttgaaatatcatttaaaataacatagtagtgcatgtgattctgtttaaggggaggttcacaaaaccctatctctcctagttctgatatcaaagttagggagtgaggtggaagacccttatttctccagaaataagagaagaatcaggagttaggagactccatctctgcttcagatctgtccatcccatcacatgggtgattaccaggcaaggttcttcagtgtccttagattggagagagaatatctgcactgattatatatttagttaattgctacatacatgtattgaaagaaatattttcatttcttcattaaaacatatattttatttagtatttgttttaacacatattaatttttaaagtaatgccagcttattataaatatcaaataaaatagaaatttacaaaataaaaaccaagagtcctacctcagttctaccctactcttcaacgctactctccctggatcactactgtgaatgggatgcactttgtcttccatatatctgtttagatgagtctgtatacacacaattccatgcaaacctataggaaggccatttactccatatagacaaccctgtcagaagaatctttcacaccttctctttcttttcaagtatatttcttctcaaatcttctaatctattccccttctctgaggtgttgattggaagaggatccagacaaggtagtgatagattacagaacacagcagctggggccattggtgattttgctccctgaagtcagattactgaaaggcacattctcatagctgtctccctactcttgtctcttttcagtaggagtagccagaaaaattatcttaaaaagtatatcagatcatttgtcttctctgttcaaaactctccaaaatctcatttcattggcaacaaaaacaaaaataatacaacagcctcagtgcctgctgctatctaaccccccccccatttcactcattatctctccagtattatatcctctgcttcccccttttccacttcattctggagactccagagacactatgttccttgaatatttctctctgagaaaatagacacaatcacaaaaacaattgttttattctctctgcttgggagttattctctctgcttgggaaattcttctcccgtatatagccatggctcatttcctgacctctttcaagtctttgctcaattattacattcttggtaacgtggacccagacctctactcctcattcaaaacagcaatcatggcctcaacactcctgataccacaacctgattctttctttttgtaacattgatcacatacaagataggtagtatatattgtacctttgtacatatttgttatgtgtattatctggcattctccaccagaatataatctccaaaagtatatgattttaatcagcacagccctagagcctagaagagtggctagcaatagcagccattcaacaaacatttgtagaataaatgaatgaatacatacacatatataggagttaatatagcaaaatgcattagtgtgcaggaactagagtcagactggtagactctatcaattatcagctgtaaatataaataataattgatccataagtatctaaaacatactttacagggttcttaaaagggttcagttagcaattaggtaatagttgtaaagagacacaagttatttttttctggtcagttcttcctctttatggaactgttcttcttttccccctagctattagtttctataaaattgtcatgttcttactctctaatagctttcattttattcagagtcagagctcgatacttacaagagccccttcagggtgaaagctaattggtctacatatagcatctaacttaaactgagaaatataagacttgcctgaaattttgaacttcagaacacagaatgtattgccaacccacttcaacgatagtaactataagaagtacaactcaagtggaatcgctgtcttgtttctgaacacatggacaaaatttgacttacagaagaaagacaattaggcccactcaaagataagagaagttaaaagccagaaaaagagtgtgtgtgtgtgtgcgtgtgtgtgtgtgtgtgtgtgtgtgtgtgtgtgagagagagagagagagagagagagaactgggaatgtttgcattcctacttccagttggttctaagtcctagctgcatcctgtcatacatatgtgtaagtcatttaatcccctttctgtatccacgcagccaataaattgctcttcttttttccaaagaattttaagttgtttctattacttacaaccagaggagtctaatatataccacatgttttgctaggattaataatattaaaattaaggcagtaatagggattatgtattccctgtagtatctacaagagagctgttcataaagaaatttgttataatgttatattagcaaaagacattccaataatatgtcacattgttttaagacatgccaggagatataaattagttaagaggcataggaatatgttcttgggtacagactctttccacaccatcctttgagaactgcctctctacgttacccagaaagctatagctttcttgttttcttggacctaggggctaaaactaaaactcctaatgagacgcctttctttatgcagccttttcttctccccaggtaattaatcacatgctcttcagaaggctttgcttgaaacagtccctttttgatgtgctgcgatcaccaccagtcataactaaatgtaatagcaatttctccaaccatactggctttgataaaacatgctttattcctagaagattaggccattcattcatcatgtatttgatgataataataatgataatgatctgttgactgttagcttctgggtgctctaagccttttttagcttttaacacaaattacaggtaggcctcccagccacctgtccctttaggaaagtaaacagctctctagaaagccttctgatatgtttttttaactcattctagagtagcactttttaaactttaatgtgcagttgaattgctccaggatcttgtaaaatgcacatctgatttagaaggtatagaatgaagcttgagatactacaaccctacatactaggtgatgttgatgctgctggtctatagactgcacttttgattaacaagttccaaaggatttattatgtactggtcctgttcagtgctctaatgtaatgtcaaagttccataaacttttcagtgtgtctctcctttacaaacagtaacttcccaccatacatttttttaaaatcacatgtggcaaattcaaaacctttttcttgtcttccccttctgagaactgaaacaaagaacccctgtcatacaggcatggttcttataccactactagtatcctttgtaaagacaatacttaaatatccactgggatgagcaaatcaaaccatttcctcatgtgtggttgtaaaggcatagaagagtttattttcattgtgcattatctttcagacttaacttagatcttattattcacctggaaaatggaaaacacttgcaaagaaacatccctggcttctctgtttttgcacttttatattttatttctcctaatctgaaagtttacttatgagtcaataaagtttcttctttttatcttgtatttaagtcttatacaaggagaacctaaaaaaaaatgttattcactgatccagtaacttaataataatagcatcatttcttgtgggggaaaatttacctttttcagttttgaagtgccatccccagacagtgatagctagtacaatagatgcagttcccttgtttgtcatagactctactggaataagagataatcaaaggatatactttcttttaatgtggacatattgccacataatgtctttgccctagggaattcatagcaagatgtagaaagtagctcttctaggtcactttgattccagtccaagttgcttgtgattaatactgctaacatcaacagctgctctagtactaatgtgaaatacagaatggtttcagtctagttcactgtagacaagttcccacagcatgcaaattattaatgcccttgtagacagtgttaggactctaaatcgttttgaaactgaatgccagacctccctagagatgaaccctatgacaataagtcagcttcactggagacttactgtgaaaaaaaaaccgtcgcactttttgtgcagcatctgctctctaaataatatgattagacctctaggacaatttatatggatcactaaactagccataaaatattatgaaattatgatgtgttattagttctgtccctttacccatataaacatttattacaagaaaaggatctggtggttatattggaccctgataatgctaacatgtaatagcattgggtttaagaagaacaaacaaaagtgcttgcccctgaagaaagcagtacagttttagtcaaaatcatgacctattaaaatttctggtcttgggaggctgaggcaggcagatcacctgaggtgaggagttcaacactagcctgaccaacatggagaaaccccatctcaactaaaaatacaaaaaaattagccgggcgtggtggtgcatgcctgtaatcccggctactcgggaggctaaggcaggagaatcgcttgaacccgggaggcagaggttgcggtgagctgagatcacgccattgcattccagcctgggcaacaagagcaaaactccgtctcaaaaagaaaaaaaaaaagaatttctggtctttagctgctgtttttcataaacaatcaatcatgttaagttttttctaatgtagctatgtactaatatactaatttaattggtgatagcaaaacatctctatcattttaatatgtcaatactcacatttgcaaacaatatgtatatagttgatgtcattcactagatttaactgtgtgacgcagtgatttataactaatacttaattagcaatacccataatttaaaaattttgtgtgatattcacatatttcaatgaaaaggaatctctctgacactttaggcaactcagaggtaaagtcaatgatctaataacaggaagatggacttttgcccatactgtagtgagaggtaattgtgtcttttctgagttctttatacttccggtgtgcggtgggaagaaagagttaaacacctgtctaggcacccttgattacacacacccaaattgaagagactggattatctttgtactagatagaatatgttgtcatttggtaattttacagatcctaacaacatgttttatattgtcttaagcacacttatttgggcacaggcaatacaaacctagcataaaaataccaaccaacagtaacaacaataacaactaaactttgtgcctactcccaatgaaacagaaaataatttgaatatttcaaattttaagtttttaaaaattagcaacatgtgttttgcttcttgttttttctctctctctttctttcttctttcttttttttttttgagacagggtctcactctgtcattcagcattcaggctgcagtgcagtggcatgacaatcagggctcaccacagcctccacctcctgggctcaagggatcctctcacctcagcctcctgaatagctgggactacaggcacactatcatattcggctagtttttttgtagagacagggtttcaccaagttttctaggctggtcttaaactgggctcaagcgatctgctcacattggcctcccaaagtgctgggattataggcgtgagccaccacacctgtccttcctttcttatcaaagtaattttttctctaaaacatttcaaaaatatagacaattacaaaaaataatataacacatatctatatatttgccaccaagtttaaacagctattaacatttgccatatttgccttaatgaaaataaaattgtagatacataaaagcgtatatctgtcccttctcctctctttctttacagaataagttggtgtaaataatttctgtgcagtcttttgaactgtattccttttgtatacccccaaatttataccattattatattctatattttaagaatttatagcaatgatattctatgtttttaaatatttctttttttctttcaacatattttttatgctaatgtaggtagctctatttcagtcatgtttactgctatatgacatttcactggaagaataagccacataaatcacagctttctggtaatgtggttctacaacgaatatctaggttatttaggttttttcccactaaaacaagcaatgcttcatcaaacatcatggtatatatgctctcaggtatatgtgtgggatattctctaggataaatgcctataagtgtagctactgatacagggtatgagcatctgcaaattccctaggtgttgacaattgctccccaaggtgatgtgccaattgtcactctcaacagtagcatgtaagtccctattttgcctcattctaaatagctcctggtattgtccaagaaaaaaagggtgattgtaaatgacatcatatttgttttactttccccctgaaatatcagtgaaggttttgtgtatcatttatattacattaacccttactgttgatttttcatatcaaagtccagttttctatttctttgtttggttctttatttttatttatagttgtttctatattttaatattgattattttcaattaaataaattttaactttagtgtaaatattttgtaaaagatgtggcatccaaaaattattgaagcaattcaaatctttacttatcccttgtggggagaagtttcttaagtaattatttcagtttatattactagtacttttcatgtatctcagtattaagtgttaagccacaattcttgtaattttataacattccatagagaagtaaataaatataggaaagaggatttacttatgttgcctgagataaacacgaagaaagtaaataattttttttcttgataatttgatggatttttagggttttatttttaaacattttgaaaggttgaattttactgtacttgcaggccaagaaattaaccttccgcagtttcataaataatgccaagagacatgagattcctgtctaaggaagtggcacaagtttcatgtttgcttcagctcccctgccccactcccatcaccaccaggaggtgacacagaggacctcactgaggtgacacagaggagcccacatgaatgttgaacacatcacagatttgcattatcgctgaggaaccccagccttagacaaccccaatcttttataataagcaggaggaatgactgctctttgcttcgaagggagacactatctttattatattggatagcaagcaaacctgttctttgctttgaagggaggcattatctctatcttccaagatcttctctatataagcatccttgaaaagctggtcataaacaaaaaagtagttatggcctctgctcacaagatatacagaaatatgagagaccaatgaagactaatctctcaaaacttgtggccggacaaataaaaatgtttatatgagtaaatttaaacgtttgctttacattgaattttgtaaattacatgcaaactttttaaaactaaagctttccattcaaactagtatttgtacatttttcaaaaataatttaaaaagggcttgaaatacaccctttgccttccctagtccctgctccaccctttgccttccctagtccctctcctcagaagtaaacactttgaactcttaggttttagttttctgatttgttatctctaacaatgtgctggtaaattaacagctggctctccaggtttagtcccaataacaatgttggttgatatattttgtttatataagatacaaattaaatgatgaagtatatgtctaaatttgaccattcatcagtgatgtgaatttttttttgctacaatacataacagtttttgaacaggaagcatattttctcatttttttggtgctatttatattttagtggccacacaaatcacacagttttaaatggaatcaccgttattgacagtttctccatgactttcctaaatccaatcaacaaagcaatatatcaagcccttatatgcggtgcaggatgatctctgtggtgtaaatgttctcgattacaagtcgccaatttgccatagcgaagcatgcagttgggaggggacgtgcagtagcattccattgcatagcatgctgccatatggatgcaataggtgtgaatcattctcaagaatgtagataacagtaaaaggtagtaaagtaatttggaagtgacaagtttgaatataatttttataatataaattttgtatttataaagttttacagtttgatttttagtcatggctatgtttattaaccagctcacaaaacttctgaaaatttaacatttggatcttgtgagcttgttcaagctggctctatcacaccactgactacctccataccttaaaccagtatgcaaaccactactttttgatttatcagttctatacattatcttctgatttcctgcaataatgaaaatttggctcatttatgttattttttctctccctgtagtagcctgtgtccaatatgacccccaaagagccttttttcctggtattcagctctttgtgaaggctcctccctcacaaaatgactgatctgtgtaaccaataggaaacaattgtatgtgactttaggatgaaagagtcattgtgatttcggcctgactttcttgaatcacttgctttagaggaagctagctaccaagttgtgagaacaccaagcagccatacagacaggtccatgtggtgagggtctgaggccttctgccaacaaacagagctcctacctattctggaggcattgcttcatgttattagcatttattgttgctaacaagaccactaatgccaacctgattcttatttctgtgtcagtgactgttatgggttgaattgtgtctcctccaaaaaagatatcttgaagtcctaacaactggtatttcaaaatgtgactttatttggaaatagtgtccattcatatcttaactaattacattaaaatgaggtcacactggaaaggatgggccagtaatctaatatgactggtgtccttgtaagaaggacccactgacgacagagacacacagggaggatttcttgtgatgaagaaggtagggattggagttatgtagctgcaagccgagaatgccaaagtttgccagccaaccaccaaaagctaggaagaggcaagaaagggttcccctgcaggtttcagagggaatatggccctgaccataccttgcttatggatttccctccagaactgtgtgacaataaatttctgttttaagccacccagtatgtggtactttgttataacagccctaggaaacaaatatagtgaccttgtttctttctctcaggaaaaaatttttctttatctgtattagctcattttcatacagctataaagaactgcctgagactgggtaatttctaaagggaagaggtgtaattgactcacagttcagcatggctggggaggcctcaggaaacacaatcatggtggaaggcgaaggggaagcaaggcaccttcttcacaaggtggcaggaagaagtgctgagccaagggggaaaaaacccttataaaacactcagatcttgtgagatctcactcactatcacaagaagagcattggggaaaccgcccccatgattcagttacctccacctggcctttcccttgacaagtggggattatgggtattatggggattataattctgatgagatttgggtgggaacacaaagcctaaccacatcacctatttatcttttgttgtttgcagtttcccaaaggtgtgtctaactgcaattttcctttttgatttttttgtgccttgtgctgtgtaactagtatattctagcacatgaaaacttttaaattctggaaaattctatgacataatttgataacttcaacccattatctcctctcttttttttttttttttttaactttctgtagaaaaatgttgaagctcctaaattggcccactatgccccttttctgtctgtctttctttttcttaaagttcttttttgtcattctaggctattacttttttaaaattttgttaatcatttaaaatttctttgggttcctgctgttttatttctttttaattttcagatgttcattttaatcttacctttagggagccatatatacttgaatctctctgaagtgctaattagaaggggaggagtttttttggttgttttgtgtaagtgtattctggtttctagattattttcagtttttggttccttctttgattttaagttgctctttttctcaaatgtctgatgacactagttcctctttaaagtgatgcactacacactgttctctgatatttctatgggtttactgactggtggagaggtaagaggtccactattaagctggagtcacctaatgtcccgaagatgaaagagtttgtcttaggagcagtaacatttatacctagagctctcagagggctttctctttggagggaaaattgaatggtaaatacctggcagcaacatggggaaagagatgggagtcttaactgcccatatagattttcatttaatactccagtgcttaggcccatcttttacttgtacccttctttatgcctggcatttccaaggcccaagactctccttgggcttctcagagtatattgtgggtctatctaatttattctgttttgtattcttgcaacaattttaacagaatctcaatagggaaagtagataaacagcggtttaaaatcttgaaccagatatacagaaatctttcttttttcaaagcacattttaattcagtttatttaaatgataaaaacatatccataaaggcataacatatataatttaaaatttctatagtaaacaagataaaaggtccaaaatttcggtagatactacatatgaccaaatgtaaaacagcatgtcttccattttgcttatttctaaaacttttttttcccctttaaacaattgtaatttgtagcctcttagtccttctactatttttttttttctttgagacagagtctcactctgtcacccaggctggagcgcagtggtgcaattttggctccctgcaacctccacctcctgggtacaagcaactctcaggcatcagccttgagtagctgggattacaggtgcccgccaccacgcccggctcatttttgtatttttggtagagatggggttttgccatgttggccagggtgatctcgaactcctggcctcaagtgatccacccattctcagcctgccaaactgctaggattataggcgtgagccactgttcccaacctttagtaatggtttttatgtgtacatcttcttatttgtgatttcatcctgaaactcaacatgacatgacataaagtggagtagaccaatggccacaggctgggaaagtcctggatttgcctaggagttgtgggatttggggcaaggtatttcagctttcagaaccttgagtttctctatcatgaagtgagatattgaactgggtgaaatattatgttcttatcagactttgtgattctgtggtttaaatagaaatattttattcttctaaatatatttttgcaaaaattttaagtgtaatttttgccatagaatagaacaaaggattttatccagatctactctcttatcttctgaattattatctgaatcttctctccttctattccactattatcttggtccaagctatgcaatattgtatcctacccctctataatccatctctgtatagcactgtgagatagcatcttatactgcaaatcaaatgatatcactctactactaaaaactcttcggtgatagcagtaataaagtccaactccttaccaacacctgtaagtccatgtaagtccaacacctataagtccatgatctagaccctgcctaattttccatccttagccctttgcactagctaaatttgctaaaaccaccatggtcatttttttcttccctcatatatgccaacttttcctgtccctgctgtctttctgccaagactgctctctcttctgcatttcccagggctatgtatttcccagggctagtttcttcagaacttcgcttaaaatccatttcctcatttaaaaagagaaaaaaaaacttattattatcattccccctcctaaatccatggtttccttaatcatactcttcacaatttgtaatgatttgttactttggtgagggcaagaaacaagtttttcattgatcactttatcccttgtgcctggtatcatttctgggacaaaacaagtgtgtgataaataattgatgaaagaggaataggcactaaaatgaatgatttgtatataaaacctagtattaaaatgaattttattttaggaaaagtgataactggttatgcagagcaaaatcaactatggtgcaaagaaataaagaaaaacaaattgcaaattattatgtttccttcttaacttgtgtatttttttattcaaactgcattaaattaggcctgcttattttcagattttttcaggctgaccttgcttgaaattggaagcatttttagaataatttatgcatcaagaaaagggtataatgctttagtgatgcaaggcccccgagggcagagtatcaagtaaaatattcatgaagcttaagtgcaagagacatcagattttctgtagtattttaacactgcatttctgtacaagggaattgtaaagtgcaagaatatgagagaagataaatattgaggacaataaagagggcctgtaaagtgagttcttgcctttccgattttacagctattattctcccaagtgtgaggtgactgtgtgtgtgtgtgtgtgtgtgtgtgtgtgtgtgtgtgtattgggtcatattagaagttattagaagttcccttataataattataaaattaagaaataatataattggctatgtgggttaccatctgattttcattcacatctgactatttgaattgggatgtgttttctttaattattttgtatgaaaaagaaaagatggggcatagtgtcatagtagttgcatacgttttgtaagaaatttcaagttctcccagatgaaagataacctttgtttttcaacttgttttccactttcaactgtacgcttcataagacattcattatttcccaagatgttcaaaaaagatacagtgaaagggcattgggaaatatttaatatgcaataatctttagagtccttcattttgaaaatggtctctaaaagttaaattagtgataacataaaaagaaatctttccatgtaaatttgtctacaggtatttatttatctttctgatgtcattgattcctttgttctgattattcatcaaaaaaatttttttaaatgtttggtagatttggggaatcaaatattatgttaaagatagaaagctctacctcatcttgaagactttggagaggatgctgatctctgacctgtggctaaccgtcagattttaggtcatcgtgcaacatacaaaatattagattatagaatgtgtaagcttagaaattagaaattagtgcagtctacaatatcttcattttgtaatattcttgaacatttaatctgtttagaatataatggtctattagtatctcagattaataacatcttgcttcattatctttctttttgaaatgtttagaccacatttttctttcagagcagtagccataacattgtctgaaatttcaaatgaagacctttccaaagtaatagttataagtaaattacacagtcctccttgatgcatggagaagccttataattgttccaagtaaattcagaagtaataggtaataggaaggttatattcaccctgatagcccttacaagactggtcatcaacattcagaaccatgttaattgccaacactgtcatgaatggggtatttatatacctaattttgctgcatggccaaagattccataaaaataagactttatggaggtagacatgactggaacatagaaaccatagcataattaagcagaaaattccaattacataacatttatgtatttatttatgattcctcaactgtggccatgggtggcttctttttcttttttcccccctcagctttattaaggtaaaattgacaaataaaaattgtatgtattcacagtatacaaggcaatgttttgatatatgtacctattgtgaaatgattaaatcaagctaattaacatctattgttgcacatacttatattttgtgagagcattggagagcttaaatcagcaatttctaatttttgcaatatattaaatatatattttatattgtatatatttaatatatttacagtatatttttataatatattattattaactatagtcatattatacagtagatctcttgaacttattcatcctgcctaagtaaaactgtatcttttaaccagtatctccccatttccaccgccagccttctctagctcctggcaaccagcattttaccctctacttgtatgaatttgatatcttttagattccacatataagtgagatcatgtagtatttgtctttctatgcctagcttatttcacttagcaaaagttcctccagttttatccatgttatcaaaaatgacagcatttccttctttttaaaggctgagttgtattctagtgtgtgtgtgtgtgtgtgtgtgtgtgtgtgtgtgtgtagctcacattttcttcattcaatcatctgtcaatgaacacttaggttggctgattccgtatcttggctattgtaaataatgctgctgtgaacacaaaagtgcaaatatctctttaacatactgattttatttcttttgtatatatactcagaagtaggattgctggatcacatggtagtccaatttttaattttttggggaaactttttattgttttctataatagctatactaatttaaatttccactaacagtctataagcattcccttttgtccacattctcaccaatacttgttatctttagtagtagccactctctctggtgcaaagtgatgtatcactgtggttttaatttgcattccctgaatattaatgatgttgagcgttttttcatacccctgttggccatttgcatgtcatcttctgagaaatgtatattcaggtcatttgcccatttttcaatcagtttatttgttttcttgctattgagttgttcaagtttcttatatattttggatattaatagtttgtacggtttgcaagtatttttttcccattctgtaggttgtctcttcactgtgttgattgtttcccttgcttgaggaagctttttggtttgatgtaatcccatttgtctgttttgttgccgttacctgtgcttttgtggttacagcccaaaaaaaatccttgcccagatcaatgtcaagaagccttaattctatgttttcttctagtagttttatagtttcagatcttatgtttaggtcttaaatccaatttgagttgatttttatttttagtgtgagataaggattcaatttcattcatctgcatgtggatattcagttttcccaatgcacatttattgaagagattgtccttttcccattttgtgtacttggcaactttttaaaaaaatcagtgactgtatatgcatggatttttttctaggctatttcttctgaccccttagtctatatgtatgtttttatgccaacaccatgctgttttaattgctatagctttgtagtatatatcaaaatcaggtactgtgattcccccagctattttttgccaaagattgctttgactatttgggtattttaggtctccatgcaaattttaggattatttttcttttttctgtagttaccttgaattaaaattagtagtttgatttcaaatgtgaaacttgtgacttttttatttatggcaacagatttttacaattatataatgaaaagcaaagagaaaattatatttgaggtcgaaattcctattactattacatttttagaaatgcctcatggttatatatgtgtgtggaaatgagaacaaataggactggaagctttgacttcctgctccctcttcagcacaatactccaaaacagcatttcctcctttctctctcacaattcatcttcttttcccccttctctgatcttgctacatttttatttttattttttgttccacactgattgtagcccaaaggtgataaatttgtgtggactaagtgcaagaggagattggggaaaatttgtttcattgttgtgtcattaaactcagttttcccaccaaagcctgttctaataatttaatggccatgaaaattggttcttttttagagtaaaatatctttcctggctcatttgaaagttgccacattcaatgttgcatttttatctgaaattcggaaataactgaactttcctaagcgaatctcatctcaacagatttttagtataatatcaatgtcagagagatttgaatagactggattaagaaagccttgggtaaatgttagaatattacaaacctgtcatacctctttattattctgtttaataattcataaataggagtcctgctaagttttgataaataatatccctgtagggagcttactgagctgtcattggtatgcttgccttccaattttcctgccctgctcctatcagagaccatcttcagggttagtggtaacctagcagcatctttcggtctttccttgcctcaccactgcggcgcggagctccctggagtggaactggctttgcagacccttcaccagcctccactcagctttcactctcactttctgcttgctttcacaccaggagtgggatctaactctcacactaccatgggaagctgaatttatgttgtactatttcagaataaatttcaagttgttaaaaaaaattaataacttttgaagtacttaaatattatcatttaggcatttttgctaatttttcttggtgtttggcaatcaaccaccaggattaataatctgatacacttttttccttcaaacacatttaatttgtaagtacatcaaaacataattttattacaccttttaaagtttcatgtctttattagtaagtataaaatagttgttgcaaaaataaaaaatataggaacagatgatatgtcatacttttattttagacttggagaaaaagcagagatttcctataagtggtagttgagaaaaaattattccttatatgattttcatcatagtgtttgacgttacacttaaacactacactaagataatagtaatcataacactctattaagtctactgtatgccagttattcatataagcgctttccatatatttgctaatgtattacttagttaacaaccctgtaaggtaattactatttgttatctcattctacatatggggaaactgaggtacaatatatttgtgacttgtttaaggtcatcaagttagtaaaagtagctagattcagtcccaggcagttgcactccagagtacgcaacttaaacactaccttatactgcatctctgttgaaaaaaatgaaagctggttgctgcattgaacaatatcaaaaatttattatttggagaaattttctaatatctgtgtctctaaaatatgggtcagtgacgtttttggggagcaaagttcttggagatttaacatgtcatgataaatctgggtctttatatacttgtgaaatgtttcaatccataaaccagaaaattggatacttactttgattaacatttctgtaatggcacaaagatttgctaagaaagcatctttgaagactggcattttggctgtattgatgcataaaattttctaaccatatatctactatattgcttatcttatttaagtaaaactattccaaaagttattttatataacacaaggtcaaactatgctgacaaaaatcattactcacttcatacacatgttattgaaggtaatatctgtttaattctattctatatcctaagcattttgcaaaacacatagcaatgtatatttgaacccaagctgaaagtgaaacatcagtttataaagatgagcttcctcaaatttgtatgtcataattacatattagaagtgcaatgaagtacaaataaaatgaataatttatagttagtgtcaatgcagttaatgaaaatgtccgaagcaaagtgtttaaatcataactaatcctgcggggctcatggccttcacctatgctttagaaaatggataaatgccatctcctggaatggcctccttggaaattattctttggaagatgaggccccagactgtgctggggttacctctagaatttgggggacattggcactcatagactgcttcccacagaggaactggagcattcatcattctactggacctctgcttagcatattctgggtatatatcagcatgggtgcagaagaccaactacacgtagagggaaaacaatcaaataaaatataaaaagatgcttggttttataaagcagtaaatatagtcttctattcctagtatatgtttgcaaaaatattgttttaaaaatcagatctacatagaaagctgcacagaatggacaataatgggtactcagcagacccaggcagggcctgccttcttggctggctatttatttatttatttattagcttggatattcttctctcttgctgctgaaactgcctctaaaagcaaattccattcacatcttcgcttgatagatgcagtcagaatggcaggcgagaaagaactatcagagttcaaggagaatactaatgcctcttcatatatacaggcacattttcacatcatgtgaatattgtatgaagatgtcacaaattatatgttcacatgtacatatattatcattttcacatgaaaatgaaatatgtcttatctcacacaggagaaatgaaagtcaaatgcgtagtttgccatctactccattacttggggctttctataaaatgagctctctaaacctgtattttcaactgaataatctcaagaggtaacacaactgcatacttttttttcttttaccatccatgctgatacttgaatgaaatgattaataatttggctgtattttgaatattttctatatttcttttttctctctcattcatggaaattttcagaatattctcaaataaagaaagcatgctgaaaaaaagttacactagaatattgctccttctagccccatagaatttagcagagttttgcacataatagaaaagcaaaattttaaaaatggaagagtcatagtctcctaattgtattccttcattttacacaggagaaaatttaagcttatatatagtatatgactttgctaaaagtcaccttaatgtaaagtcacatattagagtgagcatccagctctcagtgttccagggcaggattatttctagtgcagttcttttttatttaaaaccgaaaacaaataaactaaaaaatcctaatggaacaataacaataaaaatgccttctctatgccttaaactcagataagtagacaaatattataccttaattatgataaaataaataaatgtaagaaaataatatgtgtgggatgggggtataaaatgatttatgtttctttaaaaatatgtgtggagttgatattcataatctgatatatggtgacttaacagaagaccaggtatcagtggcatgtgatacgcacatagtgtgctcagaacattttacatcttgtgcagaggaaggtagaaccattttgtttaaagaaaacccagaggattttagaaaattacctaaagactgctgagctgtcagcaaaaatttaaggcttccaggaaaagtctgtcatttatctgtaaaacacccatctaccactgcctgcagcataaaggacaaacttcttagcgttatccatgcaaccttcgttaatctttcccaacatgcccagttgcttttctccccaatcacttcaacagaacctatgctttagcagtcctcaagaacttttagttcctagaagataccattgcacatgtcattccttctgttggcaatatccttccaagacatcaatcatagatggttacagaagatattgcagagaatatgaagaattggaaacataatcaagtgcaaaatcagtaaacactattcaggagataagatgcagattgtgatccaagctttataattattttgtaggggaatcagcaaaaagcttgagaagtagatagtacaaggcagggagctattttttttaaaaaaaatccctccctgcctgtttgagtatcttctagttaacacatacatactagttgcagtcacataacatataatttaattttcataataaccctaagatataggggctaataagtcttttttgaagaccaggaagccaagtgtaaagcatcatacctagtaatcagcagaaccagacaccaaatcccagtcattgttgaaataattgtaaccttaaaaattatttaatgtttatcactgtattagtctgttctcatgctgctaataaagacatacccaagtctgggttatttataaaggaaagagttttaatggactcacagttctacatggctggggaggactcacaatcatggcagaaggcaaaggagaagcaaaggcacatcttacatggaggcaggcaagagagtgtgtgcaggggaactcccatttataaaaccatcagatcttatgagacttattcactaccacaagaacagtatgagataaactgccctcatgattcaatgttccacctgtccctgcccttgatatgtggggattattacaattaaaggtgagatttgggtggggacacagccaaaccgtatcaatcacatttttaaaacacaggtcatgcattcatgttaatacgtacaagtacttcaaaccttcttttcacagcaaatagttatttagttggtagagagttttatagaaaatttggctctgcatgcaaacagggcctcacagagtgacagcacacagacagttgttagaaaatcccagcatctgatccacagctttgcagattttatgattgaaattggtaataaaacaaaatggattagcctttgagactgatcaaggttattgacattcacaagtgtctgatatatacacttctgaattattcatttacatttacaattagaaatacaactatcaagcagaccagaaatgttatgggcattattctctacttgttctctttgtaggcaaatctacaaattacaatcagaactttgtttcatgaaaatggagttaagtcagtgataataggaagggcaactacaatgctccatgcattgtgctaagctgcatattgctaaactctatatttgcattattttatttagtttttataatgttattatgtgaatattttatagataaagaatgggagactcagagagtttaagtaatttgcctacatttacatagccaataaggattagagccagattttaaatctaaatttatttaacttcagagaaatagatcttaatcatgacccagtgctgcctaccaaacatgatataagctccttgaagtcagggagaatcataacaacattaacagctcccaatggaggagtgtctctcatatgccttacactttcattcatcctctatgactcactctaactctcatatcaaccctgttatatagatactcttatcatcattttacagaaaataagacagaagctcgaatatgaaatctaagcccatattgctgacaagtagcaagattagagagcacttaattcctgactttgaagcttgcagtcattctcttgctgtatgctataattccaagccaggcattctcatcagagggacaggtggagatcattgaatcataatcaaggttcattgttgtgaactttaaaatagttaataactatattcaaatattaactattttaaagttcaaagtttgaagaactctaaaatagtattatctattttaaaaaacctattaaagaaggaaaagtaccaggaaccctggaaaaattaatcttgttgccctgcaatcagagccagccaggaaaagaagcagtacacagagtcagaaacagctacatgtgaaaaatcacatagtattaactattttaaagttcataacaatccaatcagtgcaagtctataagtattcacatttcctagataggtaagcttagtgagaagttaaataatctgtccacagtctcacaactagcaagtggtgtccctgtaaaacagaccaggcagtctggctccaaagtcctacactctattgaatgatcttaataagaaatgacaactagttttatggcctgatgcattcaatttcattctagaaatatttatccatgggcaacagaatgtctccccaatacagagataagaaaaatgatgcaaagtaaatgtattcctaaagagcaagactatttttgtagttgtagttgttgttgttgttgtagaacatggtggggtacaatggagatgcttggaccaaagcttgactacctaccctaatttcagtcttgcctccttaagacttgatctctatcagtttgatggaatttgagtatgcataaaaaagatgtattgtggtcaacagaagcaatcaagaagggcagaaataaagcggagttgtgaagagctacatgtgcaagtcctgaaaatatcattgtgtctgggtgagattcaaaaagaaggagaacaaaaacagttccccaatgggatgtgctttagaaagccaggtgaggctgaagacatgactcaggcatccttgttgtaaaactggctttgaggtaacacatagtagtgagcgtggacttccatggttcatacataagaagattctgtggaaactagatattttaatcaattctaaacttaataggagagctgtcaccagatgtaacttctaccaaaagagaggaacctattaaagaaggaaaagtaccaggaaccctggaaaaattaatcatgtttccccgcagtcagagctagccaggaaaagtaacagtacacagaatcagaaacagctagatgtgaaaaatcacattacagaaagcttagagaaagaatggctaggagatcagataacaataaaatgaaaatgccacaaaagaaaagagaaactgtcaaaatggacttcagaccacacaatcacagatggtgctgataaagaagaaaatgggcatccaaagagatcagcacagcagcccaaggagctagcaataaatgtgagaacatggaaaatgatgaaagtagaggtatataagtaagaatgataatggaagaataatatagacacctaaaaaaattgacagtgagtttaaagcaagaatggagttgagaaaaattccaaaggtgttttaaaaatcatgcgtaatacaagaaagataataaaaagaggaaactctgctacttggggctgaggatgacatattaacaatggccaagggaaagcagtaggcactattttactccatttagcctcctccttagacagcaaagaagataatgttcacagtagcaagaaaatgagccccatgtataagagtaggcacctacaaactttgataacatccagtattattgtgaggacttgaaattgacattgttgaattatcgatggtttattcatgttattgaataaatgtacacacaagcacacacatgcacacacacacacacacacatatgccagacactgtattaagtaatttacaattattaacttattttatttttaaagcaactctacaaagttgatgatctttctaccattatggagaatagaaaatagatattaaatatgaggataacttttttcccaagatctacttgtccagtaacactaagccttttaaatgaggttctttggcataacttgttttcgttgaattcatgttgcatgaaagaatcttatttatttttcataatttcttataatttaaattgcactaatcagttgaataatcttatgctgtttagacattaaactgactaattattgagaaataaagattatgtcacagaagctaagaatgacagacttgtcaagctacagaaaggactaaatgtaagatgaaacaggaaagaagcaaatttttttgagggaaagaatcccataattctggtagaaaagattgagtgttccctgaggacaaagattatacattaccaatccctgtatcaccattatcgtatacagtgacagtgatttatagctcaaaaattaggacttttaaacacttaacgtgattttaaactacgctaaagtaggtataaagttcagattatttactcccctggggtggctcatccgtgtgtgtgtgtgtgtgtgtgtgtgtgtgtgtgtgtgtgtgtgtaatctttatgtatatgtaatatttatgtatatgtatatgtagtctttatgtatatgtaatatttatatatgaagatttatatatatattttataaataagatatatatatatatataatatatataaaatgttcaataaggcctgtaaagtgaccctagacatattgtgttgaagacctaaatgcctactagatatttttgcctggttgccccctgagtgtgtgaaactgagcttatttttaaatttcctccacaacttatttcttctagatattctacatttataaatcaggacaattattgtcattattattattatcatcaacatgtaaaaacctcaatgatttaatgcaagagaggtatatttcttgctcatgcttataaggctactctggggagagtgttttctcctctcctcaacattcttattcctggatccagactgtttccattacttactactgtggaacaaaccaccccaacacttggtggttttgacataacagtgctattatgacttcttatggttctgtgggaggaatgggctcagtgaggggggtttccactccatttgatgtctgctgggattgctgtcatctgacaccttggttgagctggattgtccaacattggtcacttgtgtgattggcagttaatactgaatgttgactgggggctccagtggggctgtctgctggacagccttcatggagtctgtttacgtggattgggtttctcacagcacagctgaagaatttgcagaggccatatctcaagagcaagtgttccaagagggaggaagtggaagatgccaatactctttaagactacacctgaaattggcacagcatcatttctgctatgtcctcttagttaagcaatcgatcttgtgattcacgaactggaaaaacaaactccacttctttatcaggagaagtaaaagaatgtgtggccacctttagtccatagactgaaaaaacagccactatctagaatttgcttgtaattttatcagtttaagaaagagagctctgcaggacctcgcatcagcaaaaaatatatttgccctgaaagtgacacattttacttcaactcacaattccttggccaaaattggtccaatacctacatgctaccacagaatgcaagaaagtatgatcctactacagatcttcagagaacagcaaaagaatgtaactccagtttgtctcttactctcaaaatccgctggtgccctcattaattattacccagaacatcacaaagactgacttgtctctcttcctctagctgagcttctttctaatttattttacaaacctgacccagaaagaaagaacactgtaaaatataaacattattgtttaaaaatcacataaaatcataaacatataaaacccgtataaatataaacttacctacttatcatctttcactaactcaccacatttgttgagcacctccaatgggtaagacactgtgctacttcttgccatcacaaattttacatttttaattttgtccctctgccattgttatcaagtatagaatacttaatatgattcataaagtatataaaaacaagggccctggcctagttctccagcttcattttaggataagcaattttatttcttgctgttcttgttaatttagcttagttcttttatgattatttttttctcaaagaataaatttttttttcaattattcattctactttaagaaccactaatttttggtgtctgcttttattaccatttgtttcatttatggaaaatgcttttatgatttttttctaagttactgaattgaatgcttacttcatgtatttttattctaactctcctaatcataaaggcatttataaaatgaattaaacagttatgaaaactttggctgcctctcatatttttatatgttgtagattcattctaattatgtacaaaattatttatagtagcattttattaaaacataacgtgtaaacaaaaaaagttgtacaagaaagacagaaatcactgaaattccatttctataactttgatacatattttttcatcagaatcagctatcttgttcatatttttgagtaatatggggtcaaacatttacattattttgcaattatttttatgtacaagcattttggaacagtttttatgacaacaaatatgtgtgtgctttgtgtgtctttttatttcttttatttctttataaggacaaatgactatttgtctctaaggtactaaggttgattttaattttttcactaatgaaaataatttggaatatctatatttaaattcttatatggcctgttttcaattttttttatgtttttatagctaggatttagggatcaaatgatatttaagtctgaaggtttttcatattaagtaatcattttccctcttacaggttataacaatttactctcccactaacaaaaaatgaaaatgtctcttttctcacctatcaaactatattatcctgctttttaatttttaccaaactgacaggttgaaaagtatgtacatttctttgattactaatgccactgattattttgccttagctaattatttatttcattatttatgcatatttttcttattaattcaagaggactccatgaattaaaaaataatttaattattaactccatgaattaaaaaatattctgtcatatatgttgaaaatatttattcccaattttttcatttttctttaaatttttcctatttttgggggaagttttgaatgttttatgttatcaaactattaattttcctttttatagtttctgctctggctgttatatttagaaaggtctttcttttggtttccaagtttattttatttatattgctacaaaatatttcattattttgcagcaatatagtttatattaaaatttatattgctacaaaatattgctacaaaatattttgttattttgcagcaatatagtttatattaaaatgtttttctttaaatatgtaaaggatcttgattatgtttgatgtaggtgtgaaataggaatccagctttattttatctgtcacaacttggttgttcaaaagtcactaattgagtaatccattccttcccacctttttgtataataaaaatttcattttgtgtttgtgctatatatattttgttttattgacctattttgatgcaaatcatataaagtttttactgcagaaactttgtgatatattctaattacaattttggtaaggtaaatccaatatatttttctttttcaaaatattattattcttttttattttaaaggagctttataattaatgatgtttacaaacaaagtctttaagatagtttcattggacttatcaaatttgtagatcaattttggagaaaaatggcatcttcaaagtatttcttcttctaatttagaaagaggacactaacctgggtattccagataggcaattatatcctcagtaagaaattatgtctttagttcctatattaaatgttttgtttttatcaagctttattagctattactttaaaaatattaattaacagtagcaaaaatgactcttttcttgttcctgattttaatgagaattgcttcagcataaaatgatcatttattttaaattggtacattttaataagttaagaaattgtacttctgtttttaagtactaattgttaaacaaataaacaaattgtatataccaaagagaacatagcatattggtaagcatccatggaacattgacctttatattagtaaatgaaataactgtaaatattctgaaattctgagcatgttagaaaatagataaatggggaaaattcacattatctgaccataatgcaataactctagaaactaataagagattttaaaaaagaaacaaaaaagtgctgataaaacatttaaataaaggtcttgaaattttaagaaaagattggattacattgtaccaaattctacttcagcatctacccagatttttcttctttgatctagtaatgaatcatatctggaacaaataagacttagttactacgttatttttaaaagtaatactgaattaagtctgctactactattaatacagttattttacataagggaggttaattttctgttttctgctatttttgtcaggttttgaagtctgtttttattggctgtatttaacaatgggaagaaagttaactgttgccatgataatgctgtgttctccatcactcaattagcagtttaagtaacaccatttattatttatcatgagtctatggttgatgggatgttctgctgaactggatcaggtttgactcacctcagctgggcttgctcatcatctgtggtcaactggcaagtcacctaagatagctgatctgggataccttcagctgagataattcatccctctttcaaatgtgtctctgacatccttctttccaacaggctagatcaggcacacatcctcacatgtcgtcaggggtccaataaagttaaaccatgcatgtgtcttttgaaacttgtttgcaattttttcattttttttttcatttgaaagtaatttttgtgagtacatagtaggtgtatatatttatggggtacatgagatgttttcatcacaggcatgcaatgtgaaatcagcacatcatggagaatgggatatcctttccctcaagcatttatcatttgagctacaaacaatccaatcacattcttagttattttaaaatatgcaatgaaattattattgattatattcaccctgttgtgttatcaaatagtaggtcttattcatttttttctgtagccattaaccatccccatctctagccacccgctactcttcccagcctctggtaaccatccttctctctctgtgactataagttcaattgttttgatttttagatcacaaataagtgagaacatgtgatgtttatctttctgcgcctggctcatttcattcaacataatgatctctgggcttggctatggtatttgcttagcaaatgaaacagtagctccaacatcatggatagcgctactgtttcatttgctaagcgaataccatagccaagcccagagtcagtaatgggaaggcagtaggcattacaaaagggcatagataaggaaggtgtaaaaaaaaaaaaaaaaaaaaaaaaaaaaaaaatggggtcaataatacaatcaagccaccatttgaagcatcacttcttttatattctctgcaatctcttaaataatataggaattatctgttccatattacctttgcaagtcttcttaaagtcttgacacgtaaatcttctttaaaaatagcttttaaaattcattaacagaatttcattcctagacatttcttaatgagacaacttctttatagctgcgataatattttatttctacagttgtttattttctactcttaactggtcttataagaaacttgttcattttaccaatgttttaaaagaatccgttcttggatttatttatattagtgttatgttcctttttttctaatgtattcatttcttccttttgccttttgcttttatgtattccattctctatcttgcgaaataatgtattctaacctttccagcttcttgaatggaatacttagttcatttattttaattttgttgtgctcaataatgatatttttaattacttgaatatttcatctgagatcaatttggctttaccccataggtctgatatgtagtgtcagtatttctattttctaaatatgtgagatatcctttttaaatgaatttatatggtgaaaatccttatttaaatattttatcagtagttttaaaaatatatatctgttattaatttctagtattgcattgtggtcagataatgtgaactttcctatttattttgtaacatgctcagaatttcaaaatatttacatgtgttttgttgcaaatataaggtcaatgtttcatcaatatttaagagcatgctatattctctttgggatatccaatttgttttataatttgtaattcaattatattatttatgatatttttcatatacttaatttttcacctgttatcagttatagatgattagtgccattttaaattttttttactccacatgcaattttgtctatattttttctgtacttctctttgtctatatttctttgtttttctttgtatttctaagattttcacattgtatatttgtgctgctttttttagtgtacaaagttttatcaaatgtacttttataacattttgcatattgaataatttttctccaaattctattttatctaatataaccattgctatactggcttcttttttcttttttcattacaataggtaacacttattgacatctatagtgggacatgcataattactaaatttttttacatgcaataattcatttagccctcaagagaaccttataaggtatgattatcatcccatttactgagggttacagttgagtgaagcagagggaatttatgtaagttgttcaaagtcacaaaactagtaagcaactgagctgaaatttgaacccaagctctctgtctccaaactgaggttttggcaactatagtctgttgcttctttataaatatgctgcttggtcttgtaagaagtaagctatttttctctcttgttaaatttgctcagtcttttcagggctgtatgaagtctacaaatgagcccatcaaaggctctttttaaatgttactgtgattattattattattattattattattattatttgtaggatttccatttgattctattagagcctatctctctgctgaaatttcctatctggtcatgcatgttgtccacctttttaatagagccttcactgtattaatcatgattctttaaaatatcctgtgttttgattccagcatatggattatatctgcatctagttcagtgattaatttatgtcctaatagtgggtgttattttcttgcttttttatgtgtcttataacatttgaatgaaagacagacactatgtaaggacagcagagactgaggtaaatagtattaatgtgtggaaacaggcatgcctctcctgctgctagtttttttttagattatattttattttaagttccaggaaacgtgcaggatgtgcaggttggttacataggtaaacgtgtgctatgcaggtttgctgcacctatcaacccatcacctaggtattaggccccatatgcattagctatttatcccgatgctttccttcccccttcccccaccccacaggccccagtgtgtgtttttattggagatgggctgttaaatcaatccagtcaacagtcaatcttgatttacactgctgttgcttgttacactcagtgcaccacaggtttccaatcttctagtgaaatcttatgcttaggttaggtgttgggtcactaaagagaatttgtaacttttctcgatactagattttcctgtgagcctgtgcctcagtgagtatattttttataccgttgcttctctctcaatggtagaatgccattacttgttattcacaccacttactagtctgcttgtgggtgtgtggggagttgttgccgggggacgggttgtggacagttcttaggcttaggcaggcagtgtgtccctggattggggatctggctttcttggtgatcctactcatcctcctcatggcagtcaaactttgtcttaaatgtttggcaggtctcatgcttgggggagattttaccccttttggaatggttgatttttttcttttaccctttacacagtttcattgagttttcacctgtttcctgagaaactatagcaaagctattaagctttgcttccccttccatagtgccttaaagcttttgttcaataagctatgtagggaagaaaaatctgggcaagggtttacccctttctcacaacagaaattgctcctcttctcaggcctgcaccactgagagaagttttctctgatctttcattctgcctccagtcttcgttgtaaacacatggtgaggtctgtgaaagatagcctgcaagttgggtggaaattgcctttgtgcctgtgaatcccagtagttctctactcttatgagtgtactcttacaccatatactatcatgcaagctctatactcatgcaagctcatacttggattaggcaatttattttaaaaattaaaatttccttacctgcagcggggcacggtggctcacacctgtgatcccagcactttgacaggctgaggcaggttgattgtttgaggccaggagttcgggatcagcctggccaacatggtgaaaccctatctctactaaaaatacaaaaattatctgggcatggtggtgcatgtctgtaatctcaggtactcaggaggctgaggcagaagaatcacttgataggagatgaaggttgcagtgagctgaaattgcaccactgcactccagcctggacgacagagtgagaccctgtctcaaacaaacaaacaaaaatttcttacctactttcatcaggacctcaatctcctttcatgctctactccagctgcatcagtacacatgtgcctctttgtccttggaggagcctgtctttccttacatttcaggctatgagatctacctgcaatcccagccctcgatgtggttaagaggagtgatgattttgtccattacagcttctttttttcttgttgagaaggaattaatgctctttccagacatctacatcctaagcaaagactggaaatctaatatataaaaatcaaactacctctgttaatgatatatgtgttttttttctaattaattcttgttttgttgttactgttgtgtgagtgcttgcatgcttatgttctctttcttgcaatgtatgtatttaccttcttttgtgacatagaacatatgaattttgtttttaatttctctagtgaatctgtttaagttgatttaacatgtacttaaattaatataccttaattatgaaaaacaatactacaacaatctgtttttctttgtgcatgaaaattaaggcacccctttacttcctcttcatatattctcttccaaaactatcataagagaaaatattagttaatagaaaatatatgtatatatagtcatccaaaatattatttttaggcctagcttcatatatgtaattgcttccaacttctcttccaatcattttatacttttatattctctattcttcagttctgtatttttattcatctcatagtcatctcagttaaattctcttgccaaagagtaagaaaaatatatatatgtgtgttgtattcattgtagtttgagaatgttttcctattgctttttctcatgaataacaatttggcattcttagttttttctttctaaaaatctgaagacatatatacattttcaactgacatctgctgctaaggagaaaaatactaaagctacgttttcataaaaatctgaaactagtgctatttttatttgtttgtaggtaatctgtttttgtgcttagacacatgtggaaaaatttttataactttggaattaaaaaataatcacaaggttaggtctaaaaataggcttttttaaaaaaatcaattttgcctgtgacttagtgagctcttttaatatataaactatcatacttgggttagaaaatttttcttccattatttctttgagtattgaatctattttcattgacctattatttttttctgaaaaatcttattttgtttttaaattatatttagagacaagagtcttgctctgtcactcagagtagagtgcagtggtgtaatcatagctcaccgtaacgttcaactcctgggctcaagcaatcctcccacctcagcctctaaaataactgggactaccacccagtcaaatgccaccacatttgactaatttttataaatgttttgtagagatagggttttgatatgttgcccaaactagtcttgaatttggggcctcgagtgatcctcccacctcaacctcccaaagccatgggattccaggtgtgagccactgtacctaaccctcttctggaaaatcttaaggccttagattgcattcctgtctttataggtcatatttctcattattctcttctttttgaccttttctttgcaacttgagagttttaaaagttcacttattgtgtaacttattcattagtcctgatatatcatttgcattctttactactcccaactgttatttttattctgcagtagaagtttgtctttattcttttttgttttcttttctcatattatctcatcttttatatcattaccttcctttcagcctattctctttgttggttctctactgatgtttcacctagattttcattgtttaaaggcattcatcagattatattgcaacatttttattgaatgcagccagaatttatgtgaggtatgtactacctctgagacttgagggtgatattctgatttgtttagggtgcaatgagtttttgtgtttgtttatgtttctataaaccatccaggcccaatctttatttttgtcaatagttaaagaaagtgaagcatcttttgcctcctctacaatccatttagttaagttcagtttttctttctcagacctagagttaaagatcaaatagatatgttcagcatttaatcaaatttaccatgcatagtaggtattccatgtataggtttttgacagagatttactaaagttatttggtctaattatgacagagcatttattccagacactgtcttgtttatactacttatcactcagtgactaaatcttccaaaacaaaaattattgtcatctcaccctctctacttccataaccttacggtggtttctgctttgagtagtagtctctggatatttgtgaaagagtgtaactgagaaggcagcaggtagtgaataagagaacaaagtctctggatactaataaagatagttctcatatagttcaggatagcttgctgcttacttggccataaagctcttacagcctaaagttaggcataatcaaaggaaatattgttgcgggaagtcagggaccccaaatggagggactggctgaagccatggcagaagaacatggattgtgaagatttcatggacatttattagttccccaaattaatacttttataatttcttatgcctgtctttactgcaatctctaaacataaattgtaaagatttcatggacactaaccacttccccaatcaatacccttgtgatttcctatgcctgtctttactttaatctcttaatcctgtcagctgaggaggatgtatattgcctcaggaccctgtaataattgcattaactgcacaaactgtacagcatgtgtgtttgagcaatatgaaatgtgggcaccttaaaaaaagaacaggataacagcaattgttcagggaataagagagataaccttaaactctgactgcctgtgagccgggtggaacagagccatatttctcttctttgaaaagcaaatgggagaaataatgctgaattctttttctcagcatggaacatccctgagaaagagaatgcgcacctggggataggtctctaaactggcacccctgggcatggtcatctcttatggtcgagactgcagaggtgagatagactccagtctcctatagcactcccaggcttattaggaagaggaaattcccgcctaataaattttggtcacactggttgatctctcaaaaccctgtctcctgataagatgttgtcaatgacaatggtgcctgaaacttcattagcaattttaatttcacctgggtcctgtggtcttgtgatcttgccctgcctccgcttgccttgtgatagtctattaccttgtaaagtacttgatgtctctgacccacacctattcacacactccctccccttttgaaaatccctaataaaaacttactggtttttgtggcttgtggggcatcatagaacctaccgacatgtgatgtctaccccggacgcccggctttaaaatttctctcttttgtactctgtccctttatttctcaagctggccgacgcttaaggaaaatagaaaagaacctacatgaatatcggggcaattccccgataaaatatattatatagggagactcaaagcatatttctaccttccctgtactaatttgaaaaagaatatatatggttgataaatatatatatatatttagaataagtattaagccccaatgttatgcatactcaaaggaattatacaacataaagagaatcaaagtatatttctactttccttggactaattcgtcctgttctggttgtaagtatgggatatgaaatacatagatgaaatgtatgcttttgaatctatccccaatctcaatttagttgtttcaaattatttgagaatttctcatttatctttctctaacttgaattatggagcctgtggctttatttttttttttttaagtttttttttttttggtcagttgttgaaatttttaaacagatatttggaggaggtgtatcagagccagctagttttaagtctcagactggtcactcttaaaataatcccacccagtcatgccatcatcaaatttagttgcctctctccttggcttaaatttaatacattttttccccaatctattggactctttagaaatgttttaaacaaaaatgactaatttattttttaaatgtaattaattttgttgattgaataagaatgtttaaaaatgaaacattattgtgaaaattaccacatccttggtttaaaatagcctgagaaaggaaagcacagccataagaaataaatatacgaataggttaatacagaggaaattgtgccagacaaagctggttgcttttttgatagctttacagccttagtaaatgaacagagtggagtagacataatgcatcttgacttctagcaaagtactggagacaatgtcgtgtgaaattttgattgcaaaattaatttgagttggcttgaaaaacactgttaaaggaaatataagctggttgaaaagacatacagagaagagtgttgattaatgtcagtgaactaatgagttgagtgatatctccagttaaatgtcacgattgtgagtgttggattgaattatttttgttatctgttgaaaaaataaataacatagggttgattaaattagagcagaaaatttatcaggagacaccagtgattacagaaaatctatataaagacatgaattcatttcagagaaaaaccagtgaaacaatataattttacttaaagagtccatttttttaatcacaaaatggaattctatgaagtatcaatgcttaaagaccttcaaactacagaatttctcaaaactaattggaaaacaaaattaactatctcagtaaggctagaacatcattttaatccagttagtagctacattttatcccaaccaataaagtgacagttaattcttacctagaggatgtggttaaatgtataattattatttaccagaaataaaaaaagtatctagaaaatcagtaacctctagaaactcttgggcacaggagagggagaaaactatggaaggggaagtaattatgttcttaactatgttacattcttaagttacattcttaactatggggatatagtaagactctaaataactaaagtttttttttattatactttaagttttagggtacatgtgcacaacatgcaggtttgttacatatgtatacatgtgctatgttggtgtactgcacccattaactcatcatttacattagatatatgtcctaatgctatctctccccactcccacctctccccacaacaggccccggtgtgtgatgttccccttcctgtgtccatgttatttttgaaatatccagattaaatgtagttaagtaaaacaataaactttttcaatgtaggttttttaatgctaatgaaaagctagtcagcatggggtaaattagattaaattagattaggtaaattggaataagaatcaaatgatcacaatcataaaatgggattagtcttactataagtcacacctgcaaaaggaagaagataacctggaaaaatttaaagagtcttccactttacgaagtcgtagtgagttggcaagttttaataatttaaaagaaaacgttgatttcatctaaaaagagagagagaaagttttagttattgattcaacatgtatttattgaataccttaaatgtgcactatttttggttttgtgagcagtcccaaacgattaaaacagagtgacttgttccctgactatcttaaattatcgcaaactgattggcttaaaacaacggaaatttattctctcacagttttggaggccaaaagttcacaagcaaggtatcagcagggctgcactccccctaaaggctttgggggagaatgattttgagcgtttcagcttctgttagctgtcagcattctttgatttgtggcaacatcactccaatctctgcctccatggccatgttgcctcctcttctgtctgacaaatctccctctaccatagtcttaaacaaacagttgtcattgggtttagtgcatattcatgtaatctagaacactctcccctctcaatacttaacataattatatctgcaaagatcctttttccaaataaagcaacgtttgtttccaaattttaggatttaatatctctgggtgaccatgatttaacctactacaaaagcattttctaacaagcagcttaaaataggtttcttttttctttgagacagggtcttgctctgttgtcaaggctggagtgcagtggacagtcatggctcactgcagcatcacactcccagtttcaagcgatctttccacctcagcctcccaagtagtttagaggacaggtgcatgccaccacacacagctaatatttcatttttttgtagagacagggtctctctgtgttgaccaggctggtctaaaactcctgagatctagcaatcctcctgccttggcctcccaaactgctgggattacaggtataagccactgtgccaggctcaaaattaggtttctattgctgcattaatatatacacagggccatctctttctcttctaattattttacaaatataaagagcatctgtaacacaatgaagctgttttccactttaggaaaagacagttttgaaaatgtgattaattatttgttgcaggttaggcttcatacagtcatattcccagtgcacattgtcctcaagatctccccagtttggcactgaagccttattgactctgtctctgaaagaggccttaaatgatcccccttccttctaatcctcactgaaattcccttaggttaagcccaatttatccaagggctatggtcttctacttgatgttctgtttttaatccttgatgctatccttctccttccatacaaacagtagatacacatattttcaaaacacagactttcttgtgttctctacttaaaaatctgtctagctttcagatacataaaggaaaagcaacctggttttaagagcatgcaatgcttcttcttaaatttccgatccctgtccttgtctgcagatttatcacttaacattcctctccttgcttcataatactacacacacagacatacacacacacaaacacacacaaacacacacacacaaacacacacaaacacgcacacacaggcacacacacacacgcacacacaaacacgcacacagagacacacacacacacgcacacacacacacacgcacacacagttccttgatattgcagtcacacagaattgttcactgtttcttgaaaataatcataaactgcatttgctcatgttattttttgagatcagagtgttcttccctcttttttctgctttaaggttttctctttttttgcacagctattaaaacttggccaactattatattttctctatagttttccctgatccttacacatcttcatagctccttacatgtaactctattactgtgtgcatcatatgcgatcgtgtttattttccctgtgtgatttgttttttagactatgaccaccttgaagacagaactgggtcttatctatctttacatctcctagttgtttgcatggttcttgacacatagcaaatgctcataaacttctgatgaactaaattactgtaaattaaagtcattgatacatttaaatggcacgatttacctatatctgttttataatcatagttaacaaattaagcaaaatacttctaggaccaggaactcaatatggagacactccattgtaagagagaaagatgcattgaatcgtttattcagaaagaacttattatgtcactgtaggcactgcacaaaggctaaaaatcccaaaatagaattgttaaaaaattagggtttaagattaaaggcaaaggaaatcatatttgttgagactattagggttgcttgaagtaaactaatgccaagtttaagtaaaaagattcctgctatatgatataattgttaagcctaagagaccagcaggcaccaggtacagttacattcagatgctcaagcaatgccattagggaactgcccatgtttagccattactgtgttctgttattccttttttttttgttttgttttccctctcaggcagattctactcatgtggtaacaagactattattctagatactgtactcatatttaacagtctcagggaaagagtgaagccttttactcaatcgttccagaaaatatctaatggatgaagggaaggctctaactggccttcgttggaccacttacatttctttgaaccaattactctggtcagaagatgaacatgtctgatctttcaggattagattcacatgcaaaataatgttacaattcaaactaggaaaaataaattatatatttttaagagactggatgaaaatactccatacatcacatgtgcttttctttttctgtatattggtatatacataatcactatttctttttttttttttttttttttttggagatggagtcttgctgtgttgcccaggctggagcgcagtggcatgatcttggctcactgcaacttccgcctccaaggttcaagtgattcttctgcctcagcctcctgagtagctgggattacaggcacccaccaccacacccggctaatttttgtattcttagtagagacggggttttaccatgttggccaggctggtctcaaactcttgacctcatgatctgccagcctcggcctcccaaagtgctgggattacaggcgtgagccactgcccctgacccaccactatttcttttgtaattaaaaagtacatatacactttatattttgatgtagatgtaagaatagcctctgcttcaaagacctcattataatagtattaaagacacacaagtaaacaaaggtaacaataaaatagtaatacatatcaaatattaagtatctcaggaataattattccttctaaggaatggcaaagaaatttttcacaccacaaagttaattttgaattgggtcttcaaggaacataacaatttgaaaagacagagaggactttccaggaaaatgtaactacatatgcacaaatgacagtagggattatagtaagaacacttttattattattctacctcttcactctattcaatttccctgactactacaatgtccccatgttggtttctcctttcttgtattccaagatattgtgtcctgcttttgcttattattctctaccccttaagcttctcattgcttcctccttcttttctcttttttctgggcctccctctttgtttttacgatccctgggaggactcatttaattgactcctaaatggtttctgtgtctctagtgtcttgtagacattagaggcacagaaaccatttttcactgtctattttccactcggcatccaaactaattttccataaacattgcttccatcatggatatgtgctttaatagcattggaatcagacagatcttaagcacaatacaatagtatatataccagataccagttatatgactgtgagaagatagtaacttctgagagtctcactactaatgcccaacttgtaagataattatgaaaatatgtacaacatatgtatcactctcagcagtgctagccactagatagatgtgcaatatataagtagataatacttttgtgggtatctatattactcctttgcccataaccaacagtgaaccatcatgttcctttttaagcttggtggtggatacaggtgttcactttaaaagtctcagtctcagatttcaagtcttcaacccatctcctaagctgtcagaggcctttacaatctttacctacctcctttattcagtcttatttcctatcatttccccacaggaactatttgctggccctttaatttctcccttacctcagaacttgctaatatttatcactcttaaatatatgtttttgcttgtgctgttcctcaaactagaatttttctgccatcttttgttatcctctctcttcttttagtttaaataccttctgttctctaagttttttttttccaggacaacctagaaaaaaatatctctttagtttctacagtggcagaaggtaatgtgatttaccaatttaattacttcatattacaatatagtgaccatttatatcagtgtatagtacaaatatgtatactgtggtcttactactgattatcttattcttatttattgcctctccaacaagatgttatcacccatagacaagaatcatattttatatatctttataacccaaagtgcctttttaaaattaatgtatcatgtttgttttcctggaacaggaactgaaatagagagtatgaattcatttgtaactgaatctttgctgtaatagttatccccagcatccttgctaatacagagaatgaagccttaatacctaaagcagccactgtatgtgattaattaacttctctcctatgcatcttgacaggtagtggctatgtgccattcttgggagaactgggaaaatggtcactgaaatcatttttgttgtttctagttccaatgagaaatgccagccgggaaaggctgctacagtatgtagcaaggtgcttttgctgaaataataaaagtatttgcaaggaaatacttgaaataagtgctaaatttccaaagattgatctacactacagaaggcttattagggtatattgatactagtatgtgttgtcttaagtggtacattgtagtttccatgccaattcttggtttaaaacgcagcatgcatctgttatatgccactttccacttaaatgcctaagacaggtagattgcactgtcaagttaggtcattataactccaacagatgttgtcatgtagatgaagaaaattcattttaaatgatatcatttataaaatgtgtttttctttgtacctaaaaaaggcaataatatgtcatattagctcttcagattcaggttgcaatcagtatggcatgttttgattaaacacttcacaatttcaaaatcagtgcaggataatgatggagcacatgtgaggaaacagcaatagcaggggtgtttacagtatcccagttgtttcaagcttaataacacttcatgttatcaatcagttacaaaggaataattggtggataggctgaggaaatggtacagtaagaaattgtacttattctaaactatagggatggaagtgcagccaggtcaatacttatttggttagtatattgtaactaatcatttgagttttgccagctggtatcttatttttgcttatttgtttaaccgcttttaaataagtatataattttaacaatttaagtcagttgaaatcccccccatagagctctcctccaaatgcatccctagctacattcttctttctggagattaaccagaaattggtggtttcatcctgtttatatgaatacattcctagaagataaaatcatattgtagatatttgtgacaaaattttcctcacaactatatgaaagagaacgaaggaaggtgtgtggttaggagttagctgtcattaaaagtgtgtaaattttgcacgttccctacatttattttccagtaaattttactagtttctttctaatcagttgggactaaagtcaatcgacctgtctctgcttctttcaatttcatttcccaaaagaattttagtgcttctctattattcttaactctgccttgccccaatacattaatcaatgctttgggtaacaacattagatttgtacagggaaggaccagggaatggcattccaaagcaacacatggaaagggcaagagctgaatttcataaaccgtaacctaatccatcactgcagctttccgttgcctctacccagactgcagccaaacatactctaagctgccactttagagtatctttaccctccatgggagtttttctttttttccctttttttttttttttttgagacagaatctcactctatcgcccaggctgaagtgcagtacaggatcttgtctcgctgcaagctctgcctcccgggttcaagtgattctcctgcctcagcctcccgagtagctgggattacaggcactcaccaccacgcccggctaatttttgtatttttagtagagatggggtttcaccatgttggccaggctggtcttgaactcctgacctcataatctgcccacttcattttcccaaagtgctgggattacaggtgtgagccaccgcgcctggccaggagtttttcactgtgatgttgtgtaggtctctggaatgtatgtttccctctgcagtttccccagtgttgattttaagggaggaagccagagcacttgctatttcaccatcacacttgtttgaagtgtgagttaccatgcaatgtttaaaacatgagttacacctttttggaggatgctgtagaataccgatttattttttgtgtgaaaacaaactctacctcaggttaatcaaataattactgaagaaaaggtttttctttattcaaatatttcagcacatgaatgaagaagaaatggtaaaagtaaaacatgaacatttggccatcactaattatattagtttgtagaggctactgtaacaaaattccacagaccaagtggctgaaacgacaaaaatttgactgggagttcaaaagcaaggtgccagtggattgggttttccctgaggcctctctcttcagcttgcagatggccaacttttccctgtgtcctaacatggtcttctttgcacccgatggctctctttatggtctaatctcctcttcctgtaactacaacagtctgattagttttgggcccacccatatgatctcacttaaccataattatcttctttaaagaccctatcttcaaatgcattgtgaggtactgggggttagggcgtcaacacctaaatttggggaaacacaattcagctcattaaatgaatggaagtcatacctgaaatcaatgacggatcgtatgactacaaaaaaaggagacaaacattatacacctgctgtttaaagtatacaacacaaaattattgacaaatattaagctgaattaggtcaatcttctagatttaccaatttgcaaataatgcaatccacagagcaagatgtggatatgggggattcagacagcacaatctagctcgggaaactacagaaaaaaaaaatgacccattttgtgacatataattgaaggaacaaatgaagatagatgaatggagaacccataaataaagcaattcaagatacacatgaactcataaaacataggtcctaatttgagtaaagaaagaaaattttaatactgactggttatttgatgacactgagaaactattctaactgtgcagctatgaaaaggaatgagatcatgtccttttcagggacgtggatgaagctggaagccattatcctcagcaaactaacacagaaacagaaaaccaaatgccacatgttctcacttataagtgggagctgaacaacgagaacacatggacacagaaaggggaacaacacacactggggccttccccggggtggagtgcagagagggagagcattaggaaaaataactaatgcatactgggcttaatacctgggtgatgggttgataagtgcagcaaaacacctttgcacacatttacctttgtaacaaacctgcacatcctgcacatgtacctgcacatgaactaaaaataaaaataaattattctaaatcttgggaagtatgataatggtgtcatgattatgttttaaaggacttcttaacttttagagatatataccagaatagaaataatattgtataatgtctgccatttgtttcaaatcaaatctgaccaaagtaggggcaagaaagagtaggcgcataaataaataactcattgataatgagttgataattgtttcagtaggatgatgaatatttgagtttataattttattctatttatatatttgaaaatttttatactgaaaagttgaaaaagctttatattggtattttaaactttgtaaatgttcactaaaagaagatatgtctttttagttgttttgcctgagttatgatgagctttgatgagtcaatcaggctgcctcttgagttttccttgtaaggttaattgggtgcactggagagctagctgaggttaggagagcaggctctggttgaaggacagggtttcggcttggcagactaactaccttctctgattattaaactttgatgccacccacattagcacagtattctagtcacctgtgataacctgtccagaagttgctctgatcgtgttcagctcaataagtttagacttcacacaatagtgcttgtcattttttaccctcttgtaccaaatatatttcaaaatatgtccaatccagctgttaatttgactgaataaaatattataataacacttctgaggattgagatgatgtttgaagtttttcaagagtcttttccctctggattagagaacatctctgccagaatcaaaatgagtctcaaaattgacagtttttactttacttgctacagtaacctggcattttaaaaagcattctggaaaaaaaaaatgaatcttctgattgtgtaataaaagaataagaatagaaactaagataaaatgattctacatgtatatcttgacttatgtctatattttataatttcaacttttacgtcaaaaaattgtaaaatgtcactaattttataaggtttaatttaacagatcaaagctcataggactttgttgaaaacaatgaatgcaaatcctcagtacagttccaggtgtgtcatgagccctccaaaaatgatagttacaatgactgtttcaaaaaatttataccttcaacaaaactttaatcctatttttatatgcctgtctgctctgaaaataatttaatatgtttaaattcctagaataaatcttactttaaccaaattaataattcttaaacttaaatttagatttcaatgaatccccaaaatggtttccacataaagtaatgcagctaatatcagcactgctaacagattacacagaaaggtctattataatgattgagtaaatattcctgggaaatcaaccttgttaaatctatatcctataaggaaaggtgcatatctgttttttctagtaaagattccgtaattgttattacaagttaatcagcttctcccaggttcatttactctggattttattaatttattacaggaaattattgggtaagtaaaccacaattataataaaatctcatacattttattatatggttcacaaactttataaacacctgtgatgggattctgctattgatatttaagtggatatttattaaggaactagagatacttctcagtaagattagcttagagaacggtcctgtttttgatctcttaagattccaaatttttattccaaattttctgatattgcccaagtgtcttttctgaatctatgtctttattatttggcttaaaacctttgtgcatctggtgctctattctgctgtgactttggagaaaggttacagtttgtttttgctgggaggaataacttcttgaatgatgtcccaactgaaaattatttttttggttggatagaacatccctgtacaaaacttcctctattatcccttggataattcctgctgtatatagaggtccaagattgattaatgattttatcttcagtaacctgtgatctaaattaccattggcaagacaagagtgatacctgtttttttattctctacattaataaaacatgccttaagaaatctatatacttcatatagaggatatgatttgccactaagcaaactctatgaaaaagaattgtgttttcatagtaaggctttattataaaccaaatatgaccaactttcagctaaactgtattatctaatcaagtttattccgtcactttacttgctattatcaataagacaagtaatatatttaaatatagaataagtaacaagcaacatgttaactgaattaatatattggtaaaatatagattttaaaagttttttgaaaatatttgaggagggttgcacttttgctccctctgattttactacgtatgtctctgactgtatgtaatcacacctagcttatgctgtcccttccattctctacacttgactttagaaagtcaaacgtagactggagcaaaaaggggagagatcttttcctaccatttagcagattaaaaggtagattggaaatgcatctcagtatctcagccataaatgtctaagggataataatcccgctacatatttattaaactaattacaacatattgcgcaaaataaaatactttgaatcagaatgacttatgaatggtcgattgcatacaaaagtgctggagatatggtgataaaaagatgattcagccatcacaaagctcaaaattctactgggagaaacaggtaaagtgactgaagcccaggataatatttcaaataataagtacagtgagatacttatttgagagatgcaaactcaacaacagtttggtaagtactttctctattctaatttgaatacattctagtcaattgagatacacaaagcatcaattctccccattggatttggatcccataaaactacccatttccccaaatagatagtgttttaacttaacagacctcataaaaagcttgacactaaaatgagaatttataaattgtgatctgtagtaagttaaatggtgcccaaccctgcgaaaaacaaaaagtatgtccatgaactaatccctggaacatgtaaatgtgatcaaatagggaaaagatatctttgcagatataattgtaaagaatttcaagatgagatcgttatggaatatctgagtgggctccaaatctaatggcaagtatctttattagagaaagacatacggggatttaaaacagaaaaggaagaggagacagccatgtgaaaatggagacagagattgaagttatgcagccacaggtcaaagaatgcttggaaccaagagaagctggaaaagacaatgaaagattttcccctagagcctttggatagagccctgcaaatactttgatttcatatctgtcctctggaacttggagagaataattttttgatgtttaagcagatgactttggggcagtttgttatggcagccattgaaagcaagtcgtgatctagtttgccttattttccaaagcatagataattttcaatttcaattaggaaaattgaaattccacaaaatgcaagtgcatacagaaatgtctatctgagttgcagttgggaaacattttgcatttaaaaaggaaaagttttaagatataaaagaaagtcttgagaaaacaagagaatatccctcatatatgtacaacttcttactaatagaagccttagatgtctgatcaatttcagaggcaaaggctaccattgactgttcattgaccattgacaagccatgtgtttcaatgatgaaataccacataacaaaatactctaaagcatattgtcttaaaacaactgttttattactaaggttcctgcggatctgatattcaggcaggattcagtggggatagcttacctctgttctacatggcgctcactgggatagttcaattagggtaagaggattgaagatggtatcatttgcatgtctggggctttggtcctggctgttggctgaggtgctttagttacccttttctctccacatagcctctaattactcaatattctaccccagcctttaaaaaaaattttattgtggtaaaatacacatataaaatataccatcttaaacattttaagtgtacagttcaatgataataagtacatttatattcctttgcatccatcatcacccatctattttcaaaactcctttcatcatgcaaaactgaaactctatacttagtaaacaatgattccccatttccctctctgtccagcccgtggcaactgctattctttctgtttctatgattttgaccatttcaagaaacttatgttaagtggaatcataaggtatttgttattttgtgactgattcatttcacttagcataatgtcctcaaggttcatccatgttgtagtatttctatcctttgtaaggctgactgataaggagagacttacttctgtcatttaaaaacttgttttctatatggcttatagcatttttgtcccttgcttcctgcgtgactgtcttcttttgtgtttagttgattattgtaatgaaatgtttatgtatctatgtcattgacttttgtatattttctatagctattacatttaacatcctacagttataacactcttatttagatttatgccagtttaactccaataatacacaaaactctctcttttacatttccatacccacttcttttggttgctgatgtcctaaaactacacctttacacattgcaggtccaaaaacaaaaactaataatttttaaatatatcagtttcttgaattaaaccattgttacaataatagtagcttttataattgtccatatacttacctttactgtgatatttatttcttcatatatgacttcaaattattgtatagtgtatttttatttccatcttcagaactcacattaacgtttcttccagacaagtctagtgttaacaaactcctctcaacttttgtatacctagaaatgccttaatgtctcccttagtttgaaggaaatttttgccagatataggattcttgcttgacaggtttattttctcttagcactttgtatatattggcccatttctttatggtttccaaaatttctgataagatatatgcttataattttatcaaaaatcccttgtatgtgattaatcacttctcttttgatgtttttgatattctcttttttgtcttcatcatttcaaaggttgataatgtggatctctgagctcattgtatttagagtttactgagcttcttaaatgtttatattcatattctttgttatatttgggagttttggccattatggcttcaaatatcctctcttcttttctctgtcttcttatggactccataatgcatctgtttgtccacttgatggtgtaccaatggttccttattctctgttcacttttctttaatcttttttctttctgttccttggattgataattcccatggtcttctctttacatttgctgagtctttcttctggctgcttaaatctacctttgaaaatctctggcaaatttttttcatttcacttgtactttttagctacaaaatttctttctacttttaagttttctatctctttatggacgtttataatttattcatgtattatttcttgatttcctctacttttcttttagttctttgagcatctttattacagttgttttattacagttgtccagtaggtcccccatcatgtctttttcagtgacagtttctgttggcttattttattttatttttaaatgagccattctttcctgtttctttggatgccttataatttttttttgttgaaaattagacatgtgactgtagtaatgtagtaactccggcaatcagattgtacttatttctcctaggttttcctaggagaaatttcctaggttttccccttttgttctaaatgttgtagactagactgtctctgtgcaaaggatcaatctgagatgtacgtaaatttaaggtcttctcaagtctcttttgagcctgcacctttccctgggcatacacagcaactttctaatttcccgtgtgtatgtggttgcttttaaatgtcttagtatttaatgtctacctccaaaaagaggaaaagagaaaaatgaaggtggcaagcaggcactggccatttaaatcccctggaaattacttcagccagaggggtaggggtgtgcaacaatggaggggaggtgcaacaacagtgactacctagcccttcgtctacaagtccgtgattagaagcagcagtaagcaatcagagcacagatctccaatatttggattataacattccttttgcccatgctggcttttgtgaactgcatgtaagttgctcctgaaacatattcatggctgcctgccattggactaagggtcaggataggtagctgctactgttttaagagcttaaattgatcaaaagtaaccataattttccttataagctttccactggaagtttcaagccttcaatagactccagaactccagaatatttatatcagatagattctgccagtgcagttgttgcctacatggggagacagatttctggtgctttctattttgccagcttcccaaaatcttcctttctaatcttgtttctctccttgaaagctggggagaaccagctgtaattctaatttttgttgttagtggactatggctgtgagaaatgtcctctggatggggatgccactaccccctacacagctcacatctcactcacaactttggttttcccctgctctggaccagcctttttttatttctttatttctttttcacttgattggcttccaaaaatgagaagagaaaacctgtgagatctcttaagattcatgccaccaaatcatatgtcatcacttctgccacattttactggagaaaactcacagagcaaactcagattcaagaaaaggggctgtcttagaccttttgagcttctataataaaataccttagtttgggtaattcataaatagtagtaatttatttctcagagttctagaggctgagaagtcaaggcatcagcagattcaatacctggtgaaggcttgctctctgcttcgtagacggcacatcttgcagaaggggtgaacagtatcctcacatggccaaaggggaaggcaacttccttcagttcattttataagggagctaatcctattcatgagggaagaaccctcgtgaattaatcaccttcttaaatctttaatacaattgagttccaacatatgaattttggagcgcaacaatattagggaagtggactccatctcttgaaagaagaatggtatgtgtgcacagggataggaggaattatctgtggccatcttgcaggcagactaccacacagtgctctgctttttcttatcattttctttgatgacatctgatcctttctcacaaatatctcctttgtaaaacactcagcacttattatttatatcagtcatttgggaattagtcatatgctgcctagtggaatttgttgtcattaaaaattttttcctgttttgtcatttcaaaaacaatcacaaactcttggaggttaaagatgatgttctatatttccttgtaccccgtaaaaccagcatagtaggtatttaataaataactgtcttcttaattataaattttaagtggtgggagaatgatgtatttacactaatgcacggtggttgtattattatccactagattgtttcttgctgcatatcatgcactgcattatttcttgctgcatatcaatcacttagtactgacctcctttttaaaatacgcctgactttctcatgcttatcttacatatatggttatagctaagagttgtgaatggacacagatatgggaagcatatttaggaggattaacaaaagagtaattagaagaacacataaatccacaaggaaaaaatgactctttttgaagtatgctagcattttcaacatgcctgttgagttaatgatttatgggagtttcaattgtttaaatgtttggaatactctgcaataaaataaaaattctcttcaaagttgataaaaatactcagaggcatacttcctcatctgatgattcatagttaccaatgaaacccaagaactccatgcacattttcagcaagagcaaggcatctgatagcaagagagctggaaaggaagaatcatacagtgacctagacaagtgtcatgtcggtcttagcatcagataaactgattgcaatggttgattgtactatctctagcgagagtaatttagaaaacctgaataagaaaccctctcttgttcatcatagggatgactcttggtgtgaacccaatcatattaaacaattgtagaatcaccaagctagacattttatgagactaactgatttattcctcatcttgaaataaaacctgcatgccacaaaactcctctatgctgctgagacttagttctttctttgagaaaaataagagccatttattcatgcaataaattttcattgtgtgtgaattgtatactaggcctgttccatgtgcttgccatacgtcagtgaatagaagaggcaaagatctttgcctatggaacttgcagtctagtaggggacataagttatttcgtaagcttcccctttataaatatcattaatccttactaataataatacttacatcaatgtttatatattttacattggttttctgataatataaaaaaaaattcacaaaataaacccaaccactaataagctgtgagttttgagtgtagaattcttttcattaacaaaccatttcattttcagatcgagaaactaaggtttttaaaaaactgattttactgaaaataaaatctaaccacccatcctaatgttctttacttctttatctgtctttcaaaaatatcttcctttctctatgttgagttagatatgtattcacaaaatctaccatactgtccatatatgttagatataaatttttgagctcatgtgaaagaaaccaagtttgaatagttgaagcaaaacagaagggtttattattaaaaaaaaaatgtgttttctcaaggaccccaaaacacaaagctgaacttgagaagtgagcgctcaaaactattaaggctgtctgcatgacccttgctctaattcctctctgaaatagtgtctcattgattgaggtaaaaaatgacagcagtttctagagctacactgcctgtgttcaaatcctagctatgtcatttgttagctgagtagcctggaacaggtaaattaatccctctaattctcaatttccacatctgttaaaattagcataattataatcatatcaggataattctgacaggattatagcaaaaaaagattaaataatatctaatgactggcacaatacctgcctcataaatataagtcttcagtaaatataaaccaccattattaaataggagatgttaagaattgagctgagctggggagggctgagctgccagatgtgggagtattcagtaagacaacaagccaaaatgaaagtaacgattaagcttttattccacttactgtgatagtataatcaagagtccagaaagaaagtgccagcttcacctgtgtttcattttccctacaaatggcaccacgcaagggtcagatgcattagtacagttttggataactgtcttactgctcagggaaccccaaacaaaaagttcctatggttttatggacctaagggcaggagaagaagcaaggggaagatctaggaatgggaaagtaccaagtactaagtcagaatggagaaaagtgtcctccagggtacccactcctcccaacaagcaggtcttggcagaggctcctggaaaggttcatctcagagtccccagtaaagaagcctctgaatggaggctcctgggctaagaatgcaaatatgtataaaacatggctggccaggggtcctaagtccttgactgcaactcccgtcagacactgcagcacattgtctgtgcaagtcagtttggggagggaagctttcctctgtgaaggcctcccaggcaaagcctttgtattgcctagggcagggcaaaatcatacagaggtttttgacttggagctggattccttgagaggatttctaggagaaatcctcccaaaagtttcaacagtttatatttcatttgtatgttggtggttctctttcaagtgagatataatatagatgaaaagtatctaacatagattaggtattactcttattattactatagctatggttgcttgtatataactgttcagattatagctccaataaaacaacttattttattctctccagagttaggtaatatcattattcctcatactgaaggcttttgaaaaatgttccttggtctttactatacagagtttaacctttctgctctcaggaagaaagacagttggaaattcaccatctaaatttaaaagggggaaaaatctcagctgatagctggtaacacagtgttggctatgtattgagatacttacttaaagcatcatataagaaatgatgtacaggccaggcgcggtggctgatgcttgtaatcccagcactttgggaggccaaggtgggtggatcacctgaggtcaggagtttgagaccagcctggccaacacagtggaaccccatctctactaaaaatacaaaaattagccaggtatggtggtgtgtgcctgtaatcccaactactcggcaggctgaggcaagagaatcgcttgaacctgggaggccgaggccgaagtgagccgagataatgccactgcactccagtctgggcaacagagcaagactctgtctcaaaaaaaaaaaaaaaaagaaagaaatgatgtacaatcactttaatgtgtattaaggttcttgtttaaaaatcatctaaatttgtttagtatccaataaaaattgaagtctcactttgtgccaataattatgtatttaataaatgggaagaggaaacaaaacagtaatttttcttgaacacgtggaaatttatagataattgctgcaataaatattatcatacaaaatatatatttaaaaaacttaactacaatattactgtaaaagagaggaacatgattctatattacagtgatatgaggtagcctggggtgggggcaggagatcaaggagagtttaccccaaactacaggtgtttatattgagatctaaaggatgaggaaaaattactttactaattcattaaagaattgcaggtgtcttaagattgttccagtcaaggaaaactgtatattcaaaaccactgattctcacatttggctctactttggaatcatcttcataactttacacaatactgatgcctagatttcatgcccagattctgatttcattggcatggggtgtggctttggtgtcgggatctttttttataactcccctagcggttctgataagctttagtcagtgctttagaaacaatgtttaaattttcaaggtaggagggttatgccttactcaagaaaccgtaggaagactcatatgatttgaattcaaagaatgagagggaaggcattatgacatgaattgatgaatataaataataacaaatcatgcaaattctggtaggccacatccaaagtttggcctttatcttgagaatactggaaaactatggaaagactttaagcagatgttataatctcagaatttatgtttgcaaagaaagactgtaaagagaagctatgaaattagcttcggctaggatggtaggaaggaacgagttaaatagattcaggagacatttttaaagaggtgaaattggcagagctgggcaaaggattggatctgagaggtggtgagactgacagcttgatttttggctagtgggactgagctgatagtagggatagatagtgagcttaatcttagagatatctgagctccctttgaggtatctaagcagagacagtgaagtgatagtgaaatataaggagattgctgagcttgagatttttattgtttaggagtaaagatctaaattgcaatagagatgctttacactaaccttgtcagtttcataaaaattactttactggtacaaaacatggtaaaaggcactgtaatagacagaaaaatgattcagatggtacccatgaccttaagtggttaattatttaatggaggagataggaaagacagtgagaatttaatgtgattttaaaatgaacatcttaaaatgtctcaaggtagaatggaatagaagagaagaaaatccagcaacttttatcaggttgtaataattaaatgctaaaatattattagaaaaaataataatattgtgatctgatagaaaaggaaagctaatagaatttgagggaggggaatgaccccgaagaatcatgaaaactctcagggatacaacatcatattaggacacggtgtctagttggaaacattttggtttttcattcagcttgaactggagaaccaaaaagaaagaagaataaagaggacagcaggagttttaaatcatggatttgtttattcaaatctgccatgtaccaatacaacaatactatgataagagctaggagtacaactgtggacaaggtagtcatcattctggcacatagtttataggttcatatcatatttattataaaaaatagtttacttgagacaatatccctagttagctttcacaaaggaaaccagtcaaaataatgactttattaaaagaggttaagtagccattctatgagtttgcattccctgtgtgttgaagcaagtttttttttttcttttttttttctttttttgagacagtcttgctctgttgcctaggctggagtgcagtggcaccctcggctcacggcaacctccatctcccaggttcaagcaattctcccgcctcagccccccaagtagctgggattacaggcatgtgccaccacacctggctgatttttgtatttttagtagagacggggtttcaccatgttggccaggctggtcttgaactcctgaccttaggtgatctacccgccttggcctcccaaagtgttgggactacaggcgtgagccaccgcacccagcctgaagcaagttttagggcagtggttttcaaccttggctatacattggaattacctggaaaggcttttaaactactgatgccttggttatactcctggggattctgacttaattgtcctggggtttggatggagcatcagaattttttaaagctttccattctaatagtcaacaaaatattctaatagtcaacaaaagttgaaagccacagttttaagggcatgttttatcactcagactactaagtcacccgaaaaatgagactgagcaaggaacaaaagaattctgattatataggaaaaataataacaaacatttctttagtctcagtgtgtcatgaacacttctaaacacttaacatattttaaatcagttagtggtcccaaaaactgtatgaggaagtcacttttactattcgcatttgagagatgagaaaactgaaacccaacagcacacgcaaagtaagtgttagaacaggtacttgaactcaatcagtcttcttctagagcttcttatctgaactggtatgctatattgcctctaaatgtagtgtaatggtaattttataccagaagaattataaaagaaaggaaaacctataaaaataggatatcattaaatcagttaaatgctagttgataatagagtgattattatgactgcataaaacatctatgggttatacatatgtgtatatagacatatatatgtatatatttattcaaatatgtctatatatagatatatgtatacatatttgtatatatatgtgtgtgtatatatatgctggttctcatgttttcttcatttgtaggaatcagttaacaagttcttgttacatagtatgaaggttctgttttcagtagtgaaacagggagataaaagtggttgaaccatgtgattttttttctgacttttcaaagacattttctcctgaaggaagctcaagtgctaaggctattccacataatctcaagaacgactactactttatagtaatgaccaaactgtagtaatagaatcttaggagcatataatcatcctctagggaacacattttacaaattgaacctatcttgcaggtggaaataccataaagaaaattatcattggagagattactggcacactgcattcattcacatgtcaaagtggaaaacattccaatttacttctataaaacatgtatctgagtcaacctgccatatgtattttttacactttctatccccttacagaatatctaccaaataaatgctgcacatttctaagtggctggcttttaagctgctttgcctatggctttttgttccctctttttctcagctgagaaatcaagtaaacaaaacattgtggctggtagcataggtcctcagtgcagtggatattttgtgtccggcagctggagcattggtcgtacagatgggcttcatttgttccatatgaatacaagttaataaatggagagaattccatttggtattcaattaagatctcccctgactcctgttattaaagcctacaaactattgagcataaaattaaaatcgagcagttcagctctttttgacattataacactgcctgaaaaataatgtaaaacccaagagtcacaagtcattccttacagcccatggcaaataagaagtggaaacattgaggaagaaagagtaaatatttaaaacttgatcattagtacacatgttaggagcaggctactgtgctcatgcaaatacatcaatccagtttgttgaacacaagatattacattaattttaacagaatgttacaagattattattgccaaagctccaatgaaggaaataattaaagcactaggcattttaaggtcttaaaatgacagaaaatactataggaaatcaataaccagaaaatactatagaaaatcaatatactgtaattgaaaggaaattgaattgggtttactttttttatcccgtctaaattttcttcagattgccagaccactgaagatagtgaatcttgttttgccatcagcagtgtgactttctctaagtctcatgtgctgcaagggccatctttattgttttttatttaggaagcactcagctgaatagacagtatgagattttgtgtgtgtgttctctttactagtcttggactcattgttaaaaaaaacagaaacaaaatcaaagacacagcagacaaaaacaaccacctccacataaccagagaagtcaaattaatgagaattcagacatcgaaaccagaggacttgttagataagcctcacacttgaacctaagtgaaattcttctagtttttatcaaacactatgcctgtcattcttgctatgcaataagaaacattaccagttgcagatacaaattcaatttgaatctatatgaatctaactcattttcattgcttattattttaaaaagttattataatcaaacaaaaaagcttgaaatgaacctcagggaggtaagtggatatgaacagaaattaaagaatgttaaaatgagaaatccagactgggtgctgtggcttaaacctataatcccagcattttgggaggctgaggtgggagaatcccttgagcccaggagtataaaacaaaacacttaacaattctgagtctcaatgtcgttgactataaagtagaaatatcttcccttcctaccttaaatagatcacatttatgaaaaagattcataagttataaaacaacacctcaatgaaaaatgctgtatctggactttaaaaagaagtgaattaaatactaattttacctcttagtatatatgtgatcttaatgaagtccttagttttcttgtctgttaaataataatggtaagggcaccttctcatatggtcattgtgaagcttacatgtataaaaagctcagtaccatggctgacacatagaaagtatttaacagtgttcaaaaacataatcaatataggaaataagtattattttatttccttaataatttcttagttataccccattatcatatgtgataagagaatgtactttatttctagttttccagataatctgtatcctaaacattctttactcccaaattcagtctttgagcatcctaactcttgacatccacagctaatatttaggaaacattaaaatttgtttgtacatttgaaggaagaactaagtaaatggaacttaccaatcctaaaatccagactgctgttattaagaagaagaacaactgtacaaatgctgttatcaaaggatgtatgagtcaggcggaaaaaaaaggagaacacagaaaggtgaaaagtctttgtcaagcagaggagagaaattattgtcttgtaatatatatgagagagtctagccaaatattaaacatttttaaaatgaaaagaaatattatacatggtatgaataatatttaagtcattgcctaggttagaagattagatatatttacctattctacctacttcaaatgcttttttgctgtcattgtttggaacctccaaatactagaatgctttagaattataaaaccattgaccatgttcagttatgtttaaaagaaaacatcattctgaggaaactggaaattatatatttataaatgtttgtccatagcattgttgaaacaaatggctcaggtttcactgttaatccagttgctgatatttttgactactcaatacaccaaaatggtacagtcaagttggtgctaatagatgtcatttatttacacaaactgacaataggttcaccaaagttaagagacgaatttaagggggacagaaaagaaattcctgtgtgtgctttggcagcttagacatacttaccacgaacaagattatatcttaaaagctattcgttaagcttaaaattaagttatatggttgtaatatgtggagaaagcacattggaatagctcttcacttaatgttatagatcactttttccaccaatattatttggtctaggaaagtaaaatcctcttgaggaagtaattagaaaaagcacacatcagggaatgtaattgaagatagacttttgttgacctcagaagagaaaagctcaaaagaaatttcgtaaagttttaaatatggcaagaggaccacaatgtctttgataattagactttcaacacatttggatttgctaattggatctaagttctaattaggctttttatgtaactaagaatgacatatcattgtatgaatttaatgtgcttttacagttgaaactaacaattagcagccttttccaaattattttaataaggaaaaagctggctctgctgtttatactgtgacattcccttctcttaagatatattatgtacattttcattttcttaattaaacaccttttggggagcttaaagggaaacttgggttttaataggaagcacctaaattgtttatttgtgggggagacttgccagccagtatgtagatgactttggaagctacagacaaaccgcaataaaaagaaataaatcacaatcatcaggaggaaacagcacaaataaccatttgcccctatgaccattcagttaatcaaaacagtctctgaatatgatgaaagatctgttacatttttaagtgtgcacatgcggaatatgttcccaaatgtgaaggctcatggatctgctttcaggatgaataataggaaatttcttctcaagatgtgcattacaacattctctctctctgtagccttgttctgtaaacagttatctgctaattcaagtcaaatcatctctttctttctccatatttttgattgagagtcatcaatttttatcccattcagatatatagacagtaatttaaaaactggtagccctcagatttgtacattccaagagataagacctatataacagcataaaattaaactactatttgggtgagtaaagagcagtgagtcattgcaagactttaagggaaaggctgctgccaaaatattccaagcaaattgataacactgccaaaaaggcaaattatattgttttatgtgctatgaatactttgaaaacaaagacatacacatgatttttttcaaataaaagcagttgcccttctaaccatattaaaaatagtgtcttttttcccagtaaaagccatataagatcaaattaaaaccattgaaactattagagaatctaacttacagtaattgatatattaaaaaagacattatgttagagttatatgtgctattatttttccaattagtacattactgggactgagtgattggtgtatacataagtcctcattaagtaaaatgtcctcaatgagcctcctaaagcacattgggtactgtcatgtgccatataatgatatttaagagcaagaaatggcatatctaataacttcatttcctatttaaaaagaaaacctgtgcagtactctttccataccaattattctaagagctatcacatagttctccataaagactatacagaggtgatgggactgttcttcaggcagaaaaatgaccaaagttgtcttatctttcagcttggttgctggaatcctgtcacaggtctgaatgggtcactgactgacaagaaattggagaataacatgcgtggagtggttctacgtgtagtaactgttctggtaagtattatctgagcctcgtggttttgacttttggaggttactttatcctatatttctttctttattaactgatgacataatcttaaaagagattttaacaaattctaaatacgctttctaagattttttaatggtcatatttcacagccttcaatttacgtggatcaggatcacagttttgcagacttttaactacagtgtatgtgttaggaattttcttagaaattttaggctcaatttccatcctacagttttctacacatgacaaagtaaaggtatgtctcaggccttctttcattaaaactgtagtgaacatagatagtcaacatatagtgaacattgaaactataaatgaacataaccctgaccatgccaaacaatggtagatttggtaaaatgtacattctctaatagtgaaatattaacaaactaagaatctttttctcgtaagaacctacttcaaagggaagctgttgtttaataggcatctactgtcgactgtattccaggctcagtgctgattactgagaacattgacaaataaaatgacagatataattctgtcttgatagaacttatcatctagtgattctgtgaatgttgaataggattacagtagtttccctttatctgtgggggatgcattccaagacccccagtggatgcctgaaactgtggatagttttgttttcttccaacacaatcacattgtgtagggcttataggttatagagtgtggatatgctggacaaagggatgagtcacatccagggcatgtcagtgggatggtgtgagatttcatcatgctacttagaacaatgttaaattcaaaacttataaattgtttatttctggaagttttcatttaatattttttggaccatggctgattgaggagtaaccgaaactggtgaaagagcaaccatggataagaagagtctactgtatacctgggaaagatctgttacaatttcatttacttattaaaaagtcaataaatggtaactgttataattctatacattatagttttctttcctaatagatacatacaataagatgttaatagaaatattcttaaacagtaaaatactcaaatgggctctgtctaaatagccataaaccacgaaggcatacattctcctttgctattccaatgtgtttaatcatgtgctagtttatagcctgtttcaaaacgtaatagtccatagttagtactttatttttcttcagaaaagtctacttgtttttaattttgaaaaagattttcctatgggctaggtaaattgcagaattagtaaataggagaggaagactttttgatacgttgatgctaattggatgttcatcaaattttataacaccagttgctgccctttgtacattgtttactacaaattaaatatatgcaatgtaattttattgtcaaaaaagtggatttgtgcatattttctatgaaaggacattcaagtgagtgacctattcttctttttttgtggcccataaattattcctagttattatttttaaaagggcttaattgcttttggtaaataattgtaagtatttcacaacttaaatgtgaattcgcttctgtatgtacctaagggtattgatatgcatttacattgatgcactaatattaaaaaagacagatatttaaagtacagcaaattattaatagtctttcctccagtgattagcatgaaaactccagtgatgattgcagtgaaagacggtatatgtgctttgttttcctttgagaaaagaaagcaaatctttaagtccaattaacctcagtcagttttaagcaaatagttatttcgcaattactatatgatagactcagtaatggatataagagaaataatatacagaccttgtcctcaaagtattcatagaatcttgttaggttgatgcacatagagaaaaacagctcagattgattaaatatggttgacccttggtgtctgtgaggcattggttccaggaaacccccacaccaaaatctgcaaattcttaagtttctgatataaaatgatatagtatttgcatataacctatgtacctcctctcatatgctttaaagcattttagattactcttaatacctaatacagtgtaaatgctatgtaagtagtggctctaccgaattatatatttatttttgttatttttattgggtttttttcctaatatttttgagcctcagtttgttgaatctatggagttgagtctagatgcagaacctgtggatatggagtgttaactgtacttactatgtgcaagctactctactaagtcttttgcatgtattgtcttattttgtcctcacaatattctcaagaaataggtaatattctgatctcaagaggaaactgagacatccagaagttgaaatacatacatgtatgtgtgtgtgtatatatatatatatatatcttatcattaagggaaggggttaaggtctagaatcagacttcctgaatttgaatcctaactctgctacttactatctgtataatgttcataaatacatgaacctagaagaaattgaagaataacatgcaaggagcgattctacgtgtggtaactgctctggtaagtattacctgagccttgtggttttacagacagtaagtagcagagttaggattcaaattcaggaagacagattctagacgttaaccccttccctcttaatgatacattatactgtctccagtcctactgtgataagtgtgagaactgaggtgtctatagaattttgtttgacttgagagttgaaaatgcttacgtctgaataaggtgaaagtgagttttattgggaaggattgtaggtacaatcatgttaaattcatttccaggctgaataaaacaattgctattttgttcatgaaatagtagcacttcacacagtgttaacacctgcataccccaggttcaccttcatgactcttaataatctctatttcctgcaagcttagccctgcacagatattgaatatggttttgtgactggagacatggaagcagtgtttttttttttttttttcaagtcttctatgatggacttatcagttgggtgccagttgagtaacaggttgttatacttattacattactacaatatacaatcattgtgtttaataattttgcatgcttcctatgtctttctgtaactactctgagaatggaaaccagtcattcccttcttatttattttctacaagtgccttttcaggtctagctcttagttatatggccttgcaagcttcttctactcaacactgagaaccactctcccctcaccccacccagcaactcccgaatcttgaggctttacctcactaaaccctgaaactaggatttaatctatactcaacttgatgttgtcacctaaacgcaacctcccacccccttatattccaagtatttacgtccaacactttccagaagagaaaagggaaaggaccaatgtgtacatgggaagaagctatttcctcctttcttctattgaaactgaaatctagtcttagctctacccactccctcttttcttaagaaattttatattatcaattacaccaggttaataaaatggatttttcttaccaaaattttgaaattcccattcttatgactgttgatattttattgacttgaaagaaataacttcatatttattttaaactacacaattcagcactctactgtttgtgatcccatgggcaaataagtggtgctctcaaacatttcattgaagagttaaatagaggtattattgacgaagatgtaaatagtgttaaaggaatcaacaaggagtgttgaatcaccagaacctacctagatgacttacatgaagactgataaggcatgggaggaagcattattactagacaaagcaatagagccatgggagagagaccatcactcatagtagtagtgagctacagtgcagaaaaagaaagagaatcactgccaataccaaaatcaggctatgaggaactgggaataagggatacactgatctcactcctcttatctatctcttttcatggtctccaactgcaaatccaaccagaagtcagaggttatgggagcctaagtaaggaagaccatgaaagttagtctttcaggacacagaggaaggcagtgaagccctcagtgaatccagaagaaaagtagagaaaaaccaacacgagcatctaccatttgataggacctattataagaaggttatatatattaacttatttaatccttataaaatttcatatgagtggcactaattacattataaggataaaaatagggtacataagagttaactaaatttctgcctccatatagctagcaggagccagacataaatttcaagatcagagatcctggttccacaaaccatgtccttagccactctgataatcttccttctgaatcagaatggactcatgttaggtataaatgaaatttgatataattattgagatgtgaggattgcatatgttggattgataacttaggagaattttcctaaatttcttcatatatagatttctttgtattcaaccatcaccaaagccacagaaatatgtcttagaaatggaggaaaagaaagaatgataataaaagcagtctctactacttggtgtctcttctaatctctttgtttccataatttgcccactgatctttacttcttaccaagtggtccaagtgtattactacaaaggaattatgaagattttcccgtttttaacttcctgagttatgcaatgtagatagcaataaatgaccaattaagtcattcaattgttttcatggtaattcatgaaaacactattggaaacattactgagttataaacataatcataatatatatgataataaaatggaaaggaattggttacaaattaaaagaaaggcgtgcgaagctatgctgcaacaagtataagatatctgagaaccataaattggcatttgggaggagctcactgattagtaattcttatttacctactttgattggccttaaaaaagacatatacattcctaataaacatacattcactcatgaattcacacaaaacagtcaaagatcctgactttagagagtttttttgttgtttgtttttattgagacaggctctcactccttcacccaggctggagtacagtggcatgatcatggctcactggagcttcaaactcctgggctcaagaaatcctcccacctcagcctcctgagtagctgggactacaggtgcatgccaccgtgcctgactaatttatttttcgtagagacaggggctcgctatgttgcccaagctggtcttgaactcctggcctcaagtaatcctcccaaagtattgggattacaggtatgagccaccgcacccatccagggagtttgattcttgcaagatatcttctaaagctctcaaaatagtcttgaaaaactgcagtgcagttgttctccattaaatacacaatagagcatttttttgcctagaattaccataaaaataattcaatatataaattgaattcatatataaatatatgactggaagtctatagtaaagactgtgatagtgatttttctgcattttataaattaaaaaacatagtttttcatattttaatctctctaaaattaggatgcatccttcaacttctatttgcaattgtaattagcaccatgtttgtctttattagtgatgtgtaaaatagttgcacatcttacaataggaaacattttagattaaataatgtatggtatttttacaaattaagttaatggatattcctggaaagttaagttaaacgtcactgggcaagaagccacataaagagaataactattttaaagaatacctccaaaagaaaaggcagtaggaaatataccaattagaaaacataggacagtaatagcaatgagaaaaattactgtctaaattaaaactgttgcctcaatcatagaaggatatacacagaaataggaaatacacagagatagcttatcttgaatcattaccacaaagcaatatccaaaatatctattgagagaatggtaggtttttctaagcaactcaccaaaggaaggattgtttgcctggctgcagcagacagccacctactgagttatcattttgagtaatttctttttcctaaaaaatatccatcattagtctcactttttggaatttctttttttttttttatggagattgtgactgatatatgggcaccagagtcttaatttgtacaaaaacaaaaaaaaagtatttaggttagatttagttatttatatacatcagcatgaagtaaagcaatgtacttaatttcctcttaatataccttttaacaaaggaataaataatatataattcattttttattcaaagtacttcacacaattttgttgcctttatttcaccaagtctcctctatttaatacacctatgctaagaagctttggcacacactgcaaaaagcactcaacttgcagtcaaaaggtatgacttttagtatcgtactagtttttctgcttaattgatctttgaatttatggaaaccaagacgctgttctgaacttcaatttttccatctgtaaaacaggaataataaaaccaatcacaaagggttactactatattaactggatgaaactatgtgaaagcaggtagcaaaatgaacagtgcttctacatacattatctctgcagtaaaactatgatgtgtaaactcagtaaagaaaaaaaagcatgagtgatcataaaagtctaattattcattgtcatcaaacttcagatttttgtgggagattggaggactctaagggagacaaacaaatgtaaactgcagaataatgagttttaggccccgtcactgttacctcaatttgaaaacctgctaatgaggaccacaggaactcttctgccagtgaagctggtacttcctagaggaaaaatgcacaaaaaacacctaccaccgaaaacaaaagcaccctgaattatgattttcaaaaatatctagaagtttatatatcaattatattatctcatataaactgtgtttgattccaggctagctttaaatagactctatattttaatatataactaaacaaatgcctccagtgatagttctgaaacgtcattgtccttaaattttttgctaaggacattgtccaagtgtttgctacttagagactttcagaattttcatcgctacctcaaagttcaagcttttctgaggtcccagcgtttgagcctcttgaacctggaggcaaggttaggggttgggaaagtaaacttgtcaagagactctactgggcaagccctcacagcaaggagttgggaagagagctgacagcaagctctggtggctcccacagcaatgtcttacgagggctccttcggaggagttaataaataataaagtttggttcaggactccaggcaagaatgacaactctggctgaggaaatttccaggggctgatatctaaaataaacttaaagtcacaataaaatatgataagtgccatgtaataatcctacaatggaaatacacaggatagcattgtggttaagaacacagttcccacagtttcacttctggggtggcaaatgaggagttccatggacccactccccagcaaaataagcagagatgtcaaaaatgaaaaagaaatgaacaaaaaacaacactaacaaaaaagtttacattctctggaaataattgcaaatcatatatctcataagtgatatttagcatatacaaaaatattataactcagtatgaagaaatataaacaaaattaaaaaaaattaaaatgggcaaagatctgaacagttctgcaatgaagatatatttatataaatggtcagtaagcaaatgaagagatgctcagcatagttttccatcaaggaaatgcaaatcaaaaccacaatgagctatgactacaagcccactaggatggctatattcaaaatgacagataataacaaatgttggcaaggatgttgaaaaatcagaatgctgatacattgctggtaggaatgtaaaatggtacgactccttcagaaaacagtctagcagttcctcaaatggttaaaagtagagtcactacatgattacaaattccactgtatatataatcccaagagaaatgaaaacatatgtccatatgaaaacttgtactcaaatgctcatagcagcatggttgattgcagccaaaaatggaaacaacccaaaggtctatcaactggtgaatggatacataaaatgtagtataccataaaatggaatattatttggcaatagaatgaaattacatgttgataacagtgtgcagcatggatgaaccttgaaagcatgctaagggaaagaagccagacacagaggatcatgtattatatgaattcatttctgtgaaatgttcagaatagacaaatctatagggactcacaggggcaaaaagtaattcgtgattgcctaggtctgggaaagttttggagattggcagatgacagctaacaagagtggcatttttgagggggagctggtaataaagttctaaaactgactgcaatgatgattgcacatatttgcgaatatactaaagctattggattgtgcactttggatgggtgaattgtatattatgtaaattatatctgaataaagctactttttaaaaaagagagagtctggttccccagactgcctatgtttaaatccccacctctcctacctgtgaatgtaggccaggtatttaaactctatgattctgtttcttcatctgtacaatggagataatataaattacctacctcataaagctgttataaaaattcaaataactagtacatgcaaagaacaaagaccttctaacagaacctggcacatgaaaagtgtgatatgtgtccattcttcttatgcacagactgttaagggagagcatgaaagaagtatccaacttatgggtaaggcagtcggcaaggcttaaaggatgatatttaaattcatcttgaaagatgagcagggattatcaaggaatagataagagggaagggatatccagcattagaaagagtatatgcggaagtatgtagatatgatattctatcaagaatttaaagtatcctaaaagtaaattcaaatattttctgaagtatatgaaattgaaatacagaaaattccagcaacctatgtgtcatgtcttctcttttttaagagttcctttagagacaattcagtaagaaatttctctgtgactatgaaggtaatattgtatgatgtaaataatattcaccaagttaaaaataacattgctacaactctgatccagtgtaaagtttaggtaaaatagtactcatttttattattgaaacagtgtaatcagtagacatagctctgtgttgtgtacatattttgttttgtctcttcttctgagtgtactcatcttaggtgaatggggaaaatatgatttttataaacagactcttaaagaaaaatggcctatgcaaatgatgtaatttagagcaaccatagtatatgtgttcacttcagcgctcactaaataaaatcaccataagaattgatgcatgacaatggcttgacaatttcttattcttttgtatcacaccaattcttgaaatgatagctgttgcacagacatgtgtgagtattgctattgtatatgtggtagccatgcatgaccctacttttctcctcttggaagctggaacctgaattcttagactaatcaatgagtaaatatttcagagatgtgttatctaatttacttctgaaaaacagatctactacttgtctctagacatttagaaagagattgacagagtcatttgcaaattcaaagatataaaaacagtaggtagattgacttccataatcaaatcaatatttggttagaacatttcacaatattctaaccgaaattacatgaactacattatatactttcagaaatgcagtgtaccactccatctgaacaaaaacataatgttaaggtgtccttgaagctttaagtcatcttttggcaatgcagtagtttcaacataatcacaagacaaaaccagttccacataaaattcttcagaaatgaacatgaatataaataaaaacttgagagatgctactgaaatagattttacatttcagagttacaaaggaacacattagtagctattaaagcttacagataacattaccatctagcttactaataaatctcattgttagtattttctctagtctttactgaacctttaagattattaatttttttcatattttattgatatggctaggatagagttattaaataacttcttcaagttacaaatatgctaaaaataagcattgaatccttatctatctaatttactcccagccatgatgattctaacaaggactggcctaatttcctgccacaaaaggctataaaactgagccaagtatggaaaaaccttttcagacattagtcaattggtagaaatggactttgatacctaaaaggttggaaacaactaaatgatcccaacaattatcccagctttcttgctgctggcagtttccatactggagacatgaaagtatggatccaaaacagaacttgtcagcctcactgagtttacgaagtagagatcagagggtgagaaagctgatgtggttggcgcatattatctcatttttgagatatgttgtaaattagagggagctgagcaggaaaatatttacagaaatgtgaatcttgcctgagtactagaccatcaatgctagagagaaattctacaagtgtgggcaaagaatgacaggaatcagaacaatcgccagagctcacacatgatttttgagaaaggtttcatttggggagatcgtattgtatcaagaattcaaaagaaaatgtagaaagtatgtatttatctttgagttgtgtagtgatcgatagaaatttaggtgaatatctaaatatctatatagatataaagtaggatactcccacacaccttgctatttctgtgttttacatatttccctgacctcccaaaatgtccagttttttgttaggaagctgcacgctcatcttccccttctgagctccaagagcatgttgatgttcttgctgtttcatagctgatataaattagcattgggtaaacgacgaaaaaacgtcacagaaagtttttcttgttcacattttggaaatcttccttctcagtagagaaaagcaaccttaaagttgcaacatcatgattggatttcagttcacaaaagaaaataaattttgacaaatcacatatgcttttcctgtccctcccaaaatgctgcagtcttccatggcagccttaccaaagaaaaaactaagtccctaactggaacttggattctttcaaaggcacagtaagaggttttgaccaatagagaagcattgatcaaatcactatccactgcattacatggtactctaggagagtctgaaatgagaatagatatcttcaaaaagcatccaaatctggggctggtttactcatctgtcagcttctggaatagtgaacatgctattaaaattcagctccttctgggaggtgggaagataatcaaggggagacccaccatactgcatggaagtcccagaaatggaaaagctgatcaaaggaaggaaggtaatatacttttttataatatgttccttgggatttttaatgatcggtcgaaatacagaggttttggttttaaggtgttattttcacagcatctccaggtaaacttccaagtattatgttagcctggatagaaacaaaaaagtccataatgcttgaaactgaatatgtgatccttgcatcatgtttaaaattgttcagcaaggaatttcagtttctctaggtgatggaagttagcacgagcaaaggaactttacaatttttcagaattttttttttttcatgtttggaaggtctcctcctcctcctcctccttctcctcctcctcctcctcctcctcctcctcctcgtcctcctcctcctcctcctcatcctcctcgtcctcctcctcgtcctcctcctcttcctcctcctccttctcctcctcctcctcctcctccacctcctgcttctccttctcctccttcttcttcatttttatttttaaccattgctagtggtatgatttttgaattgggaaaacaaaatattcagactaaatattttcccaatgattcttatgtagagtaatgtactttgcaattcaattaaaaataacaagctaggatggtgttctgagccaaatgtaatctccaagaccatggtcagtaaagtactcaagaaaaaagtattgaggccgagtagtctgaagtctactggggaataaagaagcagctgattagcatttgaaagcaaggtctttcactgttttaaaagtgaaggagaattttttaacagaacactcatcaaaaacaaagcgtttgaaaattacccctcctttgttttatcagtctcagggaagatgcacttcgatacacgtctcaggaattaagatgcatttcgatacatgtaatattacatttggtgacactgctggaacatatgctgagaaatgcaagaataaataggactaatgctcattttctttttttttttaatcacttgcaagtgacatttgtttcatctaggcaggaaagcaggatcttataggcagggtaggtgtaagggctgattttaggtcaagcttttcaatttattatgcaataaaatatagcaataaaaatatgcatctttatattttccagtaaattataggaatctccgtttaattttttatatatgtgctaataattaattcagtactacagtctggatccacagtccttttgataagagctggcacagaggtcatttttatgtgccttattattaatcttaataatatgtagtaatattcctttatatgcttattgtgacacacagaaacttaaagcctttgtagctttaagttcagatgtctccacattcttttgtaaatccctgcagatttgtttcttgcttttaaatatcagcacctttctgctgtctactcttaggtctctgccctctatgcaggagatcttttcttttaagtttcccaccgtgcttcataataaaatcaaaagaaaaaggtacatccctcagaaagcattcatctcactagaaatagaaaacctgtcaccttattcttaaaaccttagatcagccaggccagtggctgaaatagtgagggtagtgtctacaaagggtatagagtaggggtagcaaaataattatgtaccttgttctctccacatcttttagggaagagactctttgctctggaaaatgacttaataccattgggaggaaaacatttcctctacccacttaggttcctatgtttaggggcctgtgaattaactgataatagacagattaacaggagaaaagaaaaggttaatctacacatgcatgtgaagtcactcaataatgagtcgtttcctgaatacccagaggtaaagattggtatagcaacttaaaaaagggaagggaagtgtggctagggcatcaatgtgtagttgatctccttcctgggattagcagaaagctcttggaggagagttaatagcagctgtattgggggtagtgtcagctttagttaggtaagggaaagtcagatcagatttcaaatattttcactttaatctttatgctaaaactgtgattccttcaatatgctgatgaaagttgaagtgtggcttggaaaaaaagagaaagtataagtagatttattctagatataaagcattttttaggtatagtagaaagagagaaagagaaagcaacaggcacacacacactgagagagagattttgacacgaccatgtcaaagactaagagtaccccaagttctttatcaaccatgtagtttctgcaacctgcagtatacacacatgcatacccatatactgatggaggcagtctaaattaatggttaagaatatgaacttcagcaccagagggcattggattcaaatttcaatctttcttactagctttgtaacttcaaacttttttcctcttggaagctggaaactgcatttttagattaaacaatgagtaaatatttcagagatgtgttatacagtttacttctgaaaacagatttattacttgtctctagaagtttagagagagatcgacagagtcatttgcaaattcaaagatataaaaaacaggtagactgactaccataatcaaatcaatattggtttagaaaatttcacaatattctaactcaagttatgtgaactatattatatacttttacattatttatctaccctcaagtttcagttctctcctttgcaaatgacaataacaataccaaaaaataaaaaaactaaatgaggtaatgaacgtaaagtgataaggatgatgacaggcataaagtaagctttttattgtttttatttgctttttcctgtagcctgaaaatatgttcaaggtaaaaaaaagcattcttttgctctgaatctcctttattctaccaattcttttctcgtgtaagtgtctcagactcttcagttgtcttcactttgtcatttatttttatcctcaaatcattgatatttggcttctattttcacttctccaaacaaattgcttttttgtcttcatgatcttctacgtgacaaattaaatgcatgctttcagaccttaccttcctggacctctcacctccattggaatccactggcaatttactcccagaagccctgtcctctcttgcatcttcaacatcttctgattctgacctctctattcctttgtttatttgtttgtttgtttgagacagagtttcactcttgttgccccaactggagagcaatggcatgatctaggctcactgcaacctccatctcctgggttcaagtgattctcctgcctcagtctcccaagtagctgggattacaggcatgcgccaacatgcctggctaattttgtatttttagtagagacagggttttgccatgttggtcaggctgatctcgaactcctgacctcaggtgatcctcccgccttggcctcccaaagtgctgggataacaggcgtgagccacagtgcccggcctctctattccttttacctccttcattggattctcttcttccagagtttcatccctggccttcactatactttattgaatgacttcatttactttctagaaagttataaacaaatttttatttccaaccctagcctctctctcctgcttcagactcattatccacgagtactattgaaaaaagtattctatatttaatgacaaaaaaacagaaaatatggaaaacaaaaattaacagcaaaatcataaataattcttccatcaaaagttacttgctaatattttagtgtctaccactagctaaacttaactacatttccttatctataaaatttgaggtaattgaggtcccaaactcataaaactattgagcatgaatacacaaaaagtttttaaagtacccagcacatactaagttccatatgaatatttgctgctattatttttttcaatttcaaacatgtacacacatgtttcaaattcaaaaatgtagctttgtacattttcttcccatttagcaatatgcaaatgagtatttttaattgaatagatttttttttttttgagacggagtcttactctatcactctgtcacataggctggagtgcaatgccgtggtcctagctcactgcaacctccgcctcccgggttcaagcgattctcccgcctcagcctccagagtagctgggactacaggtgcatgccactacacctggctaatttttgtagttttagtagagacgagtttcactatgttgtccaggctggtcttgaactcctgacctcgtgatctgcctgcctcggcctcccaaagtgctgggattacaggcatgagccaccgtgaccagctgtgaatagatatttttaacagatgtgatcagtagattttttcagccacttagtgaataatttctacagctgcctcaaatgtctattaatttatctagggttgtatgtaattcccagccttctaactgttgacagttttatttctcattccctgaactatgttgaaatgcaaattaatgtctttacagagatatttttgaatctctctattaaaaaaaaaaaaagaaaaaagaaaaaaacaaaccaatcccgaacttcaaaatgctattcttggttttttaaaaaatgacctatagtccaactctgtgtagataattatgtgacagggcattgagacactgaagttgacagcccaatgtgctgtgctgtgtcatacagatagacttaaaaaaaaaaagccccaggctgggttctgtggctcatgcctataactccagcatttggggatcacttgaggtcaagactttgagacaagcctgggcagcatagtaagacccatcccccccccccaaaaaaaaataccaggcataacagtgtgtgcctgtattcccagctactcaagagtttgaagcaggattgcttgagcccaggaggttgaggatgtaatgagccgtgattgtgccattgcacttcaacctgggcaagataacaagaccccatatcttaaagcaaaacaaaacccatctctgattgtagcgtatttaggttgttttcaacttcttcctagataacttgcaatgaacgttttaaaaatatatacttgtgcacatttatgctcatttatgattatttagatgtacaattattagatgagataatataaaaaatttacagcctttcacttttatttttctttttcttttattttactttaagttccaggatacatgtgtagaatgcgcaggtttgttacataggtatacatgtgccatgttagtttgctgcacctaccaacccgtcatctagggtttaagcaccacatgcattaggtatttgtcttaatgctctccctccccttgcctaccccactaacaggccccagtgtgtgatgttcccctccctgtgtccatgtgttcccattgttcaactcccacttatgagtgagaacatgaagtgtttggttgtctgttcatttgttagtttgctgagaatgatggcttccagcttcatccatgtccctgcaaaggacatgatctcattctttgctatggctgcacagtattccacgatgtgtaagtgccacattttctttattcagtatatcattgatgggcatttgggttggttccaagtctttgctattgtaaatagtgctgcagtaaacatctgtgtgtatgtgtctttatagtagaatgatttataatcctatgggtaaatacccagtaatgagattgctgggtcaaatggtatttctggttctagatccttgaggaatcgccacactgccttccacaatggttgaactaatttacactcccaccaacagtgtaaaagcgttcctatttcttcacagccttgccagcatctgctgtttcccagctttttagtaatcaccattctgactggtgtgagataatatctcattgtggttttgattcgcattgctctaatgatcagtgaatgttgagcttcttttcatatgtttattggtcacatatatgttttctttatagaagtgtctgttcatatcctttgcccacttttttatggggttgaggctttcacttttttattgtgaatttgttttctggaaaacttttaccaattttaattcacataagtagtgcatgagaaagtctactttctcacatgcttgctgataaatgttaacattcatttttatccttgccagtcagataagcaataaattaaatagttcttgttattttaatttgtattccccaaaggtatgttaagagagcaaaacaataaataattcaccctcaatggttgctgttaaactttgtctttttaaaatttaagctttaaagattatgactttaattattttttcttctcataaataatatttctcttctaaataattctaagtcacaattatgtagggataaaaaagaaagtatacattttaatgctttcctccattaaatttgaatgtgtgttaattttgtattcagtgctgcaggtttttacagaatactgtctttggttccatattgaacattcaccttgaggactttagtctattgattgaaagctttagttcatctaatagaattattatgacacatactccaactaaaaatcagtcaaggacagtcccagaagttaatactcttccaaagactgatgcctccactgagcacctctaggaagtatgagatggtgttgcatcacttctcactaagttcttataaccccacatccaatatatcaacaaatttcatcagctctaccttcaaaaattacctagaatccaattatgtcttattaaatccattttactgccaagtcacttctgatttattgcaaaaggctcctaattgatctcccagcttcttcacttgcctcttccagtctattgtcaatagtaactgtcaactgtctagtaaactgtgaaaatatatctgatcatgtctctcctctgctcagagcccatctggcttcctatcttagtcaaagtaacagctgacatcatcatagtggcctaaagactctagtgaagctctgccccatccaaatacattgcctctcagatatttcctaatatgtggctctagcttccttggtcctagccacgctagtgtctcttctgtctcttaaacaagtcagagactcttaactgctgtatttatacttactctttcttctgtctgaatgctgtttctacagaggtgctttctaattgaaggtacaatcatttctcacatatgccttcttctcattatttgtttaatttctcttcacagcacctatcatcaccatctgacattttatatatatatatatatatatttccttttttgtttgttgtctgtcactcccactaaaatgtaggtctagaagaatagaaatgttcgtttgttgtttgttttgttcactgctgtattcttagtgtgtgcctggcattaacactcttttgaatgactgaataaatatctgaatttctgctatttccctataagtaatattattttggatagaaatgccactaatcctgaaacattttcaagttttatatggtttttatctttaatatttgtgtggctttctgctacattccaatatttaattagctttagtttacatttattaaatgcttctatatccagataatgtcatatcataagtttcagttgacatttattaacattactacttcttataatattttaacagaaatatgattcatcaactccagtgtttgtaaatatcatcaccattctgaagtcaaatgttgccaaagtcttccattaaatacttgcagacttctctcatttggtacagccagtcactccttacagctgcaatatgttatatctcgaatgtatttcttgatagctttctttaagataactgcacttgcaaagttctttgtacctagaaaactttcaacaaatatttagagaatataatttactcatgcatgtggatagacacatgtaagattcacttaagtgtcaaatttactaatataatgaaaacttggaccaaacaagcaacaaaaaatattatccagcactcatactcaaaacgcagtctgagagtttggtatttttcagttcctaaaggttgatcatgtggttcataaaatcttagtctccaaaatgtattttcaaatgaatgtcaggcagaaccaacaaatgagaactagggtacttaggattattgtaattgcctaatgtgtttggtgaccttgtattcccacttacagcaacttatgcttctttcaaattcttttgtacaaaaaaaattgtcttgtccactctccacttagcctttaagtcactaagatgtggctatttcattagttgaaagcaatgtctaaaataaaatattttattttaaaaatcaatcatcttgcataataatagctttaactttatgctcaatttaaaatatttgtatttaaataattgcttacagaatagaaatagaaatgatatataagataatatagaagatgtaaggatttaagaagttaggatgacagtatttttatttacttttatcatttgtaattgtatcttattgtctggtaaaaacatttaaggaaagattaaaatctaagtttaatgtattatttataaacatttgctccttcataaaatcttcctgcaatccctctttttaaaaatgttttcattgcatatcccgatgatctgcttttcttctctccatgaaactcagatactagttttctttacaacacctggattgtttcttcctctactgctgttccttattttgtttttctattctggtgtcttgatatctccttttaacaaattccataccattggccttcctaacttgtgaacatttctaatactcacatatgctctataaaaaaaagtgaggtttttccaagaagaacagtggccattaattctgcatatatcaaaatggaatgtgtcatctttgagcaaaatataagctcacaccatgcataaagacaactattgtttgcttcagccaggagtatgttttagggaaaaaatattttaaacaagccattaagaaatagtctcttttttctttaatgtctttgagctacatatgtgagcagaattataaagaatttccagtgactcattcttagttttggccttcctggcattctgtagtcgtgcatattaaaacctctaaacagctctcagtaaagccttggcagtagagcttgtagcttgtacctatcaaaaatgtcagatgcttttttccaacgccatcactagcaaacaatattacttagttattaacatataggaattaacggcaaaatctgcaagttgcaaacagtgttgtaaatcaactaagcatttatcatgagattttttaagtgactgaatacagattcagaatcatgaagttattatctaataacccaacaagtgatgtgaataaatccttgctaatatgaaaattatcagccactgaaacacccttttctacaagcaggtctgtggatcctcatgctaatgtacttagattgataaaccacagacattctctgaaagcttcgtttgttccagttgctgaggcttgtgcttagagcatctgtcatgcaaatgatcagcaaatcataacctgtaatttgttttcatttaataggcagacaggttttcaccaatttagactcaagtcctattaatactctttgaaactaattgctggaaaatgaattttaatgacaggattttatcatttattattttcccttctgtccctataaaggaagactcaaagccatctactcacactttgaaaatatatgttaaataggcacaagccataatctcctgtcatctgggctgttgcaaaggacccctaatcccctctcttgtaataatccattctacactctactcttaaaattactttcttactatcccatttcccttccacaaaatcttcaattccctgtcaagtaaatagcagacactttaatatggcttcgttgccctccattatctgtttgcagtttacatatttttatccttatttgatatcgcaatataacatgtatacagaaaaaagcatgaaacattaattaataagtagtaaagtaacatccagaaaacactactcagagcaaaaagcagacgattgtcattaccacagaaaccacctccccagtgcatctttctgatcagacccttcccagcatcccagagtctaaccacccagagataatcacttcctctattttctttagattgtctccagctacgtgtgaattcttaaataatatggtcaatttacccatttttgaatgttatgtaaatggaatcaaaatctgctttctttggctattgcttttttcactcaaattattctcttaaacattcattcattttagggtacagcttcagttaacttcaattttaagctgtttagtattccactgcatcaatgtaccacaatatatttatcttttccatgttgatgggcacttggatttttagattgtttccacatttgagctattacagacaagggtgctatgagcattcttggatgtatagtttggtgcccagtattcttttgtattcatacctaaggagtggaatttctaggacttagccatgcatattcatactagataaatattgatgtaatacgtaaaaccaagtaatattaacttgtatataagtagctctgtatgctactagacaagtcaaaatatttttcaaaatggttgtaaatttatatatcgagcaggagtgaatgctattcactcctacttctatttcgacttctagaaataggagcacttctatttctttatatgcttgacagtacttgggattatcagactacctcactttctgttcctcctctatttattcttgctttaggattttctatcctcttgtttattcttccttcaccctggatattaattctgacctattgcaattcatgaattctttcttcatctgtttctaatctattaatgactcagtcatatgttaactttggtaattgtcttttctaattctcaaatttgtttagttctttttcaactgcgtaacaacactcctttgtagtttccagtttcctgccaattaaaaaagcattgcccttcatttcttcaaacacaataaacataatatttccaatatgcatctgaaaattctagtatctaaattcttgaggatcaatttctgttccttgtttcttctgcaggttctattattgaagaattattatgttggtgcaaaagtaacttaggtttctaccattacttttaatggcaaacaccacaattacttttacactaatctaatatttcttttcaccacatttctttgatttttgtttggacatcatattcaaaaattatttgaaggaatcatgttacacctaaagtaatattacctttttctagagaggattgtgtttttctctgtcaggaatctggagcctccatcagggtaccaccataaattgtgttaaaatttgagattaaactatgcagtcctggattttaatccataggtggaaaaaaatagagtttcaaagaggtaagcttcaattaagacagattatgatgcctccttcttctgtaacatattgtgtgactttgagttgagattcttcctaagttttctgatctattaaaaaagatatagctggtaatccccaaaatcatgattttccttttttttttttttttttttttacagtttctactgtatttctttgttgtcctgtcagtaccagttatggtgtgtgttgctttttctttctttatatttttgttgagcacagtgattgagtacatgccccactaatagggtataattattttgagagtaatatctatgacttaacaccatatctctcactatattgagtgtagtaccttgatgcagtagctagctgctcagtgaatgttaaatggataaatcaatgactgaataaattttagagataggtacatagataaaagtgatcaaaacaagctaagtattactgcagagaaggaacaagtatcttttctattatagttcccaaagcttcaaccaaatttcttttgctatgtttacctgtccaatatattggctggttgtactcatagagtactagtcttagttagaatttatgagtaatggtccaaatccgtaatagagcttaaaactaaagctttaaaaacattgatccagatgaagaatgataggatgcaatgaaagtttatttagggcataaaatttaaaaggtatgttatcaataattcattttgaaagtccccttaatatagccatttctattctgtatctttaaccagttataggtgacattgctaggaacagattttgacagcagacttgtgcaagggatctgtttgcctagagatttacttaaaaggtagaattaaagtcatttcaagaaagaaatttaacataagaaaatataaccatttagtacactaaataattggtctagctagttatgagttaaaaatgaaaaagaattaatagtttttagcaacatatacattgggacagtatttttgccacatctatcatttacctatgcaataattaaattcataattttttaagtgtcatatcgaagagtgttattcaacttcctggtgattaaattactgataaacatagccgattttttttggttttgcaggtcctgaaaaatagagaatgcatatgacttccaaatattggtagaagagccagtcaaataatatcttccatgaatcctcttacaattaatttgctgattgatagatgttcaaaatctagaaatgaatgagttgcatgtaaggaaatcagtacatgcttctgctgccatcatatatcacaatacaagcattaaaagctatattaattatagaactttatgatcttatttacatggtctgtgaatttgatctttattttggaattcctttaatccattctgattctaatcacctcaggaccaactttagtgtatttgtacaaggcgtaatcattggctagctctataagttgtccaaacaaccaaatgagatgtcgcaaattctgccaattgtgtaaagttttattatgtactttaaatatatgaatatttggaatatcaagatgtgttgtattttaccaataatattaaaggtttgcttgttcacttttcacttgtattatgatgtcatttaaacaagtcagtattattagaaatctgattcattctgaaaacctctcatctactgatctaatgatcttcaatattcattaacatgaaatattactataataggaaaaaaatcggtaccttaacaaaaaatatggaaatttatttgtttatttattatttttacttatttatttatttatttatttatttatttatttatgtttttgagacagtctcactctgttgcccaggctggagtgcaatggtgtgatcttggctcactgcaagctctgcctcccaggttcacgccattctccggctgcagcctcccaagtagctgggactacaggcgcctgccaccacacccagctacttttttgtatttttagtagagacggggtttcaccatgttagccaggatggtctcaatctcctgacctcgtgatccgcccacttcggtctcccaaagtgctgggatatttctttctttctttcttacattctagagccttggcgagttggcccaagtgttgtacagcattttcagtgtcagggacatagacttctctcctttctctgctgtgtgtagtctcagatagttaccagagcaccagccattgtatgttctttctagttttcaggtagcagaaagaataagaaatgttgcacaaaccaccctgtttacatcacgttggccagaattagtcacatggccatgaagcaagccactttgcctgaagtaggactacagattgtctttattctccatagtggtaaaatataaaaaaatataattagagaagaagagaactcctctggaggacaactagcagtaacctactctactaactgtccatttactagttcattttgctctaagataacatataaacagtgaaactaaaatatgttttcaaaattagaaaatgtaagtaccttagataaccaagattaaagaaatgttacaaataccacaatatcaacatagttatagatgaacatcaaacttagtactgattttctgaatatccaaaatgaaaagaaatacctcaataattggttacattgttttttatcattttgaaaaaggcactactgaggcaaatgaagctctttgaccctgaacaattacaaaatttatctcatagcaatttttagggagaaaattgtatattatagttgacaatattcctataacaggtgcagtgattttataagctacttacagtgtctttgaataaaagccaaaatgaaagcattatgaaggctattttgtgaatctctgaggaaaaatcattcaaaaaaaaaaaaaaacctttggctattctggcttatatacaaggagaaattttagcctgcccagagggctggatggactacatacaccatgaatggttatctgtaaatattactgttgctgaaagatttctgaacaaatgtagaaaattaaggaatagattatctagttttctgtagtctgccagcatgtttcaaatcaatcgagctttcttaacaccaggtgttctcagaagtgaaaggggcctatttgttagctttaaaaagacaaaaatgggaaaagataaaagaggtggaagcagaaaccaatttgctaaatttactaaattagacagtttattgaaaaggtaagtgaatttctcatatcagtcataaagaagctatttttccaatgaaatgtgtgtttatatcaaagtcacaaaattacttagtgaataactcccagtaaatgcgatattattaatttcagctaaattatatgttcttagaatttttttatcttttcagattgttttatgtagattatagctgttaaaattttattggatgtaatttacatggtttacaaacaataaattcctgagaatagatacgataaatttatagtttgttgaatgatttattattaaggagtctcagattggtcctccgaggacaggaaaaataaattcatggaccctaagttttttagttacttttatctaatttttgatatggtaataattaaaagggagatgataagaaattgaatgattaagcattgttaaataatatgatgcgttaataatgcataagttatattcctgagttgattctttcaaagtataaaacaatttttagatttaatcaaaactctttaaagaattaatctttgcttttagggagcactatagattgacatcagaaatttctcttatttccatgtaggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaaggtaagaattactttatttatttgtctcatacttaaaggttcaattatttgtctcatacctaaaggttcaacagtaacaccttgaagctgatttcatataaaataagtgtgatgtatttaggttggttaagcattaggtggtggaattgagtacaaaagtctcactcaatactattttatgaactttgtggaaagaaaagtagttgacaaaataaacctaaatgttaaaatatatcctgtaatagaaaagggtttagaagaagaccttttctttgctcaacttataccccaaaaacagaaagtgtatatgatacgtgatgaaatcacaatgtaagttacacatgcaatttgtactattttttttctttctttttttttttttttttttttttttttttgagacagagtctcactctgtcctccaggctggagtgcagtggctggatctcggctcactgcaagctccgcctcctaggttcgcgccattctcctgcctcagcctcccgagtagctggactacaggcgcccgcccccacgcccagctaatttttttgtatttttagtagagacggggtttcaccatgttagccaggatggactattgttttctttttaaaaatgtgatgttattggaaaaaattaaaacattcactgcttagaaactaatcatttcattctgtaatctaatcaagataggtatgtacatatgtatatatttttctttgttctttcaattctcagaaaggtgtttaaaacctctatgtccttctttagtcctgtcagaatctgcttcagttttttgaggctctgttattaggcacatagacatttataattattacattttcctgataaattattgaatagttgggtttaggtttataacttactgtttggtttatatgtataccatttttttctctgttgcttcttttcctgtttttcttggggttaattaaatatatttcagtatttgattttattgctcttactgcctttttagttgtctccctttgtatttttgttcgtggttagtctaaaggtcataatatgccttcttaacttactacattctatcttaagttaatattgtactacttcacataaaaagtaataaattttcagcaatataattttatttgtactcactcctttttgatattgtgttcacatatttatattttattaacctcataccaaatatcatagttttttatttaaatatttattgtcttttaaaggtacagaaagaaaaaaaaaaagacagttgctgggatataatcacttatctaccgtgtctggggctctttattccttacatatatttgagctcccatttggtataatttaccttcaacctgaagaactttctttagagtgtcttgaagtgcagggctacgtaggtagcatatactctcaacttttgtttaccttgaaatgtcttttttaaccctcatttcaaaatgatattcttactggatatcaaactctgaatttacagggttttttaatgttcatcattttaaagttgtgattctatcagttttgccatatattatttctgatgagaaattagccatcatctgtatcctgattctttatatgtagtatatttttgtatgtgttagtggccattctacaagtttctcttcattttttggtgtttagaaatttaattatgatgttctagatatgattttctttgcatttattgtgctgagagttcactaaacttctgggataggttacatttagtaaatatagagaattatttcttcaattttttttaccttctttcctttctcttcttgatttgaggctcagagaatattcaagttagatcacttaatgttgtctcctaagtcactgaggccttgcttgttttattaagatatttttactccctgaccttcagatttgacaatttgtcttgatctgccttcaagtttactgatattctgccaccttcaaatttttgttaagtcctttcagtagctttttcattctagattgcttattttttctttccagaatttcaattttttgaaataatttttacttttctgctgagatttcctatctttttatcagttatgactttcttttcttaaaagttcatgatcacatttataatggcttctttaaagtccttgtttgctaaaatttcaacatcttatcatctcagaatacattgcattttcctggttcctcacatttctggttacatttgattatatattggacttcgtggttgatacattgttaagacttgggattatgtctctgaaattgtatattctgaaaaggattgatttttgcttcagtggatagttaaatcactatctgttctcttgaatttgtggagatttagctttaaacattgttaaggcaggtctatttgatgtaatcttggtccctagggcaaatcccttggttttcgtagtccacatatttctaagatataaccttctggagtttctggggaaagcctgtggttctcctcaagcccttctgacttaaaggaactcaaaattcaatctgtatcttccctgtcataggcaacagttgtaatcccctctttagcacgtttagccttctagccattactctttgctaattttcctaggatctctcccatatatgtgcagtttaggggtcagctaaggattttagaaagtttatacacagattttggggctcactcctctgtggcatcctccttcttgtgtttcccttttcaatttctggcaaccctagctgattcaaactccatcctctgacaagttagttaataagactgactttctacttgagctctgtcgaccccatccccgctgaactgaagtgggtcctcaatgactaagcctaataaaggagggctctaccccgtgcagttattattttcaagggtaccctgcagtttctgcctgctttgggttgctctccagtcttttctatatatttttttcaatttgatcctgaatttttaatttttattctgatagggctagtccaataaaagctagtacatcattgctagaattggaataatttctcaaatgctttaaagtactcagaaggctagaggatctaacctaaattgtttgtaaggaatggagaagagtagaaataaaaggtttcttaaggcagtggtagggaaaataataaagctatttctatattctataaaatcctaatgaatttggtctatttaatacataagttacatatagaattgtattggaaagcattaatatcgttatttttaatacaaaatgggcaatcgtcagtcctcttccttcttattaaaaccgtgccccttcatcttctattcttttaaaagtcacaaattcagtgttccacctttatctttctaagggctgtttcctgatctgaacccagattagcaattacgttaaaattagtgtaaagaaaaggcattatacaaatttattctatatagatagtggttaaaatccttaatgagttattatgctaataaactacacttgctagatgcaaattaaacataaaaagcattcaaattagtatgttgatgttgtttttaatttgttttatgtgcttacactagttagtttaattttggagacttactttttcacctataaaaatgaggagtccaagtatgttaatggtaagatcacttccaaatactatgttttgaaaatataagtttatcgtatagcaatcatacacaagaaatagaatgttcttcataaacaatcaatttcaatgtactatttgcatgtaagagcatgtcattattgtatgataatttatagtttagagggagtccttttgcaaataaaaaattgaggcttaaagaagcagacatatgatttttagacagaaaaaatataaaattattcattggaactaggtttttattttgttcaaccggatatttagtcactctgactaggcttcaggaaaactattaagcaggtggaggagaagaaacctacaaaaaagacttagttggagtagatagagagattaaaagaaaattgagaaaatgggttgtcatgaatgccaacagaaaataacatttcaagaaggaaagagcagtcaacattagaaaatgactatcaagttaagggtacacaacattcccttaactgtattctgactgttatcagtagagatgtaagttataatttttaacaattacaaatgttaattcaattacataatgatactttaataaaataccataaaataatttagctttccaagaaaattcatcatattcaaactttatgaggtgtatttacccctataaaccaaaattacaccgttgaaatggcataaaaatgttatgatggagctccagaaaagcaagcttattattgttattatatcttctgataatatacatacttttgtgaatctaagtatattttaaataaatgttgccactaaatatctctgtacaagacagtaagaattttaaaattaacaggattaactcgtgtgcctttctaaggggctaccaaacttaaaagaatgtttcacatagtgcaattatatatatcataatgattatgcacgtaccatcacattaaagaagagtcaaagaagaaatgttggaaagtgagctctgaattcatatgattattccacagtgattagatctcatgttagagagctttctcattaaaaccagaagtcagtggtccagtacatacatacttttaagagaggaaaatgcagtcagagagagagagaaaatgattgatatgatgtacatatggagtctatttaaaaactaataatatagtaaagtctcctcaagtccttctctgcctcactactcttataattttctgcaattaatgtgttcttaaaatttatgaaaacacaaatctggccaaaagatatgaaacagataaatgagagatatcttctgcctagtacaggagaaatatttaagggtgagttaatgtaactgagaaattattttctcctagtttagaagggaagagaggcccacagagaactttcaataagaaataaaaagtatatcaagtttaggatagaagtaccaaaaaaattaaaaacaaagataactctgaattagatacagttggatgtttgatgatatagtttcttctttggctggctttcaagtcagaagcttttaaagtggagtatttaggggtattagaagactttccaagggcaagccagtatattcagcacagaaaaatttcaaggtgttgagtgacattttgaaatagaaactaaaaacttcctttttcatatattaatttgtttggaaaagatttctataaagtaaaaaaatacagaaattaaatcttaatgctaaactctacctcatttaaaccataattagtactgacccatggatatctaaattatttttttaaaaggctctatccataacattgtaagctgcatttgtagtaaaacttcatttttatagacactgaatccatagatcgtatactaattgaatcatgactcaattcagaaaaaaagattttatacctaaaactttatagtcactggttatttaaaaaggattgtaattttaatttgtatgcatatttttgatgcaaaaatactttggtgatcaagaaaagactttcaaacacacatttctattgtacttgaattacaattgtgtgagggtggggcggaatataaatatagttcaagcataaaataaaatgatataaatattctacctattaaagcatgaggtcaaatcactatgatatttagattctaacagatatatttttaaaagtgacttgacaatattattttaagttatcaatatttacaacacaatatacatatgtcagtgccgacgcccactcaggaaaatgaaaaccattcctaaaattttgaaaagaggagaatttaatattgtgggttgatcacaaaggcgctagaaggaatcaaagagcaaaggatgaacagagtaggacattggaaaagcaaaaagaaaaagtaaaacacagatatcaagtgttactgatgtgtcagttgattgtatctgccagacgtatgccccttgatcagacctggaattgccaaaaagttgctgcccgtgccctagctgctgggatcaagaatcgcctactgccactgctgctgcagccactgaaataaccatttaaagcagacggctcttctctttctttttctgtctgatatcttcagtggtttccctcaggtggaaattatggagaagccagatggcaaaggagcctgggaaatctggtttgcagattcccatccctataaggctcacagtatatagcagagtagaaaatggtatgtataggtttaagagaaaacaggtaatgatcagtactgtctgcaaattgcgccctttacaattttctaaatgattgcaaaattaatatgtcaattataaatgtagaaagatacatacttaaaaaattcctttggggtttatatgaagaaaaaagcttgatggttattacaatggaagatttattttatataaagaacatgactggtcgttttggatttaaaaataatctgttccttcagcctaattttacctgagcgtttccaccacctggaaattaaatctcttcatgctaactgattatcaaatgctaaattatatgacaagaattttactccccaaggaaaatagatccaacaatggaagaaagccagaacccaggaaaatggaaaaaaaggaggaataagtggactaaattataaatctgtaaaattaggataaagtactatacttagcatgtaagtattaatagtgatgtttccatgttaaaatatagcaccattgagagtcctatctctcaatttctaaacttctagtataacactaggcttttcttgtcactgtgcccacccacgtggtttcatgagagtaaagaatgtttttgaaagtagacatataatattggagtataataagatactatttagtaattataatgccaataatgtcattttctgagaaagaaaatgctcccaagactaaacagagtaaatcagctgcttgggactacacagctttcctaatttttatggttgacacaaagtttggcaattctttagttttactaggtaaatgaattcctatgatgggtattttagttcatcaatgcattaacaatagaaagcatatatttaccgggaggctttataaatattttattttattattttatttatttatttagagatggagtcccactctgttgcccaggctggagttcagtggcgcaatctcggcttgctgcaacctccgcctcctgggttcaagcgactctcctgcctcagcctcccaagtagctgtgattacacgcacccaccaccatacccggctaatttttgtatttttagtagagacagagtttcgccatgttggccaggatggtcctgaactcctgacctcaggtgatctgcccgcctcagcatcctaaactgctagaattactggcatgagccactgcgccctgcctataaatatttcaaaacatatgccacttaacatgtgttaatcacatgccatggtcaaagtgctatggagggatgcaagtgtgaataagacatagacattgatcatgaaaacattttgttgatggtctctatgtgctatgcactgtgctaggcactggagatacaaagataaataaaacatggttcttgcccttgaagagatcttgtcttaatgagaaacacagaggttaaactagacacttataatacaatgcactaggtgcaatgatagagaagcactaagaaagcaacaaggaaggtagagtaaaggtaaatttcctgaaggaggagaaatatagcctgatgacaaaataacaggtagtaattatctaggtaaagagggattggcagaaagtgaaggacgtctactgacagacacaagagtagaagtaaaggtagaaaggttagaaacagcatggaaagcaggccaaaatttatgagaattttgcagctctccaagcaaaaagtgatgagaatctatcctaccatactaatgttgtgaagagaatgaaagacaggaaatcagagataaaaaggaggtaggataaacagaatttattggctaaagtgaggagaagggagaagtctggaataattcatcagttcatagtacaaatacataaaagggtggttgtgtaactaattgggacagagattgctgaaaaagatttagaggaggaggacagtttagaatagggtgagttggatatgtagcattctgaagctcactgtgaaagtgccataggaggtatacatttgggagtcagcaacctgtgggtggtagttgaaatcatgaaagtacatcagattgccaaaaagaacacatggagtaagaggatcactgggctaatcttaggatgaaacccagagaaagctgtcacttaagaattgacaaaataagaagaatttatgaaaaaaaataagaaagtttcaaaaaataagctatgactagcaatgtcagaactatttgagatgttgatgataagaactgccaaatgttcactagattggccatttgggagttgttggttacccaagccagaactcttttggtagcatagtgggagaaaaagccagactgcaaaagatgatggaaaaacttggatgtgaaaaggtgaaaatgacatgcatatgtattattttttcagaaattttagatggagaggggaagaaagagataataattggaagggtcattggttttggtagagtttttgtttgtttttaagttaaaacagagacttgagtaaaattataagctaaggaagaaaaagaaagaaggaaaatgtaatataagaaagtcagttaatatgtgaaggataaatatcctggaacagattcaactccatcaaaaatgattaaactgaaaattgattttaatgaggtaaagatgttactttgatactgaatataatataatgagaatgtgtatgttaataatagataggcaagagaatggaaaattgacaaagatactttcttattccttcaaatttattgataaaaattggagattacgtatgttgacagtgatggggacatgtattatgtaacagtctacaggagagtggtgaagattgaaatagacattgaggaaagggaaagtgactgctaaatcagaacagataaaagaatagatcagtggcactaaagactgagtggaggtttatatgaaactgacacttttttattgctgctagtttacacaacagtgtgactttcttcagctgagattgagtgcccaagtctaggagcagagatgaaaatgttcatatcaaggttgagacatggtggataaacttggtaagggaattaaatgagatgaaagaagagctaaaatgattaaggaagcatagccatgatcagagacataaacttggataaaattttggaaatgttaattagaagatcaaatgaagttgaaaaacaggtgaagtatgagtgaagaaatgaaagagtaggttagaaagacataaccagagactgaaatacgaaagttctagaatttgaccttgaggttcatggcagagtgttagagaaaacaaaagaaatgagtttaaaatagctcaaaatggagtgagggagggagggatgaatagatgaagcataggggattttcagggcaataaaactattttggatgatactctaatgatggatacactgctgacattatacacttgtcaaaacccatagaaagaatgaactctaatgtaaactgtacaccctagttaataatcatgtattgatattggttcattggccaggcaaggtggctcatgcctgtaatcccaacactttgggaggccaagatgggaggatcccttgaggccaggagtttgacaccaatctgagcaacatagagagacctccacctctaaaaaaataaacattaaaaaaaattagctagacatggtggtgcatggctctagtccgagctgttgaggaggctgaggtgggaggatccctttagctcaagagtttgaggctgcagtgagctgtgatagcaccaccgcactctagcctggatgacagagtgagatccgtctccaataatgattgtaaggttcattaactgtaacaaatgtacctcaccaatgcaacatagtaataatagggtaaattattcacactttctgctcaatttttctgaaaacctaaaactgctttagaaaataatatctatctgaatcatgacccaaaatgattgttgtaaggaatatctacattgattctgaaatatattaggaggttggtcagtttttgtgtgaagagaaacatttagccaggtctcaaagttttcagagaaggagaagaagatgctattgtgaggtttgtctggtggaggtgatgagacctcagaaagcacatgtaattgacaacataaaacaaaacaaaacaagaatggagatagcatgaatagagtctcattaataaataacaaaaaacaggttccttgagtatctaagaaaggcaaaattccatggcccctaataaatagtgaaaatgatggaagagaattcccacgccatgtcagctcaaaacaagtatattttttgcccaagccatgctcaagctcttgctctttttctatgcctcctgtgctcatccccactcctattgtctaggatcccgcacactgggttattgatgtagctagtcatgacacttggctgatggagttcatttcaataccctagtagctaatgtcaatagaactttcattgattttccagtgtcctttaattcgttaggtattgaccttttatttaaatcccacatgaccattccaaacattttccacacttttcaagcctcaatttctagtcccttcattttttacaccctcgtcatgttcagttgttaaactctatggtttactgcaaaagctgtgagaatctagcgtaagtcccttgtgttcttgatattcaacctcaaaatccttccatgattctctcatctttagtgacatcaaaggcattagttatggatactgttgacacatttaatacccatgtgagcctaaaagagttttgaatcctctctgagtcacaatgtccacatcagtggaatgaagctattgtgaagatgaaccaagaaaatgaattcaagaatgtgttgcaggaaaaacaaatagatcttgttgtatttgttgactcggatagattggtaaaacttcctcaggttctgtgttttaaaaatgtaacagatccaacacatatttggaaggtagtctgataggatttgctgtggggaagtgagagaaagaccaaagccgagaataatggtttccagcttcatccatgtccctaaggagatatacctaatgtaaatgtcgagttaatggttgcagcacaccaacatggcacatgtatacatatgtaacaaacctgcacattgtgcacatgtaccctagaacttaaagtataataaaaatatataaaaaaaatttaaaaaagaccaaagccaacaatctcttctaaactcatccctttttaattttgtcttttcagccacagcagcagaaaacaaaaacaaaaacaaaaaaaaacagcctttatttccattttccccagctccactcactatcttgttcctagccacaattatctcttctctggattgtagccgtagaggtccaattactctccctttccactcttgactgccttcaatatattttaacacagcagccagagtgatccagtcattttcctgctagaagacttttgatgggtttccatcccactcagagtaaaaactgtccttaaaattgtctacataatctgcccaatcaattccctttgtgatctctttatctctccctctgtcaccatgctccaagcttatggtaccccttgtacttccttatactcattgaacttggccttttcaatttctgtctctcctatctgcctaaaatgatatttctctgtccacctcatttttttttcagcatttgcttaaagcttattagagaggactgccattgccaccctcttcaaaagaacaacttccatcctttgtactacctatctctcttattctgttttattgttttttataacacttacaattattttattatgtactgacttgttcatttgtcttcctctggtaaaatgtaagctgaagttggtctgagatttcatatatttggtttactactgaagcctcaatatctagaaaatatttgtacataaaagaatgaatggtggccacatggcatacattaggtaataacactcccctaattaataaccattcaatgggatctcattgctctttaataaaatcaattaacctactatagcctactaaatttggactttatataaaatgtttttatctttgttgaaagactacactttgagcttttgttcctattattttaaatattttgtccattaattaaacagcttgttatattcagctactctcactttacttcaagttaattgagaatggtaccatttattggcacagaagaaatgaatgaaggaaatatttggccaggagttgcagaatgcggaatcaaaactactattttagaaatcagtaataatacccagatgctattctaaagctttacaggtattgactccttacatgctcttactaatttgatgaaatagatagttaatatgcccattatgtagatttaagacatcaaggcttagagaatttaaataccttgctcaaggtcacatagccaataactggaagaaccaggatattagcttaaattgtttgattccattctcttaacaactatggatatacctctttggagctatccaaatggaaaatgaaataagtaatctgatatatgagtctggagttcgggtaaggatatggaatggacacatgcatttgaggccagtctgcatatagatgaagtttaaattgcccctctacctttctttatccctacttctcttttattttcagtctctttcaaattctttgctccttccccatttcttaaaaaaggtattctctatcttgaaaataacctgctcatgtattctaagctaaattaattaggtgtctttggttgcaaatgacaatccaattgaagtgaaaagataatttaattctcacaaaactggcctattcagggatgagatccaggctcctttcatcaggctttggtatcgcttgctccatctctcagctgtgatttttttgtgtgtgtgttgccccagttctcaggcaggctctcctctcttggcagtaaagtgacttttagtagctcttaggcttagatttcatcctcttatctatcccaacataaacatagattctcttttacctgcagttccaatacagagcctcagctttaacattcactggctctgactatgaagtattgtgttcaagaggaggcagtgttctcaatgccaggcctacaccacttgcccaggtggagcactgagagtaggggtagctacacgcaaaacacctagagcaagcctcggggagtagtgaatcccaaggaaaagtaggatgctgttatcagaggaaggggaagtagataccaaacaggaaaaacaaaagatatccttcaggggcttaaaaacaatagaataagttacaggaaactatcaatagttacatgtacacaaaaatttaaatcgacagtaatacaaaatcataatgaactaaattaaactacaaacaaaatgctagaaaatatttgtaaaagtgtaatggtgacttgtttgtgtcaccgcttcactgctacatgaagtaaaaatcaacaagaaaatactaagaccccactggatagatataaaagatatgaacttagagtttcaaaaggagaaactagtaggcagtataaatccgaaagcaaatatattgcaatggagaagggcagttaatcattttttagaaagttaagtttatgaaatatgattgatatatattttattttacaaaataatgtaaatgtgttatatatgcttggaattattttatatgttgtatttcataataaagtagaacatcaccagaatttgatgacatacttgtcatcaataatagatttgacaacactgcaattaacacaaaacccacaaggaatttaaaagcatagcttgaaactgaccaaataacaactatactagcactgatatagagcttacttattcctgacacagtctcacatactatgtatttattacctctcagtactcacaatgataagtactactattatctcaatgttgtagatgatgaaacagagagaggtgaagtaacttgcccatagtcacatagccaagttgtagagaattaattattcaaattcaggaagtttggctccagcatccaagtgcttaactcctttaccagtttccagagaaaaacagttttgtctgcaaagcatttaaataaacccagttacatgtcagtgagaaaaacaatactcaaacagttcagagctgtttttttttaaacctgcatatttgaagaaggttcagataggagttcagacagagtatgagtagaagacaaaacataagattacatagagaaagatttggggtgagatgtaaaagatttgcatttctaaacttctcgaaattcacacttctttctcaaacacctgtgtcttctttccataaaaaattaaaacttttagaaaggactgcaatatactgtacagtctatatctcacttccctcttgcatttaatcacactccatttagatgacattcagctttaatctgcctagactgcctgtactcacttcatttctcaaccctagctaaacttgcactttgtcccataaggctttcaaactactcccatctcttagtaatctcgtcctctgagaacacctattccacttcttttcaaattacctttgtgtaatgttacacatctatctatatatatctacatctatatctataaatgggcatatatacaatctcaggaagagagaacgagagagatggagggagagagagaccttctttttgcatagtccctgttttggaaatcagaagactaaggttatgtttactttgtatgccaagcacacagcagaatgccctaaattcatccatttatctgcacatgtttttgaatgcatgttgtattctgggcactgtgcctggcatcatagatacaaaggagtggaagatacttttcctcggccttcaaagatctctaagtgcacacgaaaaacaaatgtgtagataaataattaaaacacagtgtgaaaaatgccatagggtaatacatacagggtgccatggcaacccaggggccgaatggcagcttctgcctggggagttgaaaagatttcacagaagaggagaaatttaagctaggtcttcagatgagtaggagtataagaggcaacaatagggataattataaaagcatgtttgccttgataaatagtttgcactttatcatttagccagtacaaattataaaagagttttacaaaagagaaaaatgtgatttaacttacgtttaagaaagatagctgaggtaggcctgagaatgcattggagtgaggaagagaaaaaaacaaatggctttttcaacaatctagggaggaataatggaatgtctacattaaaacaacagtaacaggagactaacaaaaagaatgagtctgaggaaagttaatattctttattttattttattattattatactttaagttttagggtacatgtgcacaatgtgcaagtttgttacatatgtatacatgtgccatgttggtgtgctgcacccattaacttgtcatttagcattaggtatatctcctaatgctatccctccccccatcccccaccccacaatagtccccggagtgtgatgttccccttcccgtgtccatgtgttctcattgttcaattcccacctatgagtgagaatatgcggtgtttggttttttgtccttgtgatagtttgctgagaatgatggtttccactttcattcatgtccctacaaaggacatgaattcatcattttttatggctgcatagtattccatggtgtatatgtgccacattttcttaatccagtctatcgttgttggacatttgggttggttccaagtctttgctattgtgaagagtgcagctataaacatatgtgtgcatgtgtctttatagcagcatgatttacaatcctttgggtatatacccagtaatgtgatggctgggtcaaatggtatttctagttctagatccctgaggaatcgccacactgacttccacattctatggcataataatagaaattgataacttggaggagaaaagaaggaagggttgagacttggtgagaaatttagcagaggaaaatgagcagatggacactccacaacaaaaataggggatgcagaaggaaaagcagattggaaaagggcaacagggacacagaatttggctataggcattttgattttgtggtacctgaggaacattctcatggaattgtctaggaacaattagtcagtgagcatctggaacccaagtgaataatgttgagaatttctaaaagtttaggaaacataggtatttccatcacttccattataaaaacttcattgggaatgttggattaataggaagatcatgcacagaatgattatttaaggtcctaaattgttccacctgagcatgggtaaggagaacaggtgttaattatttttgctgcgaggggaaataatttaaaaactagagggaggagagggttaactttgggaagagagttcagagaacctgagaatgtgatgagttgtccccttttccacccacactggagaggggcatgccaggggcagttgggaaggatcaggcattcttcccataaagtcgagcctatctctctatgccagcagaacatgctgcagggaggcacaattcccaccattctgacccaccatttcctaggtagtcaaacttagggtggcaagaacacctaagattcccacagtctagagaaggaggaagagctggcaaggacaaagaccagaggaaatggcctccttgtgcagggagagcccaccacccactgggatcaggagaaggtcctgttatgaggagcaacgcttgtgaatgaagaagggttctcagctgggtgcctgaaagccatcaaaaatgttccatgatcacacaaaagagtcttacatattttcattactgcaaaccagccttgaaaatatatgtatgggccaagaaaactttgcccaccgaagaagaacctccctgctacaacacacctgccagtgactgcccagtgataaatgcttgcaggccttgtgaaatgaggagatagctttgcaaaggggaccagagtaaaatacgtaaaaagaagggaagcccttatagagactttaaattggacagtggctaagactttcattcttacatgagattaaacaagtaataatagacagattgagtttcccagagtatgtcagctgtacacaggcaggaagttaaaaaaaatacatgtggtcataagaatacatgtttgcacgtctgaatggtaagtgttcaaaatccactggatatgcatataggatgaaactaaaatatagatatgggagatcatacaacctgtttgtatataagtacaagaggaaaacatggccaaaaatatttgttgttgataaggaaggattttaacactaatgaaggaaaaggataacgagagatctgtgaaaggaaataaattatgtagatgcaaatgacttagtgaatggctgtaggagcaattttctaaatttgcaggtgatatttaattggcagacattgcaaacagcaaggagcaattcaatcagataaagaacttgaatcattaagtacttggcctaatagatggcaagcgcagataagtggtgaataataagtcttgaatcaaaactaaagaacagagagtgaacatttgccaaagggaatgataccatccaggaatggctcttagatttaaggagaacttatagacaaggacaaacaaaacttcagtaaaatattacaaataaaaagatttggtgggttacagcttatccagctgaagctgtgatgagaaaatctgacaacttaaggatagataaatcctgaaatccacggttggctattgaaattccatttgttacctagaatttcatctatccctgatcatggtttggagataaaattaatgagtaagataacatccaagcatataagaggttacagatttgggtgaggatactataaataacttttaaagacatttcggatatgaaattctctatgttctatgggcataattgtgaggtattgtgtttagattgcttggtcatttttatttaacatgccagttctagtctacgttagtctggaaattataaacatagagaaatatgctacaagtaaaagagaataataaaaatttattatagcctagaaaggtagttgatgcaatatataatatatttcctctttctctttttttgcaatggtgaatactttactaaatgaaaaggttaattttaatattaaagagaaatggaaacatcctttagtacaacattaaaaccacaaatggaacctttaaatattcactcactctagcaatcaatgttccaacctcatttaaaggattttttttaacttgacatacaaatattcagaatgaatatttggaagcagagccacgagccataccttgaaagataactgcggacttactcttgcctgccatttgggtacttcagatttcagttgttctaagtctcaatgatcctgagttttctttttgtaatttggtaattttgtaatggcaggctttaaaataagtaaaggttttcttaactaagaacaaaaaaaaatccggagacctaacaaggctcagctgtgtccaggtaggagatgactgcagtttggcttcagaggctccctctagcagtgtgaggacatctgagtgtctctcctactcattttatatttcatttgatactgcacagaatcactaggagaacagccagaattgatttacttctcatagagacaaactgtttctgggagctagttatcttcttattaacaaagagcttacattcccctcccctccagagctcctaaaacatctatataatagctacattaagtgaattctacaatgattgaaaattttactataatgaagataaaaattcactcaattctagttcttttatccttgatttgcatttgactgaaatgtgtatttgcagtttgggcatttcagtcagcgattgctcctgtattctttgcccataagcagccttcagatggcctcttagaaaattgaagaagtctctacatgactggaaaactctttctgatggtctgtttcttcaaagatatagcattacctcttgggaattatagaaacaatatatattgttaagcctcttctaatgctactgtaatttataactggtaactttttcccccacttagcattcaataagcatttattggggcctaatgtgtaggtggaattttggagaatacataaagtatagaacacagagttcttgttcttcaagagctaagcagctctatagagaagagagagacagaacgacagagacagagacagagagagagagagaagagatcaacacatatccaccacttgctttactatctatacttcaacttttggtggactcatcccatcttatggattcaattatcatctataagtagaccacttccccaattgtttctttaacccagacctctcacctgaactacaggcttttattcctcacaatgccttcagcattttccatttctaatgggtacctcaaacattaagtgttcaaaactgaatttctgatttcacccctttcccccatccttgtctgttgtagtgtatggcaactccaattttcaagttactcagtgcaaaacctttgagttgtccttgaattctcttctctctgtcacgccttatatacaatgcatcagcaaatttgtctggctgtaaatctgaaatataccataaatataaatacgatcacttctcaccactcgaaagccactatttttctctctttaggactatttcaatggccctttaactgctcaccaagctactgctctttttcctatttctgttaaaaaatctatttttaacagagcagccaaagtgattgttttaaaatgtcagatcgtattacactctccctataaccctccaatagttttccttcaactctaatttacataattccctataatgccttatatgttcaattatatacatatacacttaccaccatctctgtgaaatctctttctcctacttccctagtatgagtattgcttaggtataaatcagaactcagaaaaataagagtaagaattaaaaaggacatatgtgctgaaaaaaatagagcaatgaataaatactggggaagtaattagaaggaagagattatacagaaaccataaggcaaaaagttaatcaaatttatcaagcatattataggggacatggccaactccacaatttgttcacctataatctcaggcaagctatttaccttgtctgagtcttagatttggcctcagcgaaaggaaagtggtgatacatcatgagcagggttgcagcacagctggcataaatggaggtttatcccacacatgtgggctgaaaatattagaatccaagctaccaaggtcagagtgcctggctaagagcttcatatggaaaaaaaacctttaagtcaatgacaaaatgggagagacttttttttttcaggcagtatatagccaagaatctattccttgaatgctggaattgaaggttatataaaagcacttattactaccaaattgcaaagaacaagcagagcaagtaagttgagagagagagagagacatctttcttggagaacatttttggaaaatgactgtgggcaaagcaatgtgaaaatatttagggagacagaagactacgaagataaaatacctatatcaagaagtttatattgaaattgagaatataaaacagatattatgggataagtcccataggagagatacagaaaaacagagaaatgaaggataactgtaaactctagggaggcaatgtcacaaactcaggtgaaaatacattagaaaaggaaaactaggtatttttcagtatatataatcaggctggaagataaaagctggttcagagactagtgaaaacaaatcaggctggaagataaaagctggttcagagactagtgaaaactaaattgttcctataaggactttaaaaggagatcagcatgtgagtagacttggaggcctgctaaagagggagctaggagaaggaatagcacgtggtttctgagaaacagtgtagcaataaggcttatcacacataaactaaactaatcatgatgtttttgtcactattgtgctgtcagagaaaaaaatctattgaaataatgaaacatactaattttgagaaacatcagtgtggcaaaacccaagaaacacttttcaaatgaatatactcaaattgcaagatcaaacatctattaattataataggtaagaaaaaggaaacattcaaaaaagtccttcaaagcgaaaatatgtaaattagagtaccttcataatcaataaacacttattgagcatctattcatgtgctatcaatgtgttaaaaatacaaaagtgacaaaaataattattgctcaaaattctgtgcagtatttagaaagattgggtagggataaacatgtatttctctaagattacattacattatgataaggtttatggaaaaaatgtacatacctatgtatatgtaaaaatagaaaagagtctaaaagaactttttcaatctcaaaacagtgtttacatatgaggaaatgtagcgatgactgttcattgtttataaatatctgttctctcctttcttagtaatacagctcctgaatcataatagccagatacagacttcccacaatatgaatttcccagtttctctccttagctagtgtggtcatgtgactaaattgtagccaatgatatttaagcagaaatatcatgtgatgcctctgagaaatgttcttaaaggaaggatttttattcttattcttatcttcctcctttcttctggctggaatgttaataggatgacttgtgttcaagcagccctctaaagacatgagttggaagctatgtactgaggagcacagagcaacaagagaaaataagtaaaataagtttggttcttagctctggaagcgtgataaacctgggatagtcagccagggaacttctttcatgttgatttttaagccagtgatattttgggcatttcttttacctgcaggaagaaaataggctgattttatgtaatttgaccctttaaaaactagaatatattcatacatagtttttacagttcagtgtttaaacttatttatttttcatcttagttttgcttccctatgttttgtaaatggtaaacttattagccattctgtggtatataaaagtttcacttttatgttttgtttttatattggcccaacttccatgttcagctaaatacactaacataatttaaattactgcatttcattgggaatccaagttagaaaattccttttcccacatttttaatacctaaaacttgggaaatgaataacattataagtacttgaaaataatattcactgatttatcatgtgtaagccctgtcgaaatatttattttctactgagcttggaagatattttaaaatgattccattaaagaaatttttaaaatttttgaaatatctatttacttaagatgttgaagaaaacataagcatctacctttaccttccattttttagatctcatatgatatgacaaataaatagaaaattagaggaaattttacaacagtactctaaattaagtaagggtaccctccatgaaccaggaattggcagatttcaaaaaagcacactcctaagaaatttctgtttttcacgtgaccctgacaaaatccattaattgtcctaatttggaagggtacaaactgcagaaaagagcagggtattagctcagcaggaagcataatatttcattgccaagttgctgttgtgactcagtagcagcacttctgttatcttctgcatggctcctcactcttcagcgagcaaattaggactcattcacatggtgatccagggttcctggcacagcaagatagatggcaagccattgtgccagccctccaatgctctgtttgtatcacattgcttttctcccattgatcaaagcaagttcctggctaatcccaaagttaaaggatagggaaatagactgcaccaattgttggaagagctgaacagtacattgcaaaggggcaggaataccagaataggaagaactttgtggctatcttatgtaatctgccgtgctgatcagttagactaataaaccaagagaagaaatgaaggataataaattcaaatacctaatagagatcaggctgttaaggtataaaagtaaagttgggtatagtacctatgcacacaatgtgcttgaattgtgagagctaaagtgaattgaagatctcatgaactttccaagggggcactgtctctcaaattcaacaagttgcttgaaacagactccagcaattttcacatgaaattgtaagtttgaatttctatgtagactctactaattttgaattctggctgaagtattttaaaactgtggttgaacataaccacatctgtaagttacttatgaatcatggaccatcaacatgtgagttttgatagagaagactgaaaggataacattttacaactctattaaatataatataaatagtacaattaatatatattttatataaatttgtgtcctatagacactgaagacccataggttaattacaaaaattgataatacatcatgtgcctccaactccaaaatttatatacaacataagtaatacctaacaaattaccagattaaaacacaataaaattaagatgaataacattttaaacaaagacaaaatctcaaaccacttggaagtaaaaatagcaaatgagcaaaaactctcatacactgttcctagagcaaagaggaaataaaaactaaaagtatagactatttagaaaataatgataacaaaagcactacatgtaaattgtttttaaaactttgcttacagaaacgtgttcatctttaaactctacttaattactaaattaaaataatgaatcaagccttcaactcaataaacaaaatatgaagccattaaagcttgagttaaaatgcattaaaatctgtattttagaattcataaatcaatagggttaattgaagggaaaaaacagttctttgaaaagatataaaacaaaaacaagccttgggcatgtctggttttggaaaatgaaatgcataaataaaagtatcaaaaacatgtgtacaccacaattaagaaaaattttcacaagcatgatggaacagtaagtacaactttatcgtaattatttgaaagaaacgtatggcatgaattattatcaaggaaaacatcccatcattaaaattgacccaagaagaaatagaagacaattaaatatatgtccaatatgacaaaaaatgttatttgtttacaaacaaattaataatgttatctcctgcctgttttcttaatttcaggaaagagtaggccaaatgattaagacatttcataaaagttacccaattaattctgaagagctagagtaattcccaaaagaatggctgaaaatgaaatcacatacaaaaaaagaaaaaacattcaatatcactttagtagtggtaataaaaatacttattaagtgataattgaattcttttacaaaattcttttggatatgaatatccaaaaatcttaaatgtcctttcatatttaatccgtcagcatattagaacatagtaaagtattaccaaacagggtttattacagaatgagcttcattcaaccaaaagataacaggagaatctttggcaaaatatctaatagtaagcaaagttggagacatggattagataataatatgaaatcatcatgtgttctaaaaatgaaagaatggtattaaaaaatcaaaggaaaaggggaaagtaggggaaaataggatatcgtaatgcactttagggaataagtggaagtaacagattttatttaaaattttcaaaacgttaactggaaaaaaaggagtaaaagcataataaaatttttaaatattgaggttaaaaactataataaaagtgcaaatctttctagatagtaaaagaaaaacctaccaaagaaaacatgctacatagaaaaacacagtaaatataacaaaatctacacaataataaataacataaagaatagattaaataagatacatttttgggatatggatcaaacactacaccctcataatatgccattttctcaagcatacatggaacattgacaaaagtcaatcatatattgattggcctcaaagaaaacactattaagttccatttaagtactttattacaaatagtgttccctcatcaaaatacaataaaactagaaatttagaagaacagtaagagaaggcttttcacctgaaattaagaaatcatcatgttaaacaactgtagaaaagagaaaaagaaacaaaaattatctttaaaattagtggtaataaaaatactatatatcagaatctgtaaaggatacttaaaggcgtaattagtagtcttggccctccccttcccttcccttcccttcccttcccttcccttcccttcccttcccttcccttcccttcccttcccttccccttcccttccccttcccttccccttcccttcccttccccttcccttcccttcccttccccttcccttccccttccccttccctttcccttccttcttttcttctttccttccttcttctccatctccctcctatttttcctccttcccttttttttccaccctttcttccttcctttagcatttcttcaatccttactttctcccaagcaaacctggaatctttacattgtaatattatttaaaagccaaataaaatcaaataatatttaagaaaactatcaagaaatttcaaatatttacaaaaatttattctcttgaacagcaagagaaggaaacagtttagtaagttagataggcagaagtagacctagtacttgtgaaatgtgtgccaaaactcttcagtaactattttccttctgctttctgtagaaaatatttaaagttgaaatgaaagcatttcctgaagtgatacgtgaattactacaagcaatatgtacaaaacatgaaaaacagaggtgatatttagtttggaattgtcatattcaaaatcagaaataaaattttcattctgatagagcagtgagtttgattttattctcagattaaattacagaatggattattaatcagatgtgttttagatgattaaaatagcagttcatgtttttgatagcattagctattcaggatcaaatgaatatctgattaaatatgtattttgagttcaataatgccttttacaaagcactttaaaccctatagacaaacgtggcttgatggcagtgtagtaaggaatatttataggtgattgaaaagctatatctaaagttttaactagtgagctatcatcaaagtgcatagaactttagaggcatattgccatactttgaacttgccaatgtatgtttcatcaatactttactagtaatgtgaatgaagaattaaaggcttgctcctcaacttctgaatggctcaaacatggtaaaataaagttgacataatgaatgagaagtatagattacagtagatgtgaaaaatacaaaagaaccaaagaatgaaattaaagagacaaatataaaatctaacatttgcttcaattgcataagactttgtgggctactagtttgatagtgtttattttaaaaatatttttaaaattttatttgaccttaaatttagcataaggcagtattaaaaatcacctaataaaaatgatacagcctccaattttatttaaaaagtgtataatttatatcaattgaggaaactgattatttagactgtgttcacaggagaatgacaagtattttgagggacagaaaatcatatctttggaaaaagtttgaaagcttgtcatagggcagatctatttagattgataacataatgtatggatgacaaaactaaaacatctaataaagagtacagggaagcaggtattgattcattataaaatcaaagttttataataattagaatatttcaaatgcaaaattttcatcttagaaaaagcaactggacttggtgtaatgttaaaataatgcatgtaaaacacatgatacttggtatatagtaagcactaactaaatgcatactattaatcttaccaatataatgttcttagcattatattcaagaataaattagatctttagttgttacatataatcatttattttagattaaatttagagtaaatgtatttcaatttgtctaagcttctaagattcagtgattatattgcttattagtcatgctccattgtatcatccatccatatccttttcatgacttgagagaatgcaaatcttgtatcttctctcaaggaaaatattatgactatataattaaaataattttaaaaatgtatttatattccagttttagtgctagtcctaatcaaaatttaaataatcattttacaataaatatttgacatataatattttgtaatatattgaattttctatagtagatgcctaattatcttagctatttgcaaataatgtaagtgtaaatatactgataaatcaagaaccttactttaattattgacataattattcaggatattaatcttttatcattgctataaaacagtcaattttcatattgccattttctttttattatttaaatacctctctctgttgggaatgcagacaaaaagatggaagagatttataataattaggtaatataagtttagtaggggctccatctttatttattcatatattcatagcaagtatttattgaccatgaattctatgccagaaaatgtgatatgtaatttttttaaaagtcacaatccttgctttcatggagcttatggcctagtggaggagtcaaacattattgaaaagatcatataaacatatgtaagattgcagctgtcatagtggctaggaaagtgaggaatgtaaacttctgatagtgtaaacaaattattgttccaatcaaagagatagtggatagcttccctgtgaaaatgaaaatcaagctgacatatagatataaatgagtgtttacttgaagtttcaggagggtcaatccagactgtgggaacagcatgtacaaagaccatgcatcaggaagaactgctggaagggaaaatggtacagtatgaatatgttgaagcaggttggggatagcctacgtaaaggtgtgtagaccatgtttttaatctttctcctaagagccatgcaaattcattgaaaatttttaaagtgtggcaggagacaggatcagatttgctctatagaaagactactttggctacaatagggagactgaagaggaagaaaggtagatttcaggtagtcttacaaggagctggagcctaggaaaacaatgaaagctggaaatagtaaagaaatgaatggatattaggatgctcaggaggtaaaatcaataatgatagatttgatagggggcataggctggagaagataatgaagctaacaagttttatgacttatataaaaagacaccattaaagcaagagatgttggaagaggactggttgaatatcataagtatgatgttggccatgttaaatgttaaatttgaggtatttttaagtcatttagtagaaatgtcaattatgtagttgaataaatcagtctagatcccagagctcagatacacatctagaaataatacatttgtaaattgtgtgtagatggggacaatagcagtaatgaacacagatggaattgcctaggcagaagagctcaaatgagaaaaggatgtaggcccaagtccagagaactgctaacatgagcttgaaaaaggaactgagaaagaggtgtatgttatgtcatgaaattcaagggaaagttgtgtttgtgatggagggagaaatcatcaatgctaaatgtcaagagacctgattagatgagctttgaagtatatccactacgttcaacaatacaataattaagaagtactttttccatgaggaatagggtatccaacaatatggggaaaaagagttttctcagagtgactgggatatataaaaatggagagaaaatgtggtaatgtggagtaaccagagagtagagggaagggctcaatctctttgatttcattttaacaagaaacaaagaatcttttaatgggaaatctagttaataggatgatgttgaatgcatgagacaggaacttaagtatctgaaatagagagagattgatacatttaatgatggaaggttagccttaggaaaggggacagctcctgtattgtggaagcagataaatagagtagactgggtatgggctataggttggaacacagaaataagtatgatttttaatctcccatcttctatgttctctatataataacagtaggattaaagatgtgacaagtcgttgtaaaaagtggacaagtgagttgaccaaataaataaaaacctaagaagggtaagaataaataattgtctttgattatttctggttatgttgtttattgatatttaggaagttttagaactgtctttctgaattagtggtccttggcctttttttttttattatactttaagttttagggtacatgtgcacaatgtgcaggttagttacatatgtatacatgtgccatgttggtgtgctgcacccagtaactcgtcatttaacattagatatatctccaaatgctatccctccccctccccccaccccacaacaggccccggtgtgtgatgttcgccttcctgtgtccatgtgttctcattgttcaattcccacctatgagtgagaacatgcggtgtttggttttctgtccttgcttggcctttttttaaattttgcttcagtgcagcacctctaatataagtaaggactaccacatactcattatccattacagtgttctgctgtatcattgattctgaaggatggagtgaagcacctctttaggaagactatacaaaactcagagatgggaaagagagagagagagagagagagagagagagagagagagagagagtgtgtgtatttgttagaaaaagttcattatatgattctgatatgcctcccacagggaggctagaaatttctccttgaaaatagaatagccaaatgttgaaaatagaccagaatttaggaatttgtttatagatatatgacaagtaattgttaaatttaataaatagtgtagcacatacaaataatcagctcccttttcctaaataaaaaactttagctatttttattctattttaaaaattcacttcgtgatatttaaaggtatccattattaaaatcagtaaccattccaatttataatcatttaaaagtaaaacatataattatttattagaaaaatatttgtgaacattttataaatattatcaacatgttgtcagtaaattcctcctcaggtggaattttctgactttggttgagtcattaaatgttttgggtcactagtgatcaattagtaaattactgatccatagtactttaatggcctgaaaaagtaaatgcatcttctgagcacctaattgaatcttagttatttattcatcattaaaatcaagataaatgagtcagctcacaataatgaaactgaacagttacattcatttcacaaatagattaaactaaagctcagaaaagacgggacaagggagttaaacatccaggttagattttccatctgaaaagacccaattcccaatatcttgctataaaaattaaatacatatatgagtttgaaagcaatatttttctgcaagttcattttcatatagcgttattaagtttaataccattcagttaataattgtagatccatggtacgtatactaatatggtcttgttataatgtaaatagtacagtttaaacagcaaaatttcacactgttttaatataaaaaatttcctagaaccaattaccctgagtgcctactatatggttcatttggaaaatgaatgatagctgcaatatggtaaaatgattatgagcacagccttcggaataagtaaaacatagctttaatatctaacttctgtacttactaactgagatctgaacaagttacttaaacttctaaggtttagtttctccacttacgaaatggagaggaaaacacataattcatagttcattgtaaggactaagtaaaaaaaaatacttaaatacttagcacagggcctagcaacaaagatatatgaactcggtacacacagacatacaaacacgtacccacactgcttaactttagctagaatatttttaaaagcattattagtttgagactagattcatccaagttggtttagcattctactagggatgttacttttcatatctttctttgtttttgttcccaaaagctataaacacaagttttatcttctttcctgaaacaattaaaaagaaaatacaagaaaatgttcaaaaaataatttactagtgtttttgtttgtctggaagggtcatcctgcagctttaatcacagctgaagatcattatttcaaaaaagacacatcttttagatatttaaatatgtattatcatattatgcagtttaaatgtgaagtcatctaccctctggtttactgagattctgttacattttaaataaatagtaaatgctgtagttaagagtgctatcactgagaatctaagaagacacattagaaagggattattactccaagaagaattctctttccttaatcattactttttcattaaaatatttctgaagtttatacaatacaatcatagtagtgaccttaggcatatgacaccttagtgctataaaaactctaacaaatctgtttagagcccaataatataaatttctgtgaagagaaatataaaccaatggtaaaatgccatgttgaagtttctaaatagcccacctagtaatttacatgttaagaacatattgaatatcttgggaacatgttcctagaaaagattctccattataagcttttcctttactgttaatgattgctttgataaaatgacccacgaaaaaagacaattttctccctgtgttatctgtgtctgaaatattcttcactgattttacatatgctgataatatgaacaaggtaatttgtctgactctggtggggcaagattttcagtaagaaatgcaaaattcacacatagctcttctgtaagaagtctatgcagtgtttcagtttatataaaaagatttatattgcctgaggcatctatttttttttcctcgaggcaagctgaagtggcacaaatgaaattgtttttcacactgttaatgtattcctttctctttcaatttctcagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggtaaggagcaaaagtacattctagtatttaaaaaaaatagaatgtgatgtttccaaagccatgtattcagttaataaggttctgtatctgacatcaataagtgttctaaagggtactcacagaaatgctcagaaaagaacatttgctacttcctcctagtggatctcagacacaccaagtttccagcaataatggttcattgtcttttgatgtaagtttaatttcatcaacaaaggcaaatgtgaatgtcaaaggtaaagctcacagaaaacatcaagatcagattttcctctccaaactctgactttctgagaaatagccttataaggatgaaattacttattaccagagaaggtactatttaattatttacatatgtaagaaatgttaggacttgttctttgttcagagacattatttcatgcattaaaaatattgtcattgaaaagactttggttaatttgagactgatgagaaattttgtgttttatcttttactttgatatgtaatctttactggtgatttaacttacaatttcactattttctaaagaatgtcattgctctgttatttaatatccaatctgcccaactctttaaacttgtccaattaattatttggctctcactgtttcaaaatagaataatatttattgcattccttacttgagactattgcctcatagagaatgaaatagtaagaaaattgatagtctcttgcaagctctacacatatattgaagaggaggatgtttgctacaatggagacattatacttttgtgctaatatttacaactctcaataacatctttctttttattcctattttctcttggaccttccatttaacttcatttttctattctaatttaatcaaagattagtctagaaccttcatctgacttgctaacttctaatctagcccttaaaccttttgtaagcatgcttttccctccacccttccatatccagggctctaagcttacctgttactgtatatttttcacagacacttttagttctttcattaataattaattcagtaaatatttaatccacactatctaagtagaactttcctaagcaattagtgtatgatggtgagcaagaaggtctttgccatcattgcgccacaacagaagtctaatgagacacaaacatgtaaacacaggattacaattgtgggtagaaagttctgtggtaggataagcatagactgttaggagatcataggtgtagaagcacttaatatatgttaatgtcgcagagaaggctttttaaagtaacactttatacagagagacagagttaactatggaaagtgcttcttgaggaagatgaatggagaaaaggagacataaacggttaggatggaatttcagaccaagaagtgagagagaaattaagatagtccaagcagagaggatctagtaaagatgaggctgaagctacatttgttattataaggagtttgaactgatccttgaaatgatcagatatttaaagataataaatgggaaaatacagattcaaattttactctagaaatattctggttataatgtggagaatagattgaaaaaaggcaatgtgaaaagtcagacaaattagaagactattacaataactgagcaaagagttgatgtggcttgctcaaaggtaaggtagctttgggagtcaagaggagagtattgatgaaatggaatcaacaggctttgattacctatagcgtggtgtgggggtcagtactgaagaaaaaaggagataaagttttatcctaggtttttgaatagaaaattatgtatattggatgtggatctcatttactgaaaaaataaaacagaaaaaacagatatgacaggagagatgatacattcattctgctgcacattgagtttgagctatccgtgaaacatccaaaagagtattactaatgtgtgcttagtggtttgatatatttgtcagatgcacagaagagacatctggacttaatatatatttaggagatattggaatgtaggaaattttgaagacatgggagttaatgagatcacacagagtagttgctcttaattgcaaactcctgattgaggaccactggcccatacaaagcctaggacagagctctaaggaaaggaatggatagaggagcactcagtggtgcctgataaggagtgactataaatgcacaagtgaaaatcagagcagctagtagtatacgtttggttgactgtgttaaacctttcaaagaatcaaatgaaattaaggcttgaaaggtttttgttggatttaacaataaatttattattgaagcaaaaaaggcttgtctttgccctatgatgtctgaggtttcagctagacaattcagaggccagaggctaaaatcatccaaaggcttgttcatttcactcacatgtctggtggttgatgcggtctgtgggctagtggcctcagctttttctccatttgggcctctccatgaggtcactttgcatgggatagtttgactttctcacagcatggtagttgctttctccacagagaacatcccaattaaagaattttatgttccaggttgggagtcataaacttgtgtgatggtgtgaattcctcttgcagagaacatcctggatgtacccacctcatgggtttttatgagaatttattaatgaatggttaaaattgtgaagttcttagatataacttatataagtgtcacataagtgtttactaaataaataaaacaatgaattagactcagcggcagataattgacatatgtaaaaaaagggataacaagacaaatgattgtagatcattttgatgtagatattgattgaaatagtagatcatggggtatatggagaactagaaagagaaggaccaagaatgcgaatgtaaagaagagtaagggtagaaattgatagagtaggcctggcatggtggcacatgccagcactttgggaggccgaggcaggcggatcacctgaggtcaggagttcgagaccagcccggccaacatggtgaaacaccatctctgctaaaaatacaaaaaaatgccaggcatggtggtgggcgcctgtaatcccagctactcaggaggctgaggctggagaattgcttgaacccaggagcgggaggttgcagtgagccgagattgtgccattgcactccagccgggatgacaagagtgaaactccatctcaaaaaaaaaaaaaaaaaaaaaaaaaaagatagagtagttaggagagagtagtagaggtctcaataagattacagaaaaagagtgaaaacataattataaatgagtttggagtctgtatttataaaataggacatctaagcctaattttttttgaaatgtaatagaggagaacatgttgtaggtatgtggatacaaattccagatgttaagatttggtgaaggacttcaaagctgatcaaggaactgagagataaagggttaggtgagccagctgtaatgatggcttggattagactggagaaaaagaaattgagccatgtgtcaaagttgtgaataaataaggaaggatgacaaggatgttgatagatatgagcattgaccagaaataggaggtgacatacctagatataattaacctctgttttcatcttacttcttccaatttattcagtttttcagtgtatgatttcaacaactgccaatatgctgatgactcccagatctacatcatctattcttgaacttcagatttgtatattcaactgttacctaggcaactctctgactataccagaggcaccataaatttgaacatgccaaaaatgtaattcattttagaatttgaaccttcttagcctctcacattctctattccagctgatccaccaccaaccattcagactcatgttagaaactctgaaaatagttttcatttcttcctctttctcatcttgtatatccaaccataatcaagtcctgtcaattttacctactaaatatttctagaagtggaaatctcttcttatctagaaagattagcctagattgtcacctagattgaggctacctcatttttcacctgaactataggagtctcataagtctttcttcttccagtgttgtctcctgcaaatatacgattcacatacttgcatatatacccaagttatccatgccatggaaagataaacacataattcccattcttcagttattttcttggcttcccaatgcccacagtttagaagtctgagttcttcagagcataaacaatattccatcacctggctcctgtccaacactcagttctcatctcttaccattcgtgcctcacatttaattgcccagttactccaaacttacggtttgaccataagacaagactctttcctaactcttcacctttgtatctgctctttccaattccttgagtgcctttgttaccaacctgattagactctactcccactctctgtctttatacagcaagttcctattcatcctctaattttttgcttttatttctctactttcaagaagtctttcctgggattgagaaccatcttctatactcctcaacatgtatttgtcatagtacttaccaaccatagtgtaattcctttttttaaacatgtctccacctgagtcctttgaatataagatagtgtactatttaatctgtgtagtctctttgcttatagttaagtgccttgtacatgttaggcatttaataaattcatattgataaatttaatgaatggatgctaaatacttaactaaataaagcatggaggttagctgcaatattttgtttattagattatagtctcaaataaaacactaaaattatccacaaatgacttaaaactcactaaaccaaaaagaaatttatctgtaatgtccccactgagttgttgtaagaaactaagaggagtttataagtaaggcatcctcttggttgaagcctcatttgtgaagacgttgacatacttatgaattggctttctgaattcttcctccaagtgaccaaatttcaataagttttggagcacacccaggaaaaaagataaatagaattacccatatggttagcatgcttttctagttctataaacatgcaacagataacaaaagttataaatatgttaaatacctttctatcccactgctcccttaaatgagttgcacagcctgcaggttgattgtacatttatacaaatttataatgacagataatgctgaatcgcatatgattagctacttcatctttgaaaagctgctattcttccacttgctaacaatgaaaaggtgaattcattaaaagacactgagagcatctttatgctctgattaaaaataaatgaagaaaaggcttataaaccctatgaaaaagagaataaatcaatgacagtgtccatgtataggcaattgacttggaactggtgatatttccaataaaaatacagtcttttaagaggaagtacagctgttatttcagaattgcagtcttcattgagccactataccagattgaatagggataaagaggcatttcatgtgttatcagacagatttctaaaaaaagagttcacggacagccaaaagcagaaaaatgttaaatatatgtgagttgtttactaatcctgacattttaaaaaatctgtaacttcaaagcattctggaaaaatagctcagggaatccaactgtgcaaaagcagtatggtccattatagagataaactcagtacatctgtttggctggaacattaagagcttgtgaattaggttgtaaaatgcacgaatgagagaccaattttatacaacttttgttgtcattttatgtcctccgttatctccatgtctacatacatctcctttcaattaatattcttaagtgaaactggatttgatttttagaagtctcttatgtttagtttattggcagtgactctatcatctggtctccagaggacttcaatgactttgcaaatgtagttgtatgtaatttgctttctgtttacatgcaaagggaaatttcagaattatcttcagatgtttgtgtctgattatgggaaatagaaatatttatagtcatgtaaaatatttgaagcaaccacatatatgtttatttagcagcaagcatttattaagcaccaacaatgtgccaggaacatgagtagcaaaaggaaaataaggaataactcttaactagggtttaataaatatttcacgagtatactatgtgccatgcctggcctatgtgctttgagtatgatgctaaataagaaaaacagttcttgcaggagtgttcaacatcacgccgatggatcttaaccaaattgagatcaaaataaaccatttctgatgagaggagcagccagaattattgaaaagaataaagaaggaaaattcctttggtagttttcttaaagatcaaatagctccacagatgctaatgatgaatagaaagtgtgcctttaggagtgttagaaatactgaaaataatttgatgctgttgcacaagagttaacataagagacaacccactgattttgaaatcccaagacaatttttggaagaaaataaagagttcttcctactgtcagatggatcacactattatacagaatccaactttctcatatccacaaaaagaagagtcagacattcttttctattgaattaggcaacagaagagattgttgatgggagaccatctctttaaaactttgcacagaaggataactcaaaaagacatcaattttaatagtgtagatatcaaatatatgaaacttaccaatgtcctatttacaaactctcaaaggattcaagccttggaatgcagtagctaaagccatttctttatattgttacctaatatttcacattcaatttgaatataataaaaatgacattgactagctctgttgtttactgaccctagtgaacagaggaaaaatgagagtaattccccatgacaggttaactcgactacaaagacaggtttttttctacattgtgttcttacaggtattaaattaaaacagctctccataatttttatttaggctcaaacaacatctctgttgttgttaattatgattggcagtccttaacaaagggaccaaaatgcattctgagtgctgtcacatccacttgagaattgccccatgctgatttaaaacatgacgaggtgcccattttctttctttttatcgcacaattcttcacaactaataaaaaaaaagttgaactttcatgctgaaagtgaatgttcaaattctaccaatagtgaggagtaatttgtgtactagaaaacagtgccatgattttaagctgtgaatgcattggtttacattcctaatgaactgtgatgaactcctaagcaattatgctatgaactatatgcatactatatggccctgaaaattatttagcttgataccgactcctcatgacgtgagtcagaaaattctttctcatgctcaactgggcttttgaagagttaaaagaaatcaaagaacatgaggcagaaatcatatttctacttataaaacaagaactagtacaatcaacatcttctttgactcctttgaactacctgtgaatatgttccataattaaaattactattttagtatttaacaaaagaaagaagctgtttcctaagagacactaaaaaattgaagggtgattttgagaaaatatttttaaatctaaatttaaatgatagaacaagcaggtgctggctgggcgcggtggctcacgcctgtaatcccagcattttgggaggccaaggtgggtggatcaggaggtcaggagatcgagaccatcctggctaacatggtgaaaccctgtctctactaaaaatacaaaaaattagccaggcgtggtggcgggcacctgtagtcccagctactcgggaggctgaggcaggagaatggcgtgaacctgggaggtggagcttgcagtgagccgagattgtgccactgcactccagcctgggcgacacagcaagactccatctcaaaaacaaaaacaaaaacaagcaggtgctatagattctttaaaatagtattgtctgaaatctgagtagaactcagtgtttttacagtaccatattacaattttttcagcttaagtagtaaaaatgggaacaaacatcctcaacataaacttatcctaaagctgatttaggattggtctaagttaaagtattgggctcaagggaaagcaggtggtggtagagaacatcatttaaattatttagaatataaatttgaaaattcaatttctgtttgacatgcccaaacctgaatccatttccccctttgtctatgaatatgtaattagaggtttaataatgatggctatattttttaaagcatgggaaactgaccagagccttcaaaaacaaagtcaacatgttttgaaaattaagactgttagcatttagcctagctctagaatgcatccttaaaacccaattatcatggacataatactgtatttaaaatccccatcttcaactttaaaaaaattgttggtcataaagtccttgtgacattttgttaaatacccttgaaagtggtacaagctttacttgattgtttttcacatttataaggcagaaaaattcaatgtttaatagagaagtataaatacacattatgtatctcattatatatatcaatgtcactagtgaactacatttttatggcaatttttttcttttttgtgtcaaaatttaacaaaagataaatgcatgacccaccaatgcactgtagacacataaaattgttctttgattttgactgtgcccaaaatttatagagtctctttatatttacagctctttatcttagactccaaattaacaatccatttgggattgctgcacagtgtattctatctgcttcagttgttttctagcagttagtgtttatatccgttgtttaagctctactttagcatgtcctaaaagtatatcttctgcctttactattttaaattcttcattctctagtaaacaccaacttggatattaaacaagaattatttaactagtcacagaggtgaataagacagcatgatggctgttttcatggagcttagaatacacaagtgacacaaactaggaagcatgcagctccatcatagaatcacaattgtcatgctgaggaaacacaagacaccacgaacatggaattcacagatatcctgctatttagcgtactgcaactgggtcaaatacatactaagttgtgatactgaaagagaggaacacagaccatgagccaattttttacctagtcacaaaggaagaaagaaattgttcaaataactcacttgatctttgcttcaatagagtgtcagattatttaaaattttcttttatctataaaaatgtaagattcagtaacataaatatctaactaaactactcttttcatgtctttgtgtttccttaagagacagctcagtttacaatcctgttttttaccacttactagctatgtgacatttgacaagttttttaacctctaggtgactcagttcaccagataataattactgacttcatcaggtgtttgagaaaattaaaagaactcatggatataaaactattagaactgtattcatgacacaaagtcggcacagaacattatagttattttttcctcactgtttccaaaggccacggcaagagatagaatcagccatattgtttaatccttcaatattcatcattaacttccagaaaataagcattagtttaaaaaagcatagtgtaatcaagcataaggaaatatattaggaaaacttgtttagctaatgaaaatgtttatagtaaaagccatatgctaataaactcacaataactttatgtcattcaagtaaatatgaaaaactacaaaaacatttttccctatttaagcatgtcattactacatgtttttataatagactatagccaggaatacaacaaattaatgaacccaaattgagtggaattataagttgtgattcaagatgtttgcaatttatatagtaaattctttggggctcataaagacttaggttttggggggattaatgtcctataaaaacagtacacttagggttttgttttgggaattatatctcgagatctgcaactaaaatagcacaatattaagtataaacattacaggaaggctagtttctaaactaagcaatgttcacaaactgccactgatggcagtctgaaaccatatgggctttttccagctaaaatgatgatgatgatgctgaaatttcattttttattttgatattctcatagtattgatgcagggcaggcaagccccgaagtggagcttagcctgctgggttcttggctttgctcagggaagaattcaagggcaagacagaggtagaagaaaacagctttattgaagaggcagtgttgttacagctccatgactgcccctgtagagcagggctaccctatgggcaaagagtagcagctcagggcagttttgcagtcatatttataacccacttttaactgcatgcagattagggggcagtttatgcagaaatttctagggaaggggtagtaacttttggatcattgggtcattaccatggaaaggggcagtaactcccgagtgttgccatggcagtggtaaattgacttgacaggctggtgggcatgtctgatgacaagctgcttctgccccggccctgttttagccagtgcctaatctggttcactgtctgagccctgcctctggaattgaatcccacctcctacctcagtatcaatactaaaaactaaaatgttttataattttaaaacatgttaataactatttgatagtttaatatgttaatgaaactgaaagcagtcttgtcaattatatagaaacataacctatgttaaatatagattgaaagaaagcctttaagcttaacagaattactgaactctggtttcattgtaaacttaaatgtaatacatattgtaaatacctatgaaatacaatttaacatgtaagaaagatataaagaatcttgctaagtatctattcccactattttatgttattgcaacactaaaatataccatgccggatctgaaaacaaattctcagtaaccagtgaaatttgtttctttgatctgagaaaatcaaagttcatgatagtattctgagttcagtttgaagtgaagaacatgccatgccagattgcaaaagttggttctggatttaaaccatctttgacattatttaatataaacaatctgaaaataatttatactattaaaattattgaaaaggaaaattatctttagatgttttttccaaatactgttttaataccgattttgctgagaacaatgaccaagttcctaaatcagcaaccaatttttgcctaaagtaatttttaagaagtctgtattttatataaaggtgattcaaactttgttggcttttaaattttgaaatagtatgacttcttcacataattatctacaaagctataaggaattgttgatggcattctcttctaacttagatcctctttgatatcattatagtctcttctaaatataaaagtcattttgctatatcagcagggactgtctacaagtaccacgcttctgtgctattgttgtactgattaaagggttaaggccacttagcctttagtcctctgccttacatcaccacccaaggagtgctataatcctctagaaatgcattgcctgcagtgtggcactgcttaataaatcactccatcttatttatctttctcttgacatatagctagcagcaggaaccattatcctatgacaatgttaagttctattgacattttctcttaattaactacactaatttttacattggaaacaaacttcctttatttaatgctatcttaaacaaaggaagtgttaaacttgtcatacctgcatcatcataacatgttttgaaataagtgaaatgtctttgttacctttccagaagaccagtttattctgctgagaaaacaagtttgtacttatagaatcatattgcatcatttcttctaaactcattagacatcttaataatatataagagccccaaaatatatgtctgaattcctctgtgatacatatcccttcagtcatttgaacaaattttatgtacagtttcataaattgagaaaagcatttttttcagattaagcatgtcttacctatcttagaaccaagcattttgggtctaaattaaagatcattcaacagttagtgtatgtaatgtgccaggcactattcaagctgttggggctgtattcatgagaaaaacacacatatattcatgccttcatggagctcatcttctagtagagggagactggcaacaaataacagccataataaataaataaataaataaactacatatatcagaactcaaatgctatagaaggagtagttcagagtaaggagaattggaagtatgtatggaactgttacaattttcaatttgttgcagtaagcctctttgagaatttgatgttgaacaaaatcctgaaggataggaaggaatatactttatagatagatatctggaggaaagatgatcaggtatagggaagttcaaaatgcaaaggttctgcttgaagaggccggaagcatagtttagtaggaggtgaggacagagaggtccatgagttcagatgagattgacctttgtagactttcacatttactctgagaggaatggagaattatggagtactttaagcagagaagtgacaggacaaacattaagacaaatatatgtaattgtaatgggaggcattgacaaacttttctagagctattctattttccacatctggcatatttgaggatttaatatttgtttcaaaaaatgtagatttgtatctaaaggagtcatgattatattttataggtatacaaatgtatacatgtttaggtagatacatgctggttgcaaaatatacccagccatcgtacattttaaaaaactttaactccaagatctagccataatgttttctactctgcagatcagacacatatggttatccattttggaacacatgttaacaagtaaatcaagagatacgtctcattcccagctgtatttgtggtgatgactcctgaagaaggccattcttttctgataaatcttccctggtgcttttggtagagaaggtacagagagaaagcaaaagtacaggcattcttagtttatttttttcttctcaatcaacctagtttctttctgggaagaataaatgctatttcacaaaatcagtttaccagtttacttgaaatgtatttggaaagaaatatacatatatatggtaaaaaattctttgctacatcaaatcaatctactaataatgcctttcagagtagaattaaataaggctttctttttagaaaattcttcctgaaaagaaattaaattgaatatttttattatttttatttatttaaaatgtatatataccttctatttatccataaagatcttaaaatctgctaacattcataatagcagtgcattcttttgcttcactcacagaaaaaaaaatgaataaccttctatctccaatcttccttaccaaggccaactctttccatttaaacatttcttgatttttaaatttgcagtcatttggccacaaaaggccatctggagtataagattaaatagacactaggttcaaccacagtaggaatctgtaaactcagcattatcctccagaaaaccttcctttgaaaatgatgtacagttcttctattagggctgcacttaatctctaagctatcggaaaacaaggtcagatcttctgttgacacaggaaatagtgcaaccggtcccctgtagttattgcaaatagttgtatagattagtgacgtttctgaaaaactaaatatttttaaatgggtctttaatattcagtcctccaaatacagaaaaaggattaggttaaaaagtgaaaattaaaatgttcactatgatgttcattgatttttaatttttccttctgagcttgtattgacccaagtgacattctacaaatgctgacttaaattaggttaagcaagttgaaaattacatttgatgacctgaataattcattaaaaaggataagcatataaaagcctactttagtaacacaaacacattttttataataatgtaagatattgaatctggccacaaacaatgtccaggatggacacttttaagtcggaatgagtaactttcttgctactaaattatatacagtacatatttaactgatgaaccaaaagagagtaatttggctaagtaaaagtcattcccagcactaaaaggcaatttaacatgcatttacccccaggaaacttagaaaatgaacagtaattgcagaggtcaaacttgtaagctggctatacttacttgtttcactccaagacttgacagcgatgcaatttaatcctcaaatctgtgactacctgagactatcattgaattgagggagcttatcaactaagaaaattaaaaataattgtactagtttatagctcaggtgtagataattccatataccaaataaatattatcgtgatgtgttgtgagtttataagttaacatattacatacgtgtgtgtatacgcacacatatatcttatttctcctttaggggacgatctctccctgatttttcaatgtagtttcataaactttctaacactaattgacaaaattaaaaacaaatattgtgtaatgcacagatggcagaaagtaagcaaaagtgtatgatttcaaaaacaaaaatctacagatatattcttatcaatttatttttaaattttaagtattagctaaacagtcttattaagagccattttcatataaaatagtacattgttatattttcttttctgttatgatattgtaaaatgtggctcattcttagtgatattaaaacaaacaagtaacacaatgtttgttagacgtgcatttttgtctaatctattttacaaatcttttagcaatataattaaaaatatttgaaatcagggaattcaaaggaagtaaaggaatgagaaaagcctagtggaataaagatattataaataagatattaaaatatagatttaatttttaaatgggagcatctggcatgagtgaaataaaatgaaacaaacctcacggataaaactttgttattaaaactcttttccttccttcttttgcttctgtgcagatgatattttgataatttcctctgaaagtaactgaggctgtgctgcttcttatagataggctgcaaggaggggaaacccattatctttcaactcttaaactgtctcttcataagataagcatttcaaaaattgtattccgtaactccccttctagtttttatccctcagtttttagttgactaaattaccaaaaacaaaagtgatggggcaaattctataataggtctgaggggtctgaagactcaaatgaagcttacagagatcctaaccggatgatctagtacttttgatctttgatttggtgtgtaattggttatcaggatttgtttgctagaaaatttacccttaacacagagaaatgtggaaattttagcttgaaacaattctcaagattatacatacttttcaagtttaagacatattccttattcattacttaattcattgttatttcttctcctgaattcaatttttttttttttttttggagacggagtttttgctcttgttgcccaggctggagtgcaatggcgtgatctcggctcactgcaacctccgcctcctgggttcaagtgattctccttccttagcctccaaagtagctgggattacaggcacacaccaccacgccagctaatttttgtatttttaggagagacggggtttccccatgttggtcaggctggtctcgaactcccgacctcaggtggtccgcctgccttggcctcccaaagtgctggaattataggcttgagccaccttgcctagccttgaatttaatattttatttatgctgattgaagttagaattttggccaggcgcggtggctcacacctgtaatcccagcactttgggagactgaggcgggcggatcacctgaggttgggagttcaagaccagcctgaccaacatgaagaaaccccatctctactataaatacaaaattagccaagcatggtggcgcatgcctgtaatcccagctacaagggaggctgaggcaggagaatcattgaacccagaaggcggaggttgcagtgaaccaagatcacgccattgcactctaacctgggcaacaagagcaaaactccatctcaaaaaaaaagttataattttatcagcagatgatctctcagggtataacttttaaccataattaaagaaatgttagattagactttatccatatacattaaaaatatgaaatactactgaatatatagttcctttatttaaagccacaacaagagcatttcattcacatagctaaatgatcaatgtggtggatattctccgtatttatcaggagtttaaaaagtaaacttatcagataaaaataaggaaaaagaatattccagacatttcaaagtttaagctggtaaacagtgtgaggatcccatttttgcatatgaatggaacaaaggttggagataagactagagaaaatgttaggggccagattgcagacatgctcaggtagaacacaaagaaaatcgactttatgttacagaagatagatattcattaaagatgtttcatcatcaaactggcccaataaaatttatgttttaaaactgggctctttgcagacagtatgaagcatgatttgaaggttatgagacttgaaatagaatagctgaagtaatgcaaagctgaagaaaatcagccaccaccactaccacaacaaaaacagaagaaggaatagaaaagagagaataaaccagaaacccacacgacagggcttagtgcctgatggagtgtcaaaaaacagtaaatatattaatatgtatgcaacagtagtttcatactgcatgtaatgctattaaaattaaattactagtacatccttgacatctattttttcctttaactattttttcctgtaacattatttactgtctatataagactatattatttgtatgtgtgtacataaatataacttctttgccaacttcccttttattatatgtttatacaattttaaaaaatcattctagtggttcaatctttgtgcacatccatggtcattttctgaagaaattatcctagatatgcagcttctgagttaaatgatatgtatgcatctaagacttgatactttcagcttaacattgtaccatacttcatatttgaacatttcaacaattaaaatcacataagttttaatagactttaaaaatatttatttagaaaagtaatagtcaattaaaataatgtaaaattcagctttacattactgtgtcccactagatattgagaagaagcttaagtacattcaaacagttgaaactacttggacataaaacatgacaactctgcacaccttaaaaattacctaaatcatttggacaaaagtgtttgaaatttgttgctgataatgtaaatgttaaaaacgtaggcaaaaggcaaactgaaatttagctcaaacctttatatgtgtattgttggtgtttataaaggtataaaataataccatgtaatgcaagaaggctataactaattcatattgcttcctcagttaatgtcttcacataaaaactacccgagatgtctattttttgaatagcagcttgaattttcaaatattgtaagagtctcttgtgtattgccatatgtgcataaaaaatttctaagtctgtgaaacttggaaaaagcagcaaatacatatttttttctattttcaataaatttatgcagagaagtagggtgaatgaatgccttttgggaaaaggaaagcaaaaatataactcaccattttgtttgcatgtacaatttatacattgaaagtgctattcactagcatataatctattatatctaagattacataaaaagttatttgcctaagtaattaaaaaagaaaatataaaaacaatttataattccaatactgggtgcttagaattttcttatgattcaattaaaagtttatatactactactaaaatagagaaacgacaaatgcatttgttgagttatcactagaacatgaagttaagatatgtagaatcacagcctgcctcctagaacaactctgaggacagaattattcacctattacttctcttacttgtcattagaatctcttgtcattgcaatatcaccttccatctattttctttacatcttccaggatcatcaattcattatattggttatgttttaagttgactgctttttagaatcatctaaataacttggtctaagtaaattatttccaactcaaaataatggggagtttttctgagtcttatagacaaactcttattctgtttgttttaaatttatttgcttgaacctgccctaaatttttagtgtaggaagcccatgatctaaacctatttattctagtcattgaggagaatagagggagaaaacgaaatggaaataataaatcagaacccttggtggaagaaatggcgcatgtacttggaggcggagacaccaggaggcttcctaaattctctgacatatgtcactccctgcctggttttctcccttccctatgatagcctgtgatcatatattgtattatttccccactcctctatgatattcaccttgggttaggaagcccaatattgcttttctagtcataccataagcctgttgtgaagattaaataagaatacagttctaaaacacttaaaacaatgcataatgccttagtaaatacttaacaaatagaggctttcatattttgtttcctgacctttgctttgtaacctcctactctctgatcttgacctgagtttaataagttttttgttttgttttgcaacttcaccctgatccccttcctccctgagcctacttcctctttgttacatccatggttttgatttactgcttcagcccagtacaataaccttgtttcctgattttcctactgctcatcaattcaagtccctaactcagtgactccagaggctgtaagttgaaagtgtaagaacttcctggaaaaattattttaaccatttttaaatctcttattcaaaagaatatgtggaaaagaaatcagaatagaatcaatttttctcttcaactctttaaaatactctcctaagaacttaagcataagagctctgtaaaactgaaaattacggaagaaaattcaaaattaggaaagctgatattgttttgtaagactagattcataatgttaaatgattccctttttctctatcaaattataaatctaatgtatgctcaataaagtcattttaatttaaaactaatctccagtggtggttaacaggttgctggttttaaatgacattttggaggcttaaaaatgtattttagacttacttttggctcttttatcattaaaactgattgaaaatgtattggcattctctgaccttttagaactaatgacatacttatgcataaggcctagtttagtaaccaacctcagaaattccaaattaaaaacttcactttgagatccatttcactttgattcctgttgacaactgctgcttaccctttgaactttcatgcttctgggactggcaaaatgggtgcaattttcctcagaactactgattgattgaatctctgaaaaatggggttgctaatggcactagaatttatatagtggttttatatagtggcttaggcctcactataattattttaaaacattaaaagctaatggatcactacagagtggcaggttctgactcaactgcagtcttgcttcatgctgtttgacaaacgactagtcatctagacaatatttactgtttcggtgcctttcccagccctcatttcattgccaggtctgtggtaaaatcagtaggttaaaaaaaagtataaaaagaaaagagaataatttttgagaccttctggaaagtagcatttgtatatatgtaaagaatcatactatattccttattcaaaccatgcattgtgttcttcttttggttggttgtttactttattggtgagcaaataggcaattggtatacaatgatgtgttaaaagtagaaaacaaaacacctacagtgtaaatcaagtaatttaatacacagaaaataaataaaaaatacatgaaatgttaaatatggtggaagtgagaaaaacacagggatgatatataaattgtcttttaaaattgcagtgtatccctcaatcatactatctgaaagctttctgaagatattaagggatttgtttgaatatctttccctcttttcaattgaatttctaaactttcaaatgttttaattttgtagtattagataggaaaatgctttttacgatacatttaagcctttttccagaatcttagccttacacccttataaaatatctagcatatctaaagccaaaccaggaaagaaagaatgaggctacttggtttctcctttttattttttaacaaaacttctaaaatatcaaaatggaacagatataagagcgtgaatacaaaagctgaagatatttctaaatatatgtgtgtggttttgacaaaatgctacgtagtagaaacaatacatgtgatgggaagtattctgggagtcaataagtgtttgggacatattcctccattgtttttgaaacttatatcaatgttctgaagatatagtcttatttttatcattaacatttacaaaggtagttttgacagatactggaaatgagaacagaaaaagaaataaacaaatacatttttgttgcatataaaaataatgggaaatttaaggaagacatgtggcagactggctgtcttaatccattttgtttcactataagaaaatatcacagagtgggcatgatataataaatgaaatttattttatagttctggaggctgggaagtccaatatcaaggtgctgatatcttgtgagggccttcatgctgcatcatcccatggtggagggcagaggggcaagagaatgtgagagagccagagaactttccagaagtagccagagaacaatagaaagctgaactcacttttgtaaaaacctgcacttgtgacaatgagcctgctcctaaaataatgatattaatctattcatgagtgttctgcctgtatagcctaatcgccccttaaagattacatctgttaagactatcacaatgacagttaaatttcagtatgaatgttcggaaggtcattcagccatagcactgacccgttctgctttgtgctaaacctgctttgattatccattaatattgtgagatgcaaacctatgaattagtggaaatttcaatgaacagccacaaatactaccaagcctttcgaccaaaacattcaatttcagatatttagaagcttgtttagaaacactctcttaaaacagataaaagaacttctaatttcaatgtcatttcagaatctataaaaaagtaaacttaccaattcaaaatggatttagcagtcccataaaaaagaactttgctaattaatgttctggaaaatttatttgcctgacccaataaagttcttgtataacaagctactttcagtggatattagtgcatttcattcatactatgatcagactgtccagtagaactgaatgcaaagcaattagtgcaatggaggaataaaaggctttattaaatgagacctagagatagaatttacagaaagggtttctaaatgctatcactgccactatgcttggagacaggaaagttaatcaatttgcggtggggaattaatgataaacattatgtgtattactcacccatatgttcttaacattgcacttaagagagtttatatttcaatgcagcacttacctcagtattttttactgttacttaacatacaactgtgtcaaattgtaatgtagcccaccttacaaactggaaacctgaaatctgtgattgatgttcaatgggctctttttttccctagctctttagaaacagtgggaattttatacaggctagagtaacaaaaacattgtgaaagtaagaaactgccaagtaatatgtttttgtgtaataaaattcaatttagttctaatatgagttatagcaattggcacttaaaagttaagttaaaatcagcatgtaaggtttatgtgtggtaaccagcacccgtttaatttgattttaatttttaatttagcatttttcatatctgctcatcagaaatattttatggtattgggtctggtaaaataaacttaactgctggtattaagtctgaagtttcaaaaattataaagatcgtctccttctgtaggaagttctaatttgaaataacatatttttatttgctcagaacattcttattttaagtaaatatgtatagatggcatttgtatgtataaaagaattctattaattttaatagattaaatatgataaaatattaaattatataattaactacataacataaaattaactaactacatattaaattaacattatgttaatgttaagtataaacattttatattttaactgttaacattaaaatatattaaaaactgaaacgcattattcaaccaacatggaactcttcaaactagaaaagcacaaataatataaaagtggtggaaagaaggaactgctatttataagctttacaagtatcataatgcctatgacatgtaaatattaagtcagagaagtctacaggaaattttcatttcaattacatgatctaatgtcttgtagccttcttttgcttatttgcaaatagacctatagccagtccataacaatatttagtcatttaaaaccaactgaaataacaattatattagtcagattatcaagagagacagacccaataggatacatagaggcgtgcattgaggatattgcaggttcagtttttgccaccacagtaaagcaaatatcccaagaaagtgagtcacacaattttttttaattttccagtgcatataaaagttaggtttacactatactgtattcttttaagtgtccaatagcattatacctaaaaagcaatatacataccttcattttaaaaatactttattgctaaaaaatgctgatggagagacatgaagtaagcatgtactgctggaaaaatggtgctttgcaacacggggttaccacaaagcctcaatttgtaaaaataagtttgtaaaaaaatgtgtgaagtgcaataaagtgaaattcaataaaatgaggtatgcctatatatagatagatagagatgtagatatagatatttgagtggggatttattagagaaattggctcacatgattatggaggctgagaattctcatgacaggctgtctgcaacctagagattctgaaacactaagaaaagcctcaaaaccagggaagctgatgatgtaattctcagtcccaggccaaaggcctgagaacctgggagtggggatggggcggggaactagcataagtcctggagtccctaggccagaaaaccagggatcctgatgtccaggggcaggggaaaaactgtgttttagctccaggagacatagagagaagaaatccttttctctccttttttgttctatctgggccgccagctaactggatggtacccacctacattgaaggtgaatcttcctcactcagtccactgagtcacacaccagtcttctctggaagcccccactgatacagccagaagtaacgttttaccagttgtctgttcctgaatccagttgacacctaaaatgagccatagcaaaaatagagaaatgacattacctatcactattttttcaataaatcatgttataaaatgtgcttgaaaattctctttacttgtataagatataaaaaactaacttcattcacaaaatagcttttcttcatggattctgtcaaaagaaaataagtcaaaatatttaaaacattacatgtttgaagatgtttatagcaatgtaatatgtgatagaataaaaatctccaacttttctaaactaggagaatacttaaataagctatagtagaactgactgagcaatatcattcagccattgaagatgtagtaaataggatacaaaattgtatgtttgacctgaccattactactgaaaaatcacattaaaaatgccaaaaaaggacatatcaaaaaatgctaccttgaccccttcttcagtattgggcttctgaatatatacactgggttagttctgggaactagataagaggttccaaattcccactcagcaattgaggctagatttctgccttcagatgtggaatttttctatccatacatatcaagaagcaccttaatggtttataaagtataacctgtaattaatagattgtatattatgtaaattatgtaaatagaggcacctattttatttttagggtcactgtgatcaataagctattactatagttctctgaagataatacacttcaattatcactgagaaacagccatgactcactgtggtaattttacctcatctcttatagttagtcatccacaccacgcctttacctgggatactgctttcattttggatcaagaaatgcaatttattgcaggattccccagtgttatctgagacttcagaggagaagcacacagaactcttcagagatacttgtgttctgcccccttccatgcattttttaatgtctttgtgtagggattggccttctcatgtaagagaggtgaccaagtttcttggaacagattcattccaacattcccacctccctgaatctctacagtaggccagggaggttgtatataggttattttcaaatttcatgcatttttggttcattctttaattagccaatctaatgaattactaccaccccctgcccaagtatcaagtcagcacattaaatcccaaatctgaaatcttaccacccatgacaatatatttgccctaatagatacttaatgtcatactatttggtgtaaacttttataagtgggctttatacttctttgactcaattattttgggacctaatttgtagcatggagtcaataaggagtaacgtggtgagtccagaagagatccgtgaaatttcctatgtcaagttattgaaaagcatttgtgcagaagaaggctgattccctcagaagtggtgagaggttgcttccaataacaagaaggttcagaagaatttgaaagttcaaatttcttatcaatgcatgagatatcttatatggcagaagatttaatcagcaattaagctgtgctacagtcaagccttaatcttgtcctcagcagtatctaccctaaaactacaggataaagagagttcttcaaaactgccatcaagatattaaaattttaccttatttctgagctaggcattcatggccttaagtttctcatttgcactctgtattcattcggagacttcagagcagttagctggaaccataatcttcaaaatcactattattgccatggccttgcattccacctgcacttcattccatgccaactctggtggttatttaaacaattgtaatgtaaccacaggctgtaaattgtcacagttccatttcccatcaatatgtgctacagagatatgggagcaatccaatctcagaatctcatttttatggttctgtttcaattactaaatttaagaaggaagtgtttctaggagggtggagagggacagcaaaaatgagcagggtcagtgcatcttagatcccagagggattgcaggcttgatggagggaggaaggtcaaaagattgaagatggcataggagattggaatgcttgaaattcagattacagaagggtttatattattcttaataatggtaatattcactaatgcaacttaaaaggaatgtcattgcattcaatagaaaataactataaaatacatttaatgtaaatgaaacattgaatacaaattagttccattgaatgccaaaaggagtttgagatttgaattttctttgtaaaagtaaaatcaaaatttcagaaccttattatctgaggctttgttcttaccatgatattactgggtatatacccaaaggattataaatcattttactataaagacacatacacatatggttatcgcagcactattcacaatagcaaagacttgaaaccaacccaaatgcccatcaatgatagactggataaagaaaatgtggcacatttataccatgaaatactatgcagccttagaaaagaatgagttcatgtcctttgcaaggacatggatgaaactggaaaacatcattctcagaaaactaacacaggaacagaaaaccaaacaccacatgttctcactcataagtgggagttgaagaatgagaacacatggacacggagggaaacatcacacagcggggcgtgtcgagggttgtggggcaagggaagggagagcattaggacatatacctaatggatgaggggcttaaaacctaaatgacgggttgatgtttacagcaaaccaccatagcacatgtatacctatgtaacaaacctgcacattctgcacgtgtatcccagaacttaaagtataataaataaataaataaataaattctaaaaggtaattgtaaatggaacaacttactcactgtaacatgatgtgatttttgtgctctctctccctaccacaaaaagccatctcttatacccatgatagacatgtcatgttgtagaaaatctaccctagcttgcaaatgggttcaatatagtgaacccattatcctgtggacaacaggaaaccgcacttgtatctcttgttcacttccttattacccccacatcttctgtcaaaaaaataaaacacttacagatctggtcacagtatctctcaatttgactatcaataaactttaagcaatacttatataaaggtgactggcataaatgaagcatttcagagatgatatatacattatctcctcctatctttaaatgtagaatatgcttatgctggcaatgacttccacacaaattccaacaatatcatctttctttgtttttctacattgtgattctgtaagtgtaaaacacgctaatatttatttacattttaattgatcagcttacatgaactattcagtcagcttgaataatgaaaattttctatttactatgagtttttagccattttgttagtaacctgtttccaataaagatccaactcttgaaaaaggaatgtttatttttttaaaaaaggtattagttttctcccatttttttctaattataatttataaaataatcccaccattccagattacaaattaaaaatgttgtgagtgtttaaacctataagaagtggatttaccaaacaaccaaattggagactcttcaacaattaattgctttttcatatttcatggaaacacaaagatgcatatatactcacacagaataagacttagaataacaaatttttgcctgactcagatggatttatcaaatttcccaaacttgcctgaagaaattgcttatttttaacaacttttttaagtaagctaatgtatacagtagcaaggttaatgtagtttttcatgtggtaaaacaatcacatcaaaatgaaaatctggtcaagaggattttccttaaaacagaggggtcctttggaaaataaaaatttttcatgctttagcagagcactttaaacttatcaagggctataggaatccaaatacccaacttcagagtcagacctttgcacactctgaagtgtcatgaagtatcagcctaatttttgcaatacttttttagcaaggtgagattatgttttttttttaatttggcacataattattttgtcctttacctaattctctcttctggcatcctgactctatgaaaatgcatattttttttctaattgtggataaaaaaaggagaaagaaaacaaatatcattattaaattcactattctctctccttattttcttcttttatttagtttttaattgtgaagtattatttgcctacagaaaagtacgtaacatattgtgcagctcaatgaattaccagcaatggtccacctgtataattgccacctaggaaaagatagaacattaccagtgacccagcccccatttccttttcctcaatcatttttcactcttcccaaaggtaaccatccatgggatcatcaacactgccattcatgttgcttgcttgtgaacaattattatacagtgtgaattattttacccaacattaggttcataaaacccattaatggtgttgtttataagtgagatttgcttgttttcattgttgtgcaatattttattgtttgtgttcaaaaaaaaactttagatgaatgaaatttaacagagttgaattgagcaaagagccattcaggaattgaggagcccctcaaaccagataggttcagagcaactggggggctgccacaagattagataatatttatggacagaaagaagaaagtgacatacagaaaatggaagtgaagtacagaaacagctggattgattacagctccacatttgccttatttgaacacagtttgaacagttggtcacctatagttggctgaaactctgtgattggtacaagagtaggttacagtctgtttgtacatccagttaggtcacagttcactacgcatgaagaaaccttgaggccaaacttaaaatatgtaaggaggtatccagtctactctcaaagtatgtttgggctgtttccagtttagactattatgacaatgcttctacaaacatttctgtctcttggtatgtacattcatctagtgggtatgtacctaatgggggaaatttctgtattctaagatatgcatacgttagttttcagagatcatttatcagaatgattgactgaaccaatttgcaatcccaacaacagggtacaagcattctgatagtcccatgtccttgccaacacttgctattgtaaatctttttattttaatcattctggtggctgtggagtggtatttttttattttgtatttccccagtagttaataagattgctaccttttcatatatttattggccattggttatcttcttttatgaaaccacctatccatttttctgattgttgtctcatttattcttatagatttataggagttaatatttattgatgattttttgttaggtatatgtattataaatatcttctactgtggcttgtcttttcactctctttatggtatctttttaactatgaagtattattgcagtcaaattatcaatcttttcttttgtgttaatgcattttatgctgtgtttaataaatccttttctacccaaacttgtggatatattctcctatatagttttctagaagctttattgtttaccttttatatttatatctataggctgcatggtattaatttctgtgtatagtatgagttaagagacaagtttcattatttttcatacatatatctaattaacctagaactacttaatgaaaagacctccctttctctatagtacatactttagtgccagctgggtataaatcaagtgcctatgtatgcatggacaactttcatttatttatttggtttatccttgtacaactaaccaactgtcttaattactatattaatctatagtcatcaagagccagtttttttcttcttcctgaagagtatcttggcaatttttgtacttttgcaacttcatataaactttacattcagcttcaagcacatttacttgtgcacacacacatacacacaacctgggatttttaattgggaattcactgactgaatctatagatcaatttgaggagaacttatatctttacagtattaagtctctcaatcaatgaacatgctatatcttcatttattgaatcttcctttattttactcaaaaatagttttatagtttttcatgtagaggtctctcatatctttaaatgagtttgttcctagttatttgatcatttaatgctattgcaaatgatatgttttttaattctatgttgtcagtgttgctgttatatataaataaaatctttttttgaacactgattctgtaacatagcaagctgataactaatttattaattttagtaatttatcctttgttctcttagattttctacatacatattcatatcatcactaatccgtaacttttgtttcattctttccaattcctaaatacttttttctgattttttttcttggactacagagtctagcacaactccaattcaatgctgaatagaaatgttagcaatttgtgtcctttaagacagtcaaaaatttttattttattagtatgtatgatacttgatatagattttcttaaagtactctttataaaaataatgaacactttttaaagtttccaatttgctggttatttctaggtttgttttggttttgtttttctaagactggatgttgaactttatctgtaccttttcttcatctgccaagatcatataatttttctcttttggtcctaaagtagcgaattacaatgattgatttttgaatgccaaaccaatcttgctgtcctataataaaccctatctgtttatttatgcagttctccgtttgctaatttatttaccttttgaatctacaatcatgtgaaagattggcctataattgccttttattggaataactttgtcaggttttgttatcaaagttgtgctttctttataaaatggattgaatagtgtcttgcttttttctaacttcatgaagaatttgtgtacaattaaaattaattactccctcatatatttggtagattttgttagtaagaccactggccttacattttgtggtgcgtaggttttaattccggatttgaaatctttgatagttacaaaaccattcaaattttctatttctttggggaggaacttttttaggaacttgtccatatcatcttaattttcaaatttattggcataaatttgtacataagttatccttctattatctgtaacatctgtaacaatgtacttttaaaattcctgttacatttttgtgtcttcacttattttccttgtaagtttcaacagcttattttggtctttttaaagaaccaaacttctgtcagatcaaccttttaattgcatttcttatctattttgttaatttttgctcttaattattttcttccttgtacttgttcacatttaacttgctgatttttttcaacttctttaaattgatgagtaactcagaatacttttcttatacattgcaggctatcagtttccttcaatacaatttagctgcatcccatctactttcaaaacttgtgaaattttgatatggagtatttttattatcatcctattcaaagtacttttcatttctctggtgattttctttgacccatgacttcatttatgctcatttggggattttcttgttgtctcagtcccaccctcatttggcaagccctggaccccagttttattaccacctaaccattgaatacttttaaagtgttcctcagtttgttagtttcttagctttctttttttaaattggtatatgcccctcagggaaaaccatttccaaatatgaagctatctttctgggttattttcttctccaggactctgggcctataaatttttactgcctctttagctctgaaaacacattatgtattcaatttttctagttgttgtcagtgggaggattgttctgaatggcttcatccaccaaccattaccaaccattaccaaaattggaagtcaagattcccattacttttaatatttgattcctaaatgtaattatcaaataacattttatttgcattctacaagaatatttgagttccttgagttgcaatttttataacaaagattaaaaaactcaagtatgcttttatgtgggtgataacaactctaatcaaggctaaaactttaatagaaatgaatgcccaattagcattttcattcataaatttattgttctaattttgttatacatattaacatcttttagtctttggctatcatcttgttcacattttattattattttttcaattagctattttgaccagaaaatcctcatatggatgtaaaaataaatattttattttgcttttacctttcaaaagctgggcaaataattattttgcttttaagaagaaggtatctaaaatgcattgtaacttattttgaaaaatgggttccagatatcagaggttagcctgttctgaatataatacatcaggggaatagcttagaatataaccaaagggtgtacttaccccacgtataaaatttagacatattacgtagtgggaactcgtggttgtaattaaaatatgcctgatattatagtaaatcgaatcctgttaagtcattcacgtattgatagaactacatgaaagtagtattgtatctctttatttccaccgtgagtataaaactaacttcttttagaaggcctattaatagttcacatatagcatgtattagtctaataatattgccataaaaaataacacagactcggtggcttaacaatggaaatttatttcctcaaaggtctagaggctggaagtccaagatcaaggtgtcagccagtttggtgcctcctgaggcctctccccttggcttgcagatggtcaccttcttgctgtgtcctcacatggcctttcttccatgcatgtgcatccctggtgtctcttccttttctgataaggacaccagtcatatcggattagaatccatgcttacaatctcactataccttgattacttagttaaaggtcctatctccaaataacaatcacattgtgggttagaatttcaggacatgaatttgagagagaaataatttagtccataacacagcacatattcattcaaaaaaacattacccacttaatatgggacaaggactgttcctatatcaaaaattataaaggacggaaataaacaaaaatgtttaaagcctaatacattgttatttttaaaaagataaaggaattggcagtatagggttgtggggagttattttagatagagtggtgataaaagattgttataaaaagatatcctctgagcagaaacctgaaaaaattgaaggaagacggaatttatgaattatagaggagaaaattttaggcataaccatttgcaaatgcaagggccctgggacatatatcggcatggctctatagaggaaatttcaagaaagccattgagagaatggtaagaaataaagtcagacaattgacctaagatcagtatacatagagtcttgtaaaccttggtagagatttttattttattttttaaagagtcctgggaagccactggaagctttgataggggaatcccattgatctgattttcgtttataaaggcaccatggtaatagacttaggagaggtactctctagaatgtaagtaaatggggaaaccacataagtagttcagtagtagagtcaaagatgtcatctttgaattgggtgtcagcagtagacaggatgagatgaggtaggatttgggatgtaatttgaatgtaatggtgacaggacttgctattgaagaagatgtttgaaaattcctatttttggtctaagaaataaagtaaatagtggtgctattccctgacatggtgtggactggcttgaaggagagttaatttgggagtaaaataaaatgagttctgttttagatgtcataagttagagatgcatattgaattgcaagtgagaatcatgtaggcttttatctatagctctctagaaagagtcaaggtagggggctagaaatgtaaattctagtgttatcaaagtatactgtagatcatagtcaaagtcaggggactcgttgatattgtccatggtgagactatggacagagaagagaagcagtctaaggactgagcccaagaacactccaacatttaaaagatggagaagaggattctgcaacaagattgtaagagtaggaagtcaattaaaagtagaacaaagcaagtatgtgatgctgaagccaacactaatatgtgtgatcccatgatcattaacaagctatgtttctagagaatataacaaaaaataatcctttcaatattatttatttaactggaaatctgaaaatttgtattaaatataggcatagcaatattaatgtcacctaactaatgaataatcaagcccttggaaagaaagcatatacctgtgattataataaaaggtaattaattatagggttgaacaggaagggggaagaactatcatttaaacatgttatactaaatatttatcatgcttcttttggctgggtctttcataatctcataaaagagaattaaatatggagtgatgaaaatatagagatctatgttgatgttaagcagaaaaaattctcactacttgcaagttaatttggtgttgaatatagatgacttcagatcctcaataaatactagttgatgttctttttatctctttgcttctttctacaggcggggaagtcccgtacacgactctggctacccgaatgatgatgggggcttggtggctatttgctttgattgttatctcatcttacacggcaaacctcgctgctttcctcactattacacgcattgaaagttccatccagtaagtaaacaatgtttccattagccacaaaatatgagaaatgataagagtggccaaagctatctgagaataagtatgtggtgtctcataataaatgtacaacttctctttgagtaaaggatcaattttgtgttactgcaaagtatcactgattagtccaagtcctggaaatgcagtattggtagagcattttttataaagtaaaaatttggctatgatttcaatgttgcttcccacattttcctggaaggataacacatcttcagaattttagtgtccacaaagaatgactatatctgactaacactgtgaaaaggaagaaaaaaaagagtcatacttaaaaggaaatctttgccttgagtctgtcccattatgtactgtcagaataaatagttgaatagatacagatgtttgagagatagacggatgattggggattggggagaaaagaaaagggaggggaatagcaatcaacagaaaattatagtatttcagtaaccacattctgtttttctcttcattaccttatacttcatgtggtccttattgctgctatttactggttgcagttggaatgctgggaaatagtgattaactatggtgcacttatttaatcctaaaagttacctaagccagtgtctcaattcacaaatgccatttccgtaagcccgtggagcccaagggccttttatccaccacagccagttttgcttttgtggtttcatgctataagatcaacaccacagtataatttctgccttattagaacataatgttctatatattgttttaagaaaaattttcctgaaaatgttttattcatccccaaacaaggtaagtttgaattttcctaaagttggacattcatttcccaaaaagctgacaattcaaattcagaataattagatatgtcagggaattccttaggaatgtaacttgtttggaaaagaaaatctgggtagttattttcttttaaaaagaatgtaaattaaattcattagtagccacaaaactattatagcataataccaaaaaagttaagaattaattatctataaataaatagggtattattttctatttgctcattatacaaattgaaactcccatattcaactagtaatgctaataagtagtcaattattttatccattcataaaattgatgtttctagtttctctcatgaaatcatgctgctcaagttgttttccaattattcctttgatacagaaccttcatattcccccaatttattgtccatgtaaatagatctatgtgtgacataaattacaaatcatacagagtgaaacttataccattgatggaaagcttatactggtgaccccataagcatcatactttaagcaatatgaaaatgattacaacagcccagccaaaagatcaatgaaatgagtaaaattatgaaaataataataaacatttattgatcacttacaaaaagccagattttgtgatgcattagcttatttaaaacttactatcatcttcaaaaatacatactatgaataactcattttataaatgacaaaactaaagttgagaggataagtaactcacccaaagcctgcagctagtaagtgactgagtaaagaccaaatcttaaatctggttcctgagcctacattctaactgcatcatgttagttcccacaccacacttgaacttgaatttctgtatgaatcttaggttttagagaacacaagaagaaactcgtcatagcattttccattgctaagggatgtaaaggatgaaattctccaaatcctcaactggtctgaggaaatagagtatcaaaagttaggtgacttttgtgttataggcatgtaggcatatatcccaacatgagttaattatgtctataattggtatctaccattcagggtaagactttggcaaatccaatcaatagaagtcattttaagaaaaatagcttaattgtcaaataaaaattgtacatatttaagttatacaatgtgatgattcaatatacatatacattgtgaaataattgacacaatcaaatgcaccacccatgctgtgcattagattcccacaactggttcatcttctgaaagttcgtaccctttgaccgacatctccacattttccctatactctagcccctggcaaccaccattctactcctgcttctacgagtttgacttttctagattctacatataagtgatatcatataatatttgtctttctgtgtttggcttatttcacctagtgtaatatcctccaagttcatccatgttgttgcaaatggcaaatagcaaaacagtttttaatcaataaaattgagtattttatttcattaacatatttcttatcaattatgttgaatgtgtcacattttgggtatccttaaagctcaaaatttatgtagttcacatctgactttgaagtgtttttaaataaataaatcgtaaaaagtttaaataaaataactgatcctatgcagtaaacaacaactgtcattatagtaaacaaaaaatcatggttaacattgactgagaatttataatgaaccagaagttaagcatattacaaatatcatctcatttattccacaaaataaccttaataatacaagtactcttcttattgccattttatggatgaagaaacagagtttggaagataatgcttaagattacacactcaataagtgtcagagttgagagtccaatccatgtcaatcagacaccaatccgtggccttacctgtcaaattcttttttttttcttttttttaatctagtggtgggtcctagaatttgtttgcttgatatggtatttctctgaggttgcagactttgtggtgtctgtaaatctgagttatttagttattactaactttgccagcaccagtttttatctagactttcatgcaatagcagtgggaggagaagcctgtctcaaatttttcatccataggtttatctaaaagtaaaacctgatggaaaaagattgtaatttcacatcatgtttccctcaagtgtagttctactgcccaaagtaactttgcattcatttttttaaaaaatcattcctttccaatgccaactggcattattaaaagtcatcagtgggtataataaatctctacttccttgtaatattatcactggactaattttggaatgagagaatcagagccaaataagttaaaagaagccagattccctcccgaaatttaaagatatcttctaatttcatgcctcaacagtgttggtaaacataattgcctgcagtgtttcttagaaacattcaaaatctcatttgtaactaatgccaaagtttcttgggaaaattctaatttttcttagaaaagacaaactttttttcaaagtagcattcaatgtcatgcttcttaatcatttatattaataagatttgctcatcaccaaatgaagctgcagtgcatgtcaatgtactatttccagcccaattttgctgtgccattggcaaacacatgccaaccatagcttcatttccaaaattcagcgttgcttctgcagactacaatgggcagaggtggttagaggaatgtcagtgaaggggagagagagagagagggagagaaatcagcttctttgaattgatggttgacagaaactcttccactttgctgggagcaatctaatagatttattttggggaagctgaataatttcataaaattttaccttgtttttaaaattagatatctatgggcatctaatctaactggcacttgttattaataaaagttttgaaagggaattttccctggaaaagataacccataaatttaatttcatatcccttcagtgatatgggcagcacatcataactatgtcctatgtttaatataatataatgagacagagtatgacacagttcagttcttaaagggaaaaaaaatgccatttccacaagactctaatgacaatttgggctttttcattcccattgagaggtaacaacatatagttaattgttttcaaacacctagaaattggaatgattttttttctcttgataactagactaatagtggcaatggtgaaatggagcatgtgaagctttgaaggtacttcagagtaagcactggataatagcatcatcaacattagttctgtttgcctttattgtgatattacttccaaaagctacctagttcacataaaagtgaaaatagctatgggaaaatcagggttacacagttatagttattaataactttagaatcaaactggtctttggtgatgaaacttgagttttttcattcccaggagctgcaagtaaacttggacctactcaaagggatcccaacatcccaccatatttttgtgttcagtgctttcattctccataatgcttaaggttggactaaacaaaatattgagttaattctgccactgaatctaactaatatgggatagcattgctttccaaactgatacagaaagagatccataaatattctattactaaagaagaaccccttttccctagcatatcaataacaggatttttgccatcaccttggtctacattttgaaaagaaaataattattgagcaatttttttctaagtgttcacaggtgagtatgatctaattatgcttagaaattcaagcatcaccaaatctggtactaaagcctggagacagagggaaggatagcaagtgacagatgctctgtaaagaaaaggaaagtgggactaaatcatcgagggcatggtaagacttgttaaggaatttggaatttttcctggaggtaatggagagtgacgttgtagaaagacaactttatctctggagaggaggacatgtgggagagagaaaatgtaggcatgcatgggaggccgttaaaggtgtctaatgcatgtatatttacagcaattaactagtatgtctctacttgatacgaatatgtctctacttttttcaagggctacttaatttgataatactagaggattaagggtaacttagaaatttggcttcagaaacttcatatttctaggctaatatttacttatgtagtggatgtaagaatattgcctcagttaattttgtttaagatatttaaagagaggatgtggcttactatgttttagctaactaagtaaaaaggaagacagtgattaatgaggaaattctggaaatgactctgtttaggctgcgtttcacatgcaattttgcagaaaagttgcatctcaaggtctactattcgtgggccccatctgcctctcacttttagctttgagccatcaacaaagaagttagacttatttttattccatttgaatgcatttttttcctgattgtaaaaaaaaaaaaaaacaggctgttttgagaaaataggaaagtacaaaaagatgtcgaaggacaaagcattaataatccataaactgtcatggggcagtaagttctgttaatatttggacaaactttcttataacttttaattttgcaattattatatatacacaggaagtttcaaagatatagtacagagcagtgtcatgtattcttctctcagttccctgaatttttgcatattaagtgattatactacaaaattaaaaccaggaaattgacattggtacaatgtgtgcaaattgctctatgacatattattacatatgtagactcctataatcaccactgcaatcaagatacagaactattccatcacggcaaagatctctctcattctacccctttatagtcacattcacccttccttaccaaccccaacctctggtaacttactgtgttccccatttctgtaagttttgcgtttcaagagtgtaatataggattgaatcagagtatgtggcctttcgaaaatggctttcttattgattcagcataatatccttgagatctatccaagttgttgtatgtaatagttcattgctttttattgctaagtaataatccatggtatggatgtaccacagttggtttagcaatttacttactgaatgacatttttattgtttcaagttttgggctattacatataaagcttctaagaacacttacatggcagttttctgtggattttttgtttgtttgtttctctggcataaatgcccaggaatacaattgctcggtcatgtgttaagtatatatttgttttttaagaaactgccctactaatttccagagtggctgtaccattttgtgtttccacctgcattgtatgagagatcaagggtgtctgcatctgtgtcagcatttggtggtatcatttttttttttttagccttgctgataggtatgtggtgatgtctcattgtggttttaatttctattttattattgtgtagtggtattgaacatctgttcatgggctcatttgtaatccttatcctcttccatgaaaggtgttttcatgctttttgcctattttctaattgggttgtttactattaagagttcttcacatagtccagacacaaaggctttgtcatataggtggtttgcaaatattttctcctagtctgtagcttgtattttcatcctctttatagggttcatcatagaacaaaagttttagaagttgatgaagtgcaatgtatcaattttttcattttatggattgtgcttttggtttcatgtctagcactcttcaataagtccaaggtcatgaagattttctcctatttcttctaaaagttttatagttttacattacacatttacatatttgatgcattttgagttaattttgtataaagtgcaacgtttaggttcaatttttcactatggatattcaaatgctcaagcagcattgctgaaaagactatcctttcttcattgaattgttttgcacctttgtacaaaaaaaaaaatctgttggccatactatgtgagtctgtttctgtgttcctaccctgtttcattaatctgtgttgtctatccctctgccggtaacacagttttgattactgtagtttgagtagagtgattcttcccacctattttttcagaatcattttagctattttagttcctttgtctttttattataaattatagaataatcttgtctatatctacaaaaatattgctgaaatattgacagtaattgcattaaataaattggagtgagaattcacatttttaatatgatgagtcttctgatctgtaaacatatgtctccccacttatttagatctttgatttattttatcagcactttataattttcattatacaagtcctgtacatgttttgttagatttgtgcctaagtatttctttttctcagtgattacaaacgttcttggtatctcgatccatttgtgctgctataacaaaatacctaggtctgagtaatttataaagaatagaaatttatttcctcacagttctggatgctgggaagtccaatatcaaggtgccagcaggttgagagtctggtgagggccaggtttctgcttccaagatggtactttgactgctgttctatgtcctcacatgacagaaaagatggaaggtcaaaaggggccaaactcattccatcaagcttttttataaggaactaatcccagccatgagagcagagcctttatggcctgattgtctcctaaaggtccccctcttaatattgttgaactagggattaaatttcaatatgaactctggaaggaacccaagtattaaaatcatagtaattgaatttttaattttaattttcacatattcattactaggatatagaaatacaattgttttttgtctgctgattttatcttgtaatcttgctaagctcatatcttacttctaggggtttttggtagatcctttcggatttcctaggtataatttgtaaacttactaagctcctttattagttttaggagtttttggtagattctttggatttttctaggtatagcttatgccatttacaaagtcaggtggttgtatcatttttctttctcatccagataccttttattttctattttgccttttctttgctggatagaatttacaatactatgtcaaattaagagtagtgagagtgaatatctctgctttgttcctgatcttgctggaaaagcagtctttgaccgttaggtatgacattatctgtaaagttttttattgtagatattatttctcaaattgaggaagttatcttctattcctagttttccatgtgtttttcgtcatgaataggtgttggattttgacaaatgatttcattttttattgattggtatgctcgggtaatttttctttattagcctgtttagtggattacatcattcatttcaacaactatttttaaaacaaggtagaggctaactatattccccgcttctatttcttctccatctttttctccaagtcttgattttctacttgattttcttcccattattgattcgagtcaataaaatatcatgactgtccctgcctgctgcttcacatcttagtttcttttcccttaccttaactattgttcctctttctccattctcttcccaatagagtttatccactggagtgtggagtccagactgttaccttctcccatcctcaaaattggcttgaaaaactttattattacttcatccaataaagatgaatacaactccattagcaaagcatattgagcccttctttcccacccacatttctgtccaggggcaccaacaaattccttctcactttttcatgctacagtcaagctagactcttatgggaccttgcatgcctctctggagctttacatgctcttctctctccctgaaatcactcaaaacccccttctcttccggtatcttccattttcccaggcagaattagccattactacacatgtgccttctctttgcgattttaagttcttcaaaagcaaagactatgttatatccatcttgagaggcactgctagagtgcctctcagagtacctaacaatagtatgaataagagcagctaatatttcttgagtgcttgctatgtgacagctagttttctaaatactttgcatgggttttctcatttagtcttcgtaatagccccatgagagatatgttattatcatctctattttatagatgatgaaactgaagctagggtagtaaacccaggcaatctagcactataactttttaccaggggaacatattgtatgctaattacaaatacgctaaacctttattgtatgaaataaataaatgaataaatggcatccataagggttactataaatttcttaggaaataaagagagctttgcagaaaagaataaatggcagcagtatgtttagctaagttacttccaggtatttctaagttatgtggtatgcaagtcagtaacgggagactggattcaaacaaatctgcattcgaattctttgccacttaatagctcaatgaccttgtcaggattccataattattataaaccatattttcctaagagtaaaaaagggatagattcaacttcataggtttagtgtagtgtttagtgtaaagattaagtgaaaaagagcatgaataatataacacagtccatggacagcacctacctaacatttgcttccattcttctacattttctctaggcactcatatagattccttggcctgtctttctctctgcccccattttgatggtatttttgtcattttgtccacaattctatatattaattgttcctttgagctgattcacctaaatctcaatgtttcttgcttatggagctactgtttctgacacagatgtcaccatcctaccttacagtctatcttgctgagggttgtctttttgccctgctgcttaatcctctcattttccccaaagataaaagcaaaataaacaaacaaaaatctgatgcatctgcaagccttatctgaatttaggcataaataaggtcttggaagaatgattcactctgttatctcaccttagctagtgactaactagcactgagatcaggttgctactaatagagactggcaagacccctgggtcaggatatatatttgccaggtaagttttctctcctaactcacctttatttagccctctcataatacacagctcaaatactcaaatatgtccttgccacatattcataactatatttagtgtctcccttttttgaaccacttcacatctacctcacttacaccctgtattggaatactattctacttgttttacttccctattaaaatgcatattcttgagggttgttttatcatctttgtaccagttcagtgccttatgtagtgtattgtgtgagtacttagtgggttacaagtaaatattcactcactgagtgaactagaaagacattttttagaatctgacctgagagtgtgaaactccatgacttgtatgtgtaccccatttaaaaaattagatagaaatatgaaagccatttctttgtcctattattccaggataagagaggaaacccaaaatggtatgctctctaagtatcctttgtgtcacccactcactcttcagtcttccagtaggagtcttttttatagctctcagtagggaattgcacactttattaggaggagccaaaatgaaggtggatgaagtgagcgagggctggctcatactgcctttctgtttcattttagtacagaattgtataggcttaactccagaacacacaagcactgcagcagaggaagacattcatctccttactctctattgttagtgttgaaatggcttacttgtcctagcacttaagtactacagtgatggatgtttcccaaacgtacagctatctcgatgtcatagacagaattttgtctctgttttggaaaaaaattaaaacttcctagaagtatattggtctttcaaagccacctttcagtgagcatttaattaaaagttgtctcacagtttgtggctcccaggaacagggctatgttagcatttccatagactctgtttacactgagctcaccaggacaaaaactttaccaattttataatcttccacagcttctaaaataatcttcttctgaacaagatgaatcattctagacaaatcaaatccttctctttttctctttcttcccaatcttgctcctttaagcctagaaacctattaagtgctgtgctcaagaatataaattcctgtctcttctccattttctgttacttcctccccttactgaagtctgctggataaataaattctatccaccacaaacttatagatatggttaaaaaaagaacctatgcttggagtatactgcttagtcattgtggaggacatagtttgagtacagagcatccttttgtgaaattaatgtgggaagagtagtgatgaaaatcagcaagactggagttggcagccggggctgtttggcagaagaatactattaaaggagactgaagacttaggttcaagtctcttttctcctactaaagaataaggcaaattctaaaactactttgcacttcagtttttcgtcttttaaaaaagtgatccaattcttcgctcactgcacaaatatttgctccacagtttgaatgatgttattttccatgtcccttcaggcataaacttttatatcaactataccaatgagatatcttaataaacaaggtgtgagataaaactgatactcaactgaaaacctgaataacagatatcttaagttgaaaggcaaatctgaaaaaaaaaatccttttttgtcatatcttcttattttctttttctagttctctatttccagtcctatttttctttccctagcctctccatcatgccagtgatgttggtatgctgccctccacactctactgctaagtatctgtttgaccccatcaattctctgatgctcttagttcctccatagttcctgtcacctaaagatatttaatttattttaatggctctctcctccactccccccccccacacacacacgcacaccacacacacacacacacacacacgtactacagcctccatttctcaagcccagatgctaaagagggatgatgctaaataagagccagataccccagctaatagcaagtggtgaggaaggcgaggaataaggtctaaagctggctggtgggctgcttttattcagaggacgattgtcattttctgagagggatgctacagagttctcaagatttgctgttgtcttgggagtgtggagcacatttgcaaaacagttcgggcatttataatctcaaaatagcagttaataagacctggctctcaggcatcaagatatgcatttaatatcaacttctgctgaaatttctcaaaaaggaaataccacctacttgagaatagaggataatttctctgaatcattctgaatcagtcattgtggaggacgtagtttgagtatggagcatccttctgtgaaattaatgtgggaagagtagtgatgaaaatcagcaagactggagttggcaggcagagctgtttggcagaagaatattattaaaggagactgaagacttaggttcaagtctcttttctcctactaaaaaataaggcaaattctttttattttattattatactttaagttttagggtacatgtgcacaacgtgcaggtttgttacatatgtatacatgtgccatgttggtgtgctgcacccattaactcatcatttagcattaggtatgtcacctaatgctatccctctcccctccccccaccccacaacagtcctcggtgtgtgatgttccccttcctgtgtccatgtgttctcattgttcaattcccacctatgagtgagaacatgcggtgttcggttttttgtccttgcaatagtttgctgagaaggatggtttccagcttcacccatgtccctacaaaggacatgaactcaaaccactttgcacttcagtttttcgtcttttaaaaaagtgatccaattcttcgctcactgcacaaatatttgttccacagtttgaatgatgttattttccatgtcccttcaggcataaacttttatatcaactataccaatgagatatcttaataaacaaggtgtgagataaatttaaaaaaaatatttattttgagaaattcacagacctactggactgagaagaggaatgtatcttttgcatttggaaaatgttgagttatcagtagaaacttggccccctgttcctgtgttataaagagccaggatttttggtttttgtcatattcattagatacttcactgaaactgtgaccttctaccttactttgacagtaatgtttcactgggtctttaaataggctactaaattagcctacacttattcatggtaacttatttctcctagtcttttatttcccactatgaaatttttgatagtatgattaatgtttttgagctcctcaaaagatcttatagaggaaaaaaatcacaaattattatggattcctcatttgaattcacactgtatttcatttgggtcattgtttcatgtagtattattatgtattattgtttcagagcttgttagtaggccatatgcaaggtagtgatcaataatatttcaatgtcagccttggagggtatattgaataatttttttccataagtcagcattggtcttgattctaattaacattttcaatgttaatttgaagtatggaatagggagtaagcttattaaatatgcagattactctatattgagtaggggtgattattgactagaactccactgtaagaatgtataaggacctttacaaataaaacaaggtgattagaagtacgatgaagtttaatagggacgaatatgtgataatcactcagagatggaaaaaacaaactgtatgcgtatatttgtgtatacctatgataatttcagtataaaccatctgtcaattataaatctgaaatgtggcattagtgtttatttttaaaatgaccagagtaacctagcagcatgtaagttgttcaagccttgtaaagactaccatgacctacttagaaggttcacaaattatgcaaaaactaaaatacaagagaaaaaaaaatggtttagttaataacagtctaaaaatggaagtaatatatcttatagataacaactaaaataatttagtatttaatttgacaaagagaaggctaaaggaggaaaatgaaaaagaagtgttttattacatagagaaatattgtaccagaggtggtatgcaggtattgtccattttcattgagaacaaaatagtgttttctgtgaaacaggagattttggggctatgtacaagtaaggactcccttgtgttaagttttccaagtcactgaagtatcttattaaaaaaaacatgaagtcagttttagggactggtttatgtgccttaaggtacctaatcatattatgtaatgcctctggtaactctttcaactctctggtattatgattattttagtatgtttttgttaacaccatttaaaaatgtgatccttccagggaaattaacgggaattagtgaagtccttcctgaattttcaagaatataggaatatgaaaatcccctatttcactactgaaatctattgcattatttgaagatatcatcttaacataaattttacaatcatcctataatcagcagtaacattgtaaaatgctgaccataaaatttaggataattttgtatttcttcctagtgtcttgagataaataagtattgcagcttttttatgatatataaaaaagaaactgcacatgctttttaccatgcacaggaaaactgcaggataattgaatgtacagaatactaggaccttttatagtgaagatttgcttaataatttatatattataatatatattttattagatatcatacacatatattaaatataatatatctaaaatggcctttcatggtatatacatgtatatttattttataatgtatttattattaaatattaatatataccaaatatttgtttatttaactaatagccatttaaaatagagaaaaggatcataaatgatatttctgtcaacactgtcagagttttgaggtttgtggtagaaaaatacagtgtctgccacatttcagggttcatgatgtgacacaattagtttctagcttgtaatgtgggtcaataagtcagacaagccagtcagattttcagatgactgttctcttgcatctgtataacaccatcatttcacagagagtttaacaatcatttttattggttatagccaacagcagtaagacgtgcagcatttccatcttcccttagattctctaaaatggcctgccgtgtccacatatctgaactaactcctaagtttgtaaggaaagtgcagatctttttaatgcaaggggatgttcccctaagtagtccatgacatctacccttcccaagggcatctactttacataaacttacaattttacctgtgaccatctgactgtaccacatggtgggtagggctgacccagaatactttcgtcgggacagagtgcagaaaatattcccaagtctgtcagggtagacttcagggtcatctgctggtctgtaatccccacactttgtaatctaatctaccacaggaggaccgtgttctgccaggtagatgtgcccttctcatgaatcttgctgcgcactttttctagaccaaacgcatcttatattctggtggctatttaaacagttctaaaaaaattaaaatgaaatagacactctaaaggagttcaaaccagaaggacctgaggctgtcttttatctaatgtattctgttgtgccacatgaggagagttagggggaagatgaaagactcaggacaggagtggggaaagggacagaatggagcgactagaaaaggctgcatcatttagaccttattcaagcattccacatggaggtgcccatcttctgaccctccgtaaatctctaaccctctttgttcctcctatggcaccctctccatccagaaggcttcatttgaaaagttctctccatttcccaaaatggagtcctaaccctctgccttgcctggtatcattctaccgtgctggcctcagacctcagcttgctcttccaaaggcttctgctgtgttgaggaggaagagactctggcaccataacaggaaggaagacacagcactttggtgctggtacattccttcattagagattgctgtctctgggttcctcctgaattaccccacaccgtgaggaatacttttaggctatacaatctaatcttctctgagagaaccctatgtcttccattaacatgactttgacattaatcttttttaaaataggaaacttagtgctattaagctaaaaactctttcctgagcctactttcattaaataaggacaccccttcaggcactaaaaatatcttttacagagctcttaattatggaccaagccaccttgaaaacatcaggagtcctttttatcccaccgtatactcttgatacctttacatttcaccagactttacaagcttgagtctgaggtagttaagaaaacttcactaaggaaaaggagctactaagtaagataggaatgtgacttctcaaagaacaagtggccattggctacgccgtaaataggaaggtggaaggcttattccatttgtccatacatagagcgtacatactctccttcctcctcattatctaaatattcaaccaagaaaaacaatcctgaaatataattttctgtagtaatcctcaacattgccaaaggtgactgtcctcgacttgttctgctgcttatctcaagattctttagctactaaaatcatgaattcttttacatatttataagcatttcaattaagcaattttcttcaccatttcagtttgcttccaatatttcagtgaaaaaatcactcagttcatgtaccccttatcttctctgtctgcactgctcagataagtaactttttcaagagcaaatattctactttgtaccaggtcctatgtctaccagaatcacagactataccctcagctttttgaaatacgttttttggtcctaattgtttgtgttttctttttatttgccttgcctctgaatttatttattttacatatgtggcaaaatattatgacaggcaattcactggaggttcaatgaagcttgcccagctgattgtgttacagaggaaattgccaaatatttctttaaaaatgaacaatgagaacacatggacacaggaaggggaacatcacacaccggagactgctgtggggtgggggaattgggagggatagcattaggagatatacctaatgctaaatgacgagttaatgagtgcagcacaccagcatggcacatgtatacatatgtaacaaacctgcacgttgtgcacatgtaccctaaaacttaaagtataatataataaaataaaaaagttttagattttttattttgtttttgatttttttttttttttttgacggagtcttggtctgtagcccaggctggggtgcagtggtgtgatatcggctcactgcaacctctgcctccgggttcaagcgattctcctgcctcagcctcccgagtagttgggactgcaggcacccaccaccatgctcagctaagtttttgtattttagtagagacagggtttcaccatgttggccaggatactctccatctccttacctcatgatctgcccgccttggcctcccaaagggctgggattacaggcatgagccaccatgcctggccttgtttttgattttttaactacaaatacttctggtcatgattagtcagctgtagaatggctaataatatatagttaaaatgctattattatgccatgctagtttcaggggaatgcttacttcccaaaatgaaatatccttctagtgaagaagaccaccataaaacaagtaagcctcattgattgctgactgttttccagaccctgggctagatctggatttcaaagatgaagttttttaaaaatcatgggaaccagcaatctatattctagtgaggtaaataaacaaatacaattcctaaacacaatgctgaaatgtgaacatattccaagtgttagaagagcactgaagagacagtgaagtttcatgttgaaaggaaggaattctccaggtagacagagaagcatcttatgccaagaagacatctaccaagacatgcacctgtgatacagccaggaatgaagaaacagtgtttggcttatactgtgaatatgagtaaggcaaaaggttgtttctgagaatggaaatagaaaaggcttaagccaaatttttgaaggaacttgaaggctaaggagtttaaactgttttctaagggcagtgaagtacataggcagtacttaaacaaggcagcagtatgatcagattgcatatcagaaagaacagtttagctgtgctaaagaatggattagtggtgagtgagaacagagatagggaaaggcttaaaaataatagtccaggtagaaataacaaggctattagacgtggaaaggcaaagatggtgacagatttacaaaatttaggaggtaaaatatacagaacttgatgagagtagatgaggtggggaagttaaagatccacaggtaaggaaggggattagctgagaatgaatctaattgataggaaacaaggatacggcaattccagaaatcataatagagaacaaagtaatagtaatcatcataataacatcaataattttaactactggtaattgagtgctcatagctaattactaagaaaagtgtcttataaacaatatctaattcaaacctctagataccttaatataaaagtattagttcctctgctcaatagagaaagaaattgcattttggagaagtttaaataattttcccaaagattgaaacacaaatatttatgttttcacaattcatgcttttagaaactaagtgtttgctcagtgctggtcagttggcagtacctcttggggatggcctgccttacccaagcaccccagtccattttgtaacactttgacttgcttcttgggtctaaacaacattaattctcaccctcacggcatattagttgttcctttaaatgctacattttggatcactttttatgctggaaaacttgtcaccgcacttcataggacagctctcagctgctacaaccaatggacaggcaggctgtttacatggttgctaatgagctctcagggctgtaacaatatctgtcctttgacagttgctgaaatcagcatccaaaggagaaaactgagaagagaataggggggaacctaaactgagttggaggatgcttgtcatatacccctatttgtctcttttccactgttagcccttttgcctgaagcatctggtgcctatcctatcagccacgttccatttttctccccctgaagaaaaatctcctctgatgtgataacttaagttgacttgttccaccccatagaaaatgggattagacttaaaattccccaaagccagctgtcaggccactcttgtcagttattgatgagcgttctacacaaccaggctaaatgtagtttttaatcttagaagacaaagaagatggagatgggacagagaggtttatgagagttatttaagttttatgtggatagtgacatctactgtcttgttaaaggaagataggaaaaaaatataagtgaaagtttaccacagaggggttacgcattagattttttaaaaaaatagttgacagttttagagatgtgtttttaacaacgtatttaatataacattatttcattaatataaaattgtataaatgtcccagagagtttgctatgaagaaatttatgaccatttagtatcatagagtcacacaatctcatacttggaagggaaatcatgcattatttattctatttcagtgcatgaattcttcttcaacaatatttataaagaatcacctgactctgccaggggggaaaaattccacaaaaaaataccaatagaaattattaaataaggcattgtggaaggaggaatcatcaacatcataatctttatataaaaacagtagaaacctgatcaaatactgatttgacagatatgcttgactttaaaatctaacctactcaatgttaaagctattgctgtcagatatatctaatagactatcaaatatttaaaaaatttaattgtattatttttattttttattttcctttgagagggagtctcgctctgttgccaaaactggagtgcggtggcacagtctcagctcactgcaacctccgccttctgggttcaagtgattcccctgcctcagccttgtgagtagctgggattacaggtgtgtaccagcacgcccagctaagttttgtatttttagtagagacagggtttcaccatgttggccaggctggtctcaatatcctgacctcaagtgatctgcccacctcagcctcccaaagtgctgggattacagacatgagccactgcgcctggccccaaattaattttaaatgcttgaaaagagtttcagtgtttattgaaagaattttacagaaacctaaagccactcaaattttaaaaatttattttcacagaattgccttaaatcacacagtacctcagtgtatgtactgttcatacaaataactaaatataacttactcgtaagctctcagtattgttcagtacccacaggttgatgctagtctgatcagagaacagtagcaggaataaaaaaataatctcagtcaggtgtcaagaagataaggctgattagagcagcaaagcattttctttcttttatcatccaccacttagagctatagacactcatttttttactgtgtgcatgagtaagactgtgggtttgagagaagagacctcaggtctaatgggttctcagagtgagcattcactgagttttatgtgagatatgtggttaggtagagaaacagagtatactatgagttatacatactaatactatgttcacagataacacttctctggagtactctagatttttccattccttcttctttttttttttttttcttttctgagaatgagttttgctcttgtcgcccaggctagagtgcaatggtgcaatctcagctcactgcaacctccatctctcgggttcaagcaattctacctcagcctcctgagtatctgggattacaggtgcatgccaccacatccagctaattttttttttgtctttttaatagagacagggttttgccatgttggccaggctggtctcgaactcctgacctcaagtgatccacccaccttggcctcccaaagtgctgggattacaggcatgagccaccatgcctggctgattttcccattcctcctatcatctgagaaaatgtctattgttaaaaaagaaatgtctgtatttgacatggtatattaatgtatatattagatgcctattaatgattctatgattgttttacattttaaaacaatgattaggcatgtctaaatattatacactcagattttgaccttcagatacaagtttttgaagattaccatttgttgaatgacctactatatttcctttaaaggctcataatataggctacagcatttctgctaatcttgttctaaactcttcttagtatgaaaaatacaaagtgaccgcttgtaatagttactccctttctattttgggctcctgaaatggccttttcatttggtaataagctatttgtgttcacttcattttgcttcagtcgttttatttttgtcatctttggtgctatcttagtgtgctatgatggaacatgctgaatcagaaaacctgtaatttttattgcaaacatgtctcaaggcaaatttataagttgcagttgatatcagaaactactagagggaacatgcctttgttctaaattacaaaatgctctgctattctaaacttgaagtatgttgaatataaactgccttttttgtaacaccaggagcttcacatgggcaatatattaagatattcctctaaaaatgcattgtgtacaaaacaacttctccagctaaactgtattaaaactctatattttcaggctgtaaagctaatatttaaggtgaagctatgtcacagaaacctgatcatattaaagatcttaacatttgatttcagttttcttttcatagaaggataagaaggagcactaatttatttagcagcatttagccagggtgactatttgggcaacccatttatatatttaaatgaaggcactgaaaaaaaaactgcactaaactgtgatctcacctccattagattaaaaccttctgatcattatagttgagtttgattgttagtactgccagacagccaagggcccaatcttgtactggtagggtgtctggtgacctgcaatatgggctttctccaactatagacctgcaggttctagatgatgctgtgtacaaccatctggtcttcacctttgtatttatagaaactgaacaaacgagtattgttgttataacctgtgtagatatattccattccttcttcctgtgttaccacttttgggtatcctccactaaacagggggatatatgtttaaaatgttcatgtttataatacagttttactgatactactgaaaacagcagtaaattgctctcttgaaacaaaatttttgttgttataatatatcaagataattatggtatgacctacaagtaaatgtccactcactttgttattcagttgcatcctagctacatactcattttactcttgcttttgccctcaattattcatttacattatagctttagtttaccttttacaaatggtagaatccgttcaatattttagaatattccagaaaattccagaatcgcactttctcttcagataggatgatttaaatgcattattttatgcaacagatgtgtagagcaaaaaggaattatcatggtagtttccatggagtaaataatatacatcaaaaacacaaaactcaataaaatgcagataaaagtttgctgaaagttactattagaaattggcacaaatactcttctgacaaacatggcccataatgtattgtttccaacacaattttgtacatgatggagattggtgaactgcaagagtattcccagtgcctttgcccaatgctactgttggttgcaaagatcctcaggaaatcattagcaaactccatctagaaacagaccaaaagatcagagatatacattacatgagattcatggcttatggttgtagagttctgtgcgcattcgttcttgtttgaagtacagtatagtgtttcaaagcatctgctcccattcccaaaagttagtgagttgtaactgtgccagtatctgattttaacagtatgtcaaaggcacagtatttgttcttaaatgtcagtcattagagttgggcacctacacaaattcaatgagttccagtggaatgataactggttctttaagctgcaaaatatagagagactcagaaactcaaatggagggaaatcgaccaccaatttagagatagataacctgggacaaatagatactatctgtaacataaaagattgacttaaaaatcttgaagcattattctgaatatgttttcagctttccagaaacatgaaatgtattctcatccaaatagaaatcgctccccccacctccacagtacacacacacacacacacacacacacacacacacacacaatgctaaagcaaatatagcaaacgaaatatagaaataacaaccagtgtcttgcgttggaaatactatggtctttgaggctggacagacccacatttgaattctagctctcgcactcactgactatgacacactgatcaagtcacttattctctcaacctcagtctcttcctctataaaatgggtcaaataattattgatgtgaggcatttctgtgaggataatgtatatcaattgtctgacgtgtgtattcaataaataatgactatcataactactaatttttaagactacatttgacctcaaagcatgttgtttatgtaaattctataattttatacaaataagccttgctacgtaaaggaatgtagaactaatgctgataacatattgaaagttttttaaattactaaattagcatgtgattatctagcagtctaatttaacttgtctttgatggaattgctagctttttctcccatgaagcttcacaaagaaagcattgcattaccactagacgttttcacttttccttcaataataattttgtgttctcataatttgtataaatgccatataccctaacagaagtttttcttacacattatatcctaatatcagaaaacaataaaataagaaaagcaatttgatatatgtttccacacatattgcctttttttttcttttaactttattcccacttgaaaatactcagtaatgtgtctcttgtgtctctcttctctcccaataatcaaggtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtactgtccatggttctcctttaatagtccttaccattttgtgtcccatgctggaattgcgcagttgagatttgttttttttgttttgttttttgttttttatctttaatgctgacggcaaatttcctgttacaatgcatcttatattgatttaaagaagattttttagggaattcaaagtcctctgtagtgtgtctaacagatcagtttccatttgaattccaaaatcaaatacacacactggtattttgttcagaaaagggttaaggacttaacaaacatgaagtttaaaaaagtttttataaatcccattccaaatatcattcaagttatctgattcttttaaatgactcagggtattttctacactacacttgtttttggattaaaccgtcatctttagttgtgattatgtgaagctatctggaagtaaaagttaatcttgtcaacaaataaggttcctatggatgtctgtttctattccaaatgtgaaaatctttatttacatcttactttttctataactatctatattaaaaaggcatagaaagactgtttttcttttatgtgaaaatcttaaggctatttttactctgagctgtagcttataaacatatatacggaagcaattcaaaccctatcaacctctatgagagatctgactgttttttcttaaaattatctctagtgactagcctagtgaaaatcattgttgacatttaataaataattatggaatgcaggaatgaacgtcagtaatagcagcaatagtggtatacactttttctctctgaccttccactgcagaataatttggactccaagtctgtgtttcctgttctaaaggcaaactcactaatgtcatcctagaggatattttgatgactataaaaattattctgtgacaggttccagcattattctctgctttttcatctggcaccctttatctgccactgctactactatggtccctagagtcagcctagtaattcttgcagtcaacatattgatatcattcttctgagagctggtgatgctaacataaacctttcttcaagtattaatgatgtctttaaggaagtgaatgtcctggagatgttagcaatggcctctatcctctttgcccttattataccccattttctggggctcagttattgattctaaaatatttcttggctttctccaaagaaccattggctcctggagtttcaacatggttctcccagttaatggggttcgggttgagagatggatccaagtgggtgaatgaacatgtatttttggggaagggaggaggagggtggacattttaaggcttactgggtactcatagcatgttaatgaatttgtgttcagaataagtatacactatggctttgaggatgagttattttcctttatatcatctgttaaaaatgaatttgttttttgatgattaatataaatagaaatttatagttcatatttctattccattttaggagccaaagctccccctgccttataacctcattctatacagtattattgcagagaaatttcattttattttctcccaccagcctggtgttaatgggcacatcaatccgggtttgaatccagctcatttttttaaataaaatgtataaacataactagctactcaaaatctctgggccttgagagttgcatcatgaagataagaattctacctcacacagtttttgtcaagattaaataagataatatatataaagcatcaataagtagtatgagtagagccataaacctttctcataagatggccctgaagattacctgagacaatttatatgtgagggatttgtaatttaaagctttattgtttaatatttcctaatcttaatgtaaagttgtgacataataaaaagaagaaacaataaaagaggtagataataatttctattctttgttagtctgttgataaggagggctaatgagttcgaaactgcaaatcaagtcctcaaatatttattataccatgttgattcagttttctgatttactagagggctagtgaaaatgctcttctgaatgaatttataatagaaaatatctaagtgaaatttgtttgtactatatatttctttcaacccaaattagaaacagctgacaattgattagacagagagcagctaataataatacgatgtattttggttcaagcttacaaggtcttggccagcttctattaaaaaaacaaccaacaaacaaataataaccttttcacctgataaagttcattggagtttcatgaaattgagaactatgacacatggaatgtggttgtggattcttattcaagaaactagtcttgaacatttcacacagcagctttttattctctgtcattgatttctaatttatacaggcagataagacatcagaggtcttttaggtcaacatttcacaaaaggccacacttcttctataatatcttgggcaagaatccatatatatatatatgtatgtgtgtgtgtatgtatatactatatatgtatgtatatacatacatgtatatgtatgtatatacatacatgtacatgtatgtatatacatacatgtatatgtatgtatatacatacatgtacatgtatgtatatatacgcatatactatatatgtatatagtatatacatatatatatacacacactatatatggatatatatatagtaactgccttccaggaaggcctgcatcactgagaaaaacagtcctcacaatctataactttaaatagattccattaatgtctcagtctgtatttgttcttaattgtgctactagtctcattaagtttctcttactcgaaggtagataccgatctcatctaccatcttgtttcggcttgtaccaaagaaatctgtgtaaatgagcattaagtcgatgagttctgatttgctaaacttggtagcaaactaccctaagtaaactagacaaatttttttttctgccttgctttaaccaagatcttttgcataagtagaaaaaatatgatttttaaaatgcagctgaattttttatgcattcattcaacaattatttattgagcaccttctatttgtcaagcagtacattagtcactgggatggacagaaatgaaaacaaatgccttcatggagtttgcattatagtgggtataaacaataaacaaaataaacaagctctgtggtatgttcagtagtgagaattgttaaggagaaaaaataaagtaggagaagaggatgggaaataccgagaagcaaggtaatctgctttattaaatcaggtagccagggaaggcttcactaagaaaataacatttgaatacaaactttaagcaggttggagaggggagagtatgtgtacgtctgagtaaagtgtttttagaaagagggtcagccagtacaaaggccctgaggtagaagcatgcctagatgttccaagaatatgaagggggccagtatggattcagaaataagggataatatcagaagtgcaacaaggtcaagaggtaaaagatctggaggtagagagcagatgaatcatgtagggtctagcaatgcaaagtatggtcctgtggactagcagtgtctgcatcacgtgagagcttcctaaaaatatagactcttatgcccctatcccagcctttctaaacgtgaatctcattttaacaatatccataggtggttcatatgcatattaaagtttgagttgtgctaacacaggctgtctagaacatcctaagttggctttttctctggtgggatatcaaacctcaggagagttttgaactgaagagcaacatgataacatattttggcaaatcatatgactattgtgctgaaacaaacggaagatggcaacatggaagctggaagccagttaggaggccatgatggtgactcagcaacattctgaaattacaccatgggaagttcatttctcttaaaacgcaaatacatcttaaaagactatgactttgagtagttactggcattagcaccttagtggaatttagtctattagattattttagatgggcctaggacataaacagatacagcttctgagagcagttgtagaaacttccaggtggcaggtaaggatctgaccagaaatcaaggatcatgtgcagcactaaaatagggaagtccctgattattatgagggccatattcacttcccattaatctattataactcttggggaaaaacaaatcattctagaatctcagcatagaagaccactagagaagtaaataaaaccaggattggtaggatttgtaagtgaataatacttcagactatgaagttccaaggggatgtacactcaaatggataccatagtaacagggaagtcggtggtggtgccagcaccagcagtattcattcataaagatagcattaatgtataggctgtctgtccacagaagtccaagagcaatatggggaaaggggtgctattactggggggaactcacaagctccaaactgggcatcagggctgcaaccaagccactggacttcagggcctagctctaatcctagctggaaaactgaagtattaaaatggaagccaaggcaaaagattagtcataacaatatgggccagtgtcatgggttttagaagactgaggaaggaagacaaatcccagaccctaagaactagtgagtaagcttaccccagttttattcagctctggctgaaaaattcagtggacttgaacctgctattttacatactcattcaacacatattcagtgaatacctattgtttccaagtctctgttctaggcattagaaggtgtaatagaacaggtaaagttcctgcctaaatggagattatattgtagtgaagagaagataacagacaagcataaatgtgtgctctaaagaaaaactggaagggtaagaatggaaaaaaaaaagcagatcatgaagaggatgttgccatcccacattgggaggttgggaaatacttctctgagaaactgatgtttgaatggagacctgaaagaggacagggggtgaaccatgcatatagtttggagagaggggacaggaagtgctccaggcagagggaatgctcattacaaaattcctgaggcagaagctagcttggcatactggagagaaatgtcaagaagatcagtgaggttggagcaggttgcacagagagggggttaggggatggagaggcagatggatatgatcagagtgggaggtgggcaggatggaggccattgaaaaggctgatgcttgggccccactaaagtccaaattgtatcttaattggtaaatggaaggcagctaaatttctcacattcctccaagtgattctgattcacaataagggttgacaatcactgatataatattctatgagtgattttaatgaccttagttactctgagatgagaaaccagtgcagagttttgagcagaagagtgacgcaacataactttttaaaggtccgctctagatgctgtgtggagaccagggggctcaagggtgggagcggggagcttagtgaggaggccactgtaataatccaagtgtgacatgaggcgggggtggaccagagtgattatggtgaaagtgatgagaagggattaaatttaaacatattttgaaggtagcactgacaagattttctaaaagagtaaatgtggggtgaaaaagaggagttagggatgacttcaatatctttggcttacgtaggtggagggatggagttgccatttattgagattgagaaaaccatgacaagagtaggtttgataagtcaaatgagaatttgtctctggcatggtagttaatatgaaatgcttactcattacgcaggcaaagtttatatttaaggccacaaggctggatgtggtcactgaggatatgagtatatctggaaaagaaaaacatataaacacaatttaatatttagaggaggcagagacagagagggcataacaaagcatcaggaaactatcagctagtgaggtaagatggaaaacaagagagagtaagtggtggtttaaaaaccaaaagaaaagaagaatttcaagaagttcagaggatcaactgtctgtcaaatgatgctcatgataaagggtgatgaatgctaaaaattaattttagttttggaaaccagcagtcactggtgacctgacaacaacaggcctggtagagtagaagaagagattagggaaagattagagaaaagaaaagaagtaaaagagaggatgtggagattatgagactagaaagaagagattatgagaaccaggtactggaaaaaaaatgcctgtacaaataatcgaatcaccaagaataaacacagaactaatatttgagagagtgacagagagccaagtgataaaatcttcaagccacgttggaggagtgacactggtaactgtagtaaaactacaaggagatactatagctctttttaaaggagtaactcctttttaaagaaattttgctgaaagaaaatgctgagtaatgagaggagtttctggagtaggatgtcaggtttggggaaattttttacgaaagaagacatatacagtatctgtatattgatgggagtatgcaataaagagaaggaaacccataatacaggaaaaagactgcagtattgctggagaactttctttgattaggagataagttatggcatcttagtgcacaggtagacggtttggacttagaagcacagtccatccatagtaagaggagagaaggacataagttagaagatgtggtggtgggagcataaggaagttcatccttgactgcttgtattatatttaaaccaaagtcatcaccaaagtgtaagcagcagggcagagattctggagatttgaagaaagagaaaataggaatggctgtcctggagaatcaaagagatagtaaactactaaaatataataaactttctagacaagactgaaggggtttgtaatcggtggtcatgactataaattgggaccagtcagcatgattgtgagtatttgtctagccatcatcttcagctgactgagcataagtgcaaagtccacaaagagtatatttcaccagaattagtgtttccagaaaagtatgatagaagataataggagcaagaaaggaaattaagagcacatgcaaaaaaaacataattattgttatgaatcatggaatctgtgctatataaaaggaaagtgatgatacaagggaattgaggatatgaaaagggtggcaggaacaatgcattgcgggcctagatgggactggaattcttggaatcagcaaacaagaaggataaaattggaagtaacatgaagcttgttctgagatgacacgtttgaagttgaaatgatgaagagaatacagttattgaaattgatgacaagggatttggtagctcaggtagtagaaaagacaaaatctttggagaagaggaagacttgagactgaaaaagaaagtactggaaagagatgcttatgtgaataatcaaatcgccaagaagaaacgcagaactcctatttgagagagtgacagaaagccaagtgataaaaatattcaaataatgttggaggagtgttgcagggtcagttagtgaccactcagtaacactgagtggcaggtagtaaagtctgataacataagcttcaaagctggagaattttcgggacaagggtctagaaatggtttgaggggcaaagaggataccaacactggatcctgtcccagtggtatgagtgttgtagcagagaaaaataatcaccacaagaccacaggcaatgcagtatccccagaagataagtacattctacttagcaaaataaagtaaaaggaaatttcaaaaaacaaatggaggttataggtaaggtgattatttttcctagtttgcttgggacagtctcgattttgccacttgtcccagtgttattaactgtattcccactcactctcaagagtattaccattatgacaacaaattatgtgacctccctagatacacacatcctgctgataataaagtttcatagagcagagtagaagaacctggagagttgtagaggaataggaaaactggtcaaaatcaagggatgcgcagatccatatcagtgagatttaaacagtaatctggaaatttcagactttccatgagggcagcatttaggaatccaggaccaacacagactctaggcaaattatgttgataagatgagtgtaggttggcaggaggggtgagcatattgccaggtgcttactgaggtgtggggcccctcttcatccctgacagtggcagtggaagcttggctaacagcaatctcaccagcagctgaaagtcttgagggcattgcttcccacagctgagtgaggctgggaaagatagcagctgatgcatgctagacttaaggatgaagcagctctgcaccatgttgcacaaaggaaaaaaggctgtgagtagaaaacagatttcagctgttacacagcttcatctatacttcgtcctgaccttgcatgtcggccatatcctcttttctgcttgttccattccccttcctcctagagctataagcatcatttgtcattgagtaaaaatgccaaagtagatgacaattaatgagccatcagcagaaggagggtgagggctaattggagctttagtgagcaacttgctaatatattaactaggtatatgacctcaaaatctgggttaggcccttattacagaaataaacaaactgaaaatggcttggggtaaaacaagacaacaaactcaacagctttggttctacgaaaacgccaagcctgggctgtcataccactggacttggagggagcagtgtatttgctgcatttgcccttttgccaaatgattccaacaaatacatgattcacttcagtactacaccctgcagctgagagctccgataccactggcatattttctgctctctagaaatcagagtttttaggtctgtgtcagtcatcacacaaagaaagaagagaactgcacagtgggagaataaaaaagatgtagagatcatttccagcagccgtgctaatgcatttttaatagtagagttggatttttttaaattattattaagacttatttttgtttttaacaatcctcatggatatttgaaatcaaaatcagactcgattagatgttttctcaaaaagaaaaggagaaacctagaatcattgtgacacatgtaaagttgcttatgaagacttcttaggtcatcaccaggaattttacataagttacaatgtgtcaagttttatagcagacaaatcatactacaaatactacaaacaaacatgtttttctagatgccaagaaaaaatatatgtatgtatgtgtatatatatatatatatatatatatatatgtatgtatgtatatatatatatatatatatatatatgtatacaaattctgtgaattatactggatgctgatgcaacagtgaagtactgtcttatgtacataaagatgatactaccaacctgctgttgacagagtatgttcttttaaaattgcttttttccacagtgatttaattcatgatgaaagccagatctgctccaattcttcttttaattagctacattcaattctaattcatctattcattcactcattcctttaatcaacaaacatttattcagtggctgctaagtaaaatgcagaacagcaggtaccccacagagatttgtacaagacattgtgagaacacagggaaagggaacctagcatagcctgaaggatgaggctacttcagatcagtgaagacttcctaaaggaagtgatattaaacttagaatgagtagtatttaattaggtaacagaaataacaaaaaaatgggatagggaggagagggcctgagcaaaggcatgaaggtgagcagagcatagtatgtgcaagaaacaaaaagcaattccagttagaagagaaggtgctgcaataaagtggtgggggaggaaggtgcttgtggaacaaagacacctactgggccatgtatcactggaacttgctaattggacattaatataataattcaaactagatgagcaataagatgtaaaaagaatagcaggagtatttgaaatcagtttctcgattgtgaagaatagagagccactttggacttagttttcttccatattttaaaattgtggaaacagaatttattaattctaagattttttctggaatgaatattcagtgagtctttggacactaatttcaaactgtttaatagcttatgagagaaaatgcttcctaggaaacttcagaggactgtagtgggagtccctaacacagagaccctaacatcaagcctatgttgttagtcctgacttaaaacacagcctcatacccaagtgaaaaaattctccaaaggattttccagctttctagttccccaggatgaaaaaagaatagattgatgcatctttgtttcctgctggttgcattatattctcaaacttcttattccaataaatatccaaggtattgccttggtttagttcttactctcaaagttacttcccaaattggaaaatgcatatatattttttaaaaattttctgttgggtaaataccaaaaattaaaaattataatcctactgataccatttggctctgtgttcccatccaaatctcatttcaaattgtaatccccatgtgtcagggtagggaccagataggaggtgactggatcatgggcgtagtttctcccgtgctgttctcacaatagtgagtgagttcttgccgagctagtggttttaaagtgatatttcctcgatttcacactcattctattctgctgccttgtgaagaaggtgcctgcttccccttcaccttccaccatgattgtaagtttcctgaggcctcctcagccatgcagaactgtgagtcagttaaacctcttttctttatcaattacccagtctcaggcatttctttatagctgtgagaaaatgaactattacacctaccataatttaaaaattattttagtctccaattttaccctcagagtttacctccattaatagcagagtatacatctttatgacttccttctttatttaaacaggccgggcgctgtggctcacgcctgtaatcccagcactttgggaggctgaggcggacagatcacctgaggtcaggagttcgagaccagcctgaccaatatggggaaaccccgtctctattaaaaatataaaattagccaggtgtggtggcgcatgcctgtaatcccagctactcgggaagctgaggcagaagaatcacttgaacctgggaggcggaggttgcagtgagctgagattgcgccattgcactccagcctgggcaacaagagtgaaactccatctcaaaaataaaaaataaatataaaaataaaataaacaggagacatctgcaaaaatcacacatacgcaaatagtcacacatatgaatacaatttttgtttaatttccattttgactttttaaaaaataaaatgttttcatgcccttgtctttttcaattcctttgtcaaaaacatctttcaggttagtgtgtatgtatattatacatatgtaagtttcattcgctttctgtggctcccagtccctggctgttcttttacatcctcaaaagggccctccctctcctctcattctgatttatgtgttcagtgttctacaattttctccttctcaactgctaaattcaattctctgactaaacataaatgccatgactattagcatatctttctgtttttatgtttctcagattaattgtcatcttaggcactaaagcttctgattataaattcctcctttcttgttaaatatccataactctattatttttcttattttaaatcaatatgtcttgcaaaatcctttagggctctgctatctggcgccagctttgcctaggagataataaaataaataaaatttgaatgtcttgatagtgtttgggggaaataaatatattacagtataaaaccatgcttatgttttacagaaaataactggcttcttccattattcctttatttctcctattatacctaacattaaatactggagtccaaaagtgcacaatacattttaaaaaactccataactaaagataaagcttctctttttatgtgataaaaattggcttgtaatataatctaagcacatcacattcatagctttcatatttaaagttcattttttcaatgcaaatttttattgaaattttaaattttatttattttttaaaattataaaatacatgtaacataaaattcaccatcttaaccattttaggtgtacagtttagtagcattaaatacatttacattattgtgcaaccatcgccaccatccatctccacagccctttttcttgcaaaactaaaactctgtacccactaaaaattccctcctcccattccctcttccccccaaggccttagcaatcaattatgtctctacgaatttgaacattctaggtatctcatataaatgtaatcacatagtagttgtccttttttgacgggctttcttcacttagcataatgtcctctaggttcatctacattgcagcatgtgtcagaatttccttcaattttaaggctaaataatattctgttgtgtatatgtgtatgtgtatatatgtgtatatatgtgtatatatgtgtgtgtatatatatcctgcattttatatatatgctatatatatatgtatatacatatacacacacacacatatatatcctgcattttgtttatctgttcattatcaacagacatgggttgcttctaccttttggctgttatgaataatggctctcaattatcttgggtatatatccagaagtggaactgctagacgaaatggcaattctagttttaattatttaaggaactgccatactgttttccataatggttgcaccattttaccttcacacaaataatgcacaagagttccattttttttttttttttacattctcaccaacatttattttgtttttttgatagtagccatcctaatgggtatgggatagaaatcatgtaaatctaaattctattttagtatgcatttttaagaggcactattttggctaataaacttcaataactatcttcttcacattatgctccaataaaaattggattgtgcttgcttatcatataaagctcagcattcctgagaggtaagactcaatctatcccacaaatatggctcatcccagtagtgattctcaaagacagaagagaccaataacctattaaccagcccccagcaaaagaagcaagtcagaatgggggaaggaagtatgtatagttcaacagaacaaaaactcatgttattcggacacatccaattgagaataatttgttttcctaaactctgggaatgtttatctctgccattgcgattcctagaactcatcacagttatggagctgaaagagactgcagggaccttctagattaatcattttgttttatggatgagaaaattatacctaaaaaggttaagtgatttacccaaggccacacagctgattagtgtcaatatttatatctgcagcccacatctcttaattctggtcacttgctctttccatcacagttaaaaaacttaagtctgtaatgtcctctcaaaactaattaaaattcacatcacaatttgagtggttctcaaactttatatgctattaagaattgcctagtgaggctgtccaaaatgcttattcttaaacctccaaacccagatatcaagattcacggagtctggggtgggacccaagaattaaattaatgagcaatacagatgattctgataaacattgttcacagattatcttctgagaatcactcttctgggtactatttaaaagccctggtcttaagccagtgatcttcaaggcatgggccctggtccagctgcatcagcaccacttggtaacctaagagaaatgtaaagtcttagagcccacggcagaactacctaatcagagactcttggggagagactagaacattgtagattaataagctcttcaagtgattccaatgcatctaacatttgagatccagtggcctaggctcaattttagtccaagcaagccactcactttattatgttgccttccaactagaggatttaggaacccagggcttcgggtgcatcaaagtaatccaaaatatttgatcaccctaactgatactgccaagagtgtgcgtgtgtgtgtgtgttgaatgtttcaacactaaggaacaaaaccttccctgtctttgctccttacatgcaattgattgaaaagtagaggttaagtgaggggcatatcaagtggcaaatgttgcttcccgccttgtgacatcgtttacattttaggaacaaaacaatacttatctgcttgctgcaaatcttcacctggatgtcctgtcagtgctcctgccagccatatgtctaacactcaactaattacctttctttgcaagttgacgcttatctttctgtgttctttatttctgttaaaagcatcactgccctccctatcatcaggctgaaaattgaggaatcattttcattgccttcatctttgttaccagagccaaataattgctttaactatcaatcctgcctctgacacatctctccaatttattctctcctttcactttctacttccaatttagtaattcatgtcattattaccatcctcctggactacagaaataactaactaattggccccctcctgcaaattcatcttccctcagcatagcactgaaagtgatccatctttgctcaaaagcctgtaagtgttccactttatctctagtgcaaattgtttatgctagcattcaaaagtctctataggttggtattattctgtttttcagtattcatttactcattcattacttaaataacgcctattctgtattgatttgggtatcttccctttcacatgccatacattactatcaaaccaagttgctggctttgtcttatactctgcaatgttcttacatatcaggtattgctcatttctttccctccatcaggaatgcactcctctgcctgccttctttttctgtctattcgttcttcattttcaaggtctacctcagttgtactatgatgtctttcctaaaatattttcttcctccattaaactttcttaacaatgtatccatctccacaaatggtttccttttaatactgtaattgtctttgcttgtctatccttctagatcatatactattttgggccagaacacatacctgattcatcagtgtatccctctatctctacagcattgagcttgattcttaatctttctttccaacttgagtgactaaaatatttaacagaaatcaatatcagattattcatgaatttagatcccaaaatgtctaagcctgattcctcatagtgttcctcttaaacagactagatatttatatattttccttatgttctgagtagtacaacttattcactatctttaaaggctcccagtaaaataatttataagaacagatttcagtacttttcaattcagtttaaatgctatcagtcttgtctggtatgtttatgtaactgagacttatcactttgattagggaaggatgccatgtagaattatgtttcaagtgtggcaaaatgatcagttgtatgtatttgttttgcattttttgtctagaaagctgggaaataaggcaggaaagacagagtaagacgaaggctaggctcaaacaaatttggcatttccctcaggtgcataaattaagggggcactaaacaaacagaataatcagatgggatcagcattgcttatcttcccttttgccccaggcaccaatatggctccacatggtactggcaaacctagtctttatttgaaattttgatattttataatggatttttgcatgaattttgttcttttcttaaaatattgcatagagtattatttatttgattactgagtttggtgcacccttcaattatgcacacaggacaggtgctttactcaccttatcctagaggaggccatgagaaggaagcagaaaacaaaatggggaagaaaaaaggaaggaaaaatagataagatgaaaggcatgaagggagacagacagtctttattaaatactcttaatctttaagtgtaaatattatattaagttgataatagataaacaaaaacaagtatgatgaaagattctgccaacattggtgtaagcaatgttgtttatttgtatacaatatgtatataccatagacagatgtacattactacaatatatatacatattacagattgcatattttatttctgcatattacaatacattatgttcattgtattaactcaggaaggttgattctgaattatttttatttttcatatttatgtttatttttccctattagaattagttacaattttaccacattttagaagaatttacctgttaatctctgacaatttccaaatcatacttaaatatttctttaagaatcaaagataatatttgacttaaacttttgttgtttgggctaaagaggaagataaaaaaggagtttgaatctgaaattccctactaactggttatgaggcctagtcattgttctgagaaatcaccaggtaaatttgcctaaacgttgcacataatttgtaatttaccccaacagagggataatgtgtgttaaaatatggaaaatgtaaaagaatgggatcaataaacttgggctaattcaatgaatacatgtattttaatctcctgagtgtctggggttttttaacatttaaaaattaagtgctctgtagtgtaaagatgtagtgtttgttttgaaagagcacaggagacttccaggaaagagtagctactcacaaattattgctttcgccttccatgacaaggccaacaatatgctttcatttactgattctcatctaataccttaagcttgagcaccccatctgctcagcagtatgtaaatgtgatggaaggtttctgcctcaaattatactgtcagaaatatattgcatttaatactttgtgtatttaactctgtgtataaaatattcagcctgcaggagagttgtgaattacagtcaagtgaaatgctgtgcttgaattgtgaagctcaagaagcttttatcagcttatcaactcaaaatatcaatattctcctgcaccatgttaacacaaatacatttatgcaattccagcaacagagatggtcttaccatttctccatttggcactttggatataataattatatgcaaatttggacaaatttcctttctgctttagggaatctaatttagtttgtcaatctagctgttttttagaaattgctccacatattatacacaataataaaagactcaaatctcattttctaaccctgcactcctaacaacatttcacagtattttgcatattatttgataatatactgtttgaatcaggaatcttatccagagtcatagaattgctttaagttttgtcttggtgtttgtctactaatgtgcacattttttcagttgcgtgtgctgggagagccaccaaatgatgtattggaccaaaaatatttacccatttgatattctctattagtcatccagcaatttcaaacttaatatatccaaaacccaacagttgtcccaccttttatttttttctttttcacttgatagcaaattcattcttcttagattgactcttgtctttctcttacacctcatgtctaattcatcagtaaatcttgtagggccctttctttctctcttccttccttccttccttccttccttccttccttccttccttccttccttccttccttccttccttccttctttcctttcttcctttctttcttgccctccctccctcccttccttacttctctctctctttctttctttctttctttcttttttgacaaagtctcactcagttacccatgcagtggcatgatctcagctcactgcaacctctgcctcctgagttaaagtgattctcccacctctgcctcctgaatagctgggactacaggagcatgccaccacacccagctttttttttttttttttttttttggtatttttagtagagatggggtttcaccaggttggccaggctggtcttgaactcctgacctcaagtgatccacccacctcggcctcccaaaatgctgggattccaggtgtcagcaaccatgcctggcccctgtaggttttttatttaaaaacatacaaattttcaccacctccaccattattaccctggtccaagccatcactgtctctttcctggattattgcaatagctttctaccaagtcttcctgattttactctactttgccatagtctgctttcaatattgcaatataagcgaacaggtcattcttctgctcaaaattgttcattggctccccactccattcaaggccaaaaactcttacaatagcttgcaaggctgaatatgatctatgttcacccacctcattatctttctggcttggcttatctggtttctttgctgtttcttggttgtaccaaccacactccccttttcactggctgttttctgttcttcctatctttccttcccctaggtagcttcgtgacctactttctcaccatatttgagtcttagttcaatgttaccttttccagaaactttccctgacttccctatttctaaatgcaatacccctgatacctcagcacttcctacacttctttcctgcttttattctgtttccatagcatatgtcacttactaatatataatttacttgcaattttatttttaattaccttatagattttttattatatgtatttaaggtttacaacatggtgttttgatatacatatactcagtgaaatggttgctacagtcaagaaattaacatgtctaccaccttgtatagccatctttttttatagtaagaacacctaaaatctattctcttagcaaattttcagtataccattttcttaattaactgttctagtataccctgcactagaatgtaaactttatgagggcaagaatttttgcctttttcactcactgatagatcccaagcaccttataggtgcctaaaagatagaagattctcaataactaattgttgaaaaataaatttggcccccaaaataacccccaaaaaattaaacaaaagtgaattgataaaaagcaaatgcctctatgatttccttttctacagtaagaaattatttggacaaaatagtcaaagtatattaaattaacaattcttaagttttagagtttgatgatttgatgtatgtatacattgggaaatgattaccacaaccaagctaactaacacacccatcacctcacatggttactttttttttttttttggtaagaacacttaagatctactcgctgagcaaatttctagtatacagtatgttgttattaatcatagtcaccatgctgtacatcacatttccagaacttattcatcttttaaatgaaagtaaaatatgttgatcctttgaccaacatcttcccattcctcacctccaccccaggctctggtaacgaccattctactctctgcttctatgagtttaattttttttagattccacatgtaaatgagatcatgcagtatgtctttttatgtctggctgctttcctctaggtctatccatgttgtcacaaatggtgggattttcttctttttagtagttaaatacattccattttatacacacacatacacatacacacacacacacacacacacacacacacacacacacaccacattttctttatctattcatacactgacagacattttggttgtttccgtatcttggcttttataaagaatgccaccatgaacataagaacacagatgtatctttgagatgctgatttcatttcttttggatatatatccagaaatgggattgctaactcatatggtagtttcatttttaatttttcatggaagctccgtactttttcccataatggctgtaaaaattgacattcccaccaacagggtaacaagggttcttttttctccacatactcaccaacacttactatcttttgtctatttaataataccaattctcacagctatgcagtaataactcattgtggttttgatttgcatttccctattgattaatgatgttggcattttttcttatacctgttggccatttgtataccctcttttgagaaaatctattcagtccctttgcccattttttatttgggttaattgttttcttttaatttagttgtttgagttccttatatattttggatattaacccttcatcagatgtatggtttgcaaatattttctaccatttcctaagctgtagcttcactctgttgattgtttcctttgacgtgcagagctttctattttgatgtaatcccatttgtttacttttgcgtttgttgcctatacttttggtgtaatagccaaaaatatcttaacataaatttatgccaagataaatttaactaagagagtaacatatctatacaaagaatactgtaaaacattgatgataaaatgaagaagacacaaataaatgaaaagttaacccatattggtggattggaagaataaatattgtttaaatgcccgtagtacccagagggatctatagattcaatgaaatccttatcatgattccaatgactattttacgtaaatagaaagaacaatcctaaaatgcaaatgaaactacgaaagactacaaatagccaaagcaattttaacaaagaagcacaaagctggaggcatcacacatcctgattggaaactgtattgcaaagctgtggtaatcaacatagtatgatactggcataaaaacagacacataggctaaaggaacagaatagggaccccagaaataaaccaatgcatatacagtcaactaatttttgacacggaaatcaagaatacacaatggagaagggaaagtctctttaatagtgttaggagaactggatatccacacgcaagagaatgaaactgaatccttatataaattaattcacaataaagactttattgtaagatgtgaaactctaaacctcctgaaagaaaatatagtggaggaagagccatgccattggtcttgacaatgacttgatatttttgacttcttttttttttttttttaacacttgttgatttagagattcaattgtcagcttttaaattcaatctactttgacttgtgtttttaatgctggtcatggctgaaaaagagaccacacaatgattaataaatcaaataaataagggacatatttgtgcttataaatgatttaaattttccaacataattcagtcatgcaaagttttttgataaaattttgacagaaatgtgttctgtcctttaaaggatagaagttttaaattttgatgtattccatatatcttttcttcctttgtcattggtgacatacctcgcattgttaatttttgatgtctctgcatttttttaattagacttctttgcaatctcccctttataaataacactcaatatctaaaaaaatccttgaaatcttataagcttctacttttttggttgtatctctggccatgagattatgtataattattttctgacttgaaaaagtttgcttttctgaaagctaaagtgtttatataactcatcctaacataactttccttagttagttaaacttactaatggcaacatttcattctctaaggctattttcattttcaccccatcaagtagtctctcgatttattattttatgccttcttttagtgtttacatagctcctattttctgccttgaattaagcaggtttttgagagatatattaagatgagaagtaagacacagagattttgcctacaaggaattttgccttctaataaataagacaaatcaattttataaaaacaaatggctataaaacatggtaaaaagtgataattaccatcaaagaaaggcacaaattaagttctatgtgaattgacagaggaaaagataattcttttcttattttactattttcagaattaaatctaaagtagcagtttttctcattatccctttggttcctgtgagataaaattggctagaaggcaaatgacaacttcattcacaaattacatttgattgaaaggaaattgcagaaagatatttggagagttgatgctttctgtcaacattacaacttgtttctccattagccttgtggtcctcattagagatgtttgatccttaacctctattgactaagcaaaatgcagaacaaccccataaaattattttttaattctaaatatttccccctttgttacacccctttacttcatatcagaatatgttcattttttccttttgttatataggttctttttatctcgtttttacctccataatgcagttactaaacaaattttcacaaatcaataatttctaggtaaggctacataaggttttctatcctgaaatatttctgcaacgtgaaactatacaaataaatattttgttacataaaaaatttcaggaattacctgtattctctttttaaaatttttattcgtttattaaaaattgtatactcaaatcctttctctgaacactgttctttaataaaaagtaccaggaatccttagagaaatggctgatgttaagactggtgcaggaaaaatagaaggtgaatctggaaaattttttcattccagaaaataagaaagtgctcaaataacaaaaggagcaagtagggaatgctgagggacaaaggggccaagtggaaacactttctcatggccagaacagaaataacacaagaaagatgaagaattgaatattggattacaacccaaactctaaatatacaagttcatagtgatatgaaaaaaattattgaataaaaaaagtgggagaagaaacaaatatttcttacagagaattttaaataatacgtgtagatactgcgttcctacaggagctttatactcctccattcacgctttaatgtggactggacttagtgattggtttccaaagaaaagagtacggaacaggaaaaaatagagatatctgacaaacactaccttgatcaagatatcagtgatatatagatatcttgatctatagatgggagaggcattccactaccatggtattctttcaaaaaaattcataacccaagtctaatcatgagaaaagaaatcagataaaccaaaattaagggacatactccaaaatactacaccagtactcctcaacactgtcaaggttatgaaaaacaagtcaagatagagaaactgtcacagtccagaggaaactaacaagacataacaactaaatgtaatgtttgatagggttgggaacagaaaaaaaaaagacattaacagcaaaactgttgaaatcctaataaaatctgaggtccagttaatagtaatgtcccattgatggtttctcagtttttacaaatgtaccatagtaatgtaagatattaatattaggggaaaatgggttaaggagtataagagaactctgtgttacctttgtaatacttgtgaatctaaagttattccagaataaatagtttacttaaaagctatagaaacatatctagatttttctattttaggcatgaactgttatttctgactgtggaagacaagaatttagtttctgtccttctcttgcttctaccatacatgtacaaccttcccatctaccaaatccccattataattgtactcatatcaatatattgtatatttctattcacagctgacccatttaacaaactgtaattacttttccttgttgcctatcctcttgttaaactggatttagcaattatctcattttgttcatttgtttaatgtatatgtccttagcacttattcaacctcaagcttttctccattgtctaagtctcctttcataatgttcaaatgtgcccagtattctattcatttctatcgatatggtaaaagatgtcttcacaaactgttccttcaccaatattctgttttcccttagcatgtgttaggtctcttgtttcatgtatttcatgctttttttccttggtttactctttgattttggtaacacagtatctcataaccttcttaggaaaaatgagttggagataaaattgtgagacttgcatgcctgaacacatcactatcctgcttgcattttatttgcagtattggttgggagaatcctttcttccttcagaagtttgaatgcattgttccatggtatctaatatttcagttgagatgtcagaaatatgtctgatgggttttttttgtttgtttgtttgtgtgctctggaagtttgtggtatctcttcttggttccttgtgttctgaaattttactgatatgtccatttctatcatttgtgctgggcacctgagaggcccatttaatctataaactcatgttcttcagttctgaaagttttaaaaaattattttactgatggatactttacttcaattatctatttttagtttctttctggagttcctagtatttatatttaaagccttctgattgattctttcttatttatgtaattattcaatatttgtgtgattttttccttggaaattttctattcttatctttcaaaactcctgtttttcatgtctactagcattttttaacttcaacagcactttattgtcctttgaatgttgtattttctttagaattcaatatttccttattgcgatgttttttaactctaaatatatatataaggatagtgcttttgttgttgtcttggttgtatggattggcctttaacattttcttctccatgcatcgtctgttgctttcaagttgctttttcttttctaattgttttagtcactattgcaatagagacttttgatatctggtaaagtttgaatggaggcccatattttaaaattaagaaccaagaagttaattggcagctctgaaaaacaactaggcataaaaagagagagaaaagcataccccaagtaaaaagaaaagcaggttgtgaaagacctaaggcagggttgagcttgtttcattggcaaaatagggttacaaatgggacagaagagctggactatggtgaggaagggtagaaatgtaagagatcttaattttgcattccagagagaaagttttaggctgaggcttagaccaaaagctcagggcaaaggccaaagagtttcatgatttacacctggaaaatggaaagcacacaatctgtccaggcaggagtccagctacagctgtcttctgcaaactccaagaaaataacaagagctcctttttatgaatgctgtatttataagtcacatgtagctttgtcttccactgaactgtagaaattttggttcattaaatatcaacttcctcattttactggtgaagaaagtgaggccctttcttaaacatattaacatttttatcactaaaaattctctattggaatttacaattatattgagagactataaatatgctactcctagcatcatttaaagttcccaaaacccaaatgaaaaagaatatgacagcccgacagaatttgtttacctaactcgaggaaatgtcgttgagagacactatggagaaaacagcctaactcagtgaaattgaagtatattagattttaaaaggcagaaggaagacaatgaaatctaagagacattttcccaaaaggcacttagtacatgcggacagtaaatcccacagtgtcagtgtgctttttgttcaaagtgcgcagaaattttcttgagagctgtagaattataaaagttaacaacatgactataatgtttcccagcaaaacaccctacaagacagctctttaattgtaaggattcaacacttttagggtacaagtgtattctactcttgtcatggagagagtgagagttaagtgattcttggggtattcttctcttcaaatgcaagctgtgggtcccatttgtcaggaaaagaaaaataaatacaaccccggtgtgagaataagaattctctctctatcttggttccacttaattgtaaaaatcttgccaaaaaatatctgatatatatttcaaacattttgtagtcatttacagactctcatgccatttatacatggtcttgcaggggcagccttgtgagctgtgtctcatttttctaaaaccactagaaggaaaactttatgcagtacggtttgggagttgctctatacaatgtgacacttgatctgaaataccaaatggcagacttttacacagtaacttgaaaaaattatcctaattttgcgtttcatgatatcactaatgcataatcagcaagtaatgattaattactcaatatcgcccttaacttgggaaccctcatcattctggcctctctttgcaaagatgtatggacaataagttatggaagacttgaaaggaccatttcatgtgaatttcctgggaatattatattttcctaaattgaactattttactttagcttgccatttaggctgaaatgattccttactttgcccaacttgggtcactacccctcacatagccctctttaatgttcttcagttcacataccactacctaaagttaacttgattttattttaacttcagattgtctgtttcctctcactagactggggcaaagtgtgggcagtagacaatcttcaaagaccttgtctgtctcctctgttgtattcattgctgtgtttctacccacctaaaataatgcgtagtggcactgaattaatgtttattgagtaaaatattttactatcctgtacccagcctttgatgacttgccagaactgagccccagaaaaaagtaccttttctccttggtttcaataatttttcttttggattctactgaaagagaaaatgtggaaagaattactgaagctagccataactccaacaaatagccaacaattctgatcgccagtattaaaccacaaatttgtaacataaccacatcatagaataagaaagtacagtttcattgtttctgccttttttcactggaagtaaaaagagcagaaaagagcagaggatgggtgggatcataaagtcaataagatacgggaagccatgatttcttttagcttcactttcccccaaggaagatgctgaaaaagtgtgaggagggctggaaacatcacctacctgagaagaggtgggtctggtcgcaatgctcagaaggcaggaggagaccagggcacccagcctctgccttcttattcataacttagggatgcagaaagaccttatcttattcccctactgtcctgtcccgaccattttccttcttctggtaaaatttaaattcctctctgcccagcatcttctcctttcctagaagcagtgatcttaaccatctttcttcctgaagccatgcttgcgtagatcctggtcatatatgagcttacaggtcatgaaagccatcactgaggttacaagccaacaattttaaggggttacacactcatttctacctcaagccttgatattgggcatttgccaaaatgcgagtggtctcctaataacaggtcactgattcgcactgcatcccttccccaagttctcttctggaaactgaacagaagaaatatgatttaaataaaatgaaaaacaccctacttttgctaccaatatttcctaaagttcaaattgaatttggatgctctatgtctgtgattgtaagcttttcaactctcagacagtttgaaggcaaagtaatctgtagctttggtataaggggaaagaaaggagagaaaaaaaatatgaagtacttgactgtcaaacttaataaatacattttaaaagctgatttttaaaaaataaatttttctgagttgccaacagagtaaacattagtaaactttggaggtatgtctcaattatttctctctgattgctgtgcattaacacattatacacaaagccctgaggaaacaagaagaaaatgttatgttaggtattgttataaactggattgtcagcatgaatgagtgaaaataaaattgctggaaatatttgtttattcagttaagccagttggcaataaaatagaatgtattaatgtctcagtagacaataacttcaatgtgtgagaatatcaaacggcctgggagtaagggcaagggagtgagagcaagagaatgaaaacaagagcaagagtgagagtgagtgagagatagagagagagagagagagagagagagagagagagagaagcagcactcactggatcacagggcacccagaaacttatggcagcacagcatcctaaagtcacagtaactgcactggcatggcctttgggcgaccttgaaaaagaaagcttcttattaccaagagaacaagttgtgcagatgctgttataagaacaaaccacaaaaatgcaaccaatgtaagaactataaacttgctttttatattattcggcaattattatcaatgcttttatctattgactcctgaatatttggctctggattaatttttgcacactctctatattacatcaaatactactgtgatgttttcatgctagacacatttcagaggaaagtgcaggaaattggatatagattgccttagttctgagaccagctctcccagagatttgctttgtaaccactggtaacagaatatttttgttttcctcattagtaaaataaaactaatgacacttgttctcaaatgtgtggaatagataatatggaactcctttgagatctctgggaaataatttgtaaaaatttaaatgggttagcatttaaaataagcaagtataaaaacaaatatgagaattattctgtatttatgatatgtcctgatccaccacaaattatacatcatgataattatagtgataataataattaccaattattgaacagatatgctctgccagccctattttatatattctaaaatttagccataaatactaccttcattttagaaattaagaaagacaccaggtacggtggctgacacctgtaatcccagtactttgagaggccaaggcaggtggatcacctgaggtcgggagttcgagaccagcctgaccaacatggagaaaccccgtctctactaaaaatacaaaattagctgggcatggtggcacatacctgtaatcccagtcactcgggaggctgaggcaagataattgcttgaactcgggaggcggagactgcagtgagtcgagatcacaccattgcacttcagcctgggcaacaagagcaaaactccctctggaaaaaaaaaaaaagaaaaaaagaaaaaaaaagaaataaatagattaagaaagacttaggctcagagatgttaagtaagtggcatacctggtatttaaactcgtggctatctgaccccaaaacacctactctaatgctatccctttagaggtgactgcctcattcttaaaatgtgctattttacatctaaaatgatgcatttcaattttatgataccattttacaccccctaagtgaattaatcactcacttctttataactctaccatccatgtgtccattcattcactcagcacatgcattaagcaccttctccttgtcagaccctgagccaggccttgtgatacagtggtgaataagacagtcaaggtctctgccttcatgcagcctaaattcaggtgcagaggcagataacaaagaactagaaaaaatgaaaacggcagattccaatttgtgctatggaagaaggaaatagaaattttaagataagactgggaggaactaatttagattagatgacctggcagagtctttctaagtactgtatatgacgttgtactgctgaattggggaggataagatttagtagctatgggaagagctgggtcagagagaccaacaagttcaagacccagagacaagaatgagtttgtcatatgctaggggcaggaagaggccagtgttgctataatatgagtaggtaatggcagactggtatacaatgaagttgaagaggtagacaagaagcagatcgtgattaggagtttgaatcttatccaaaggaattggaaataatttcctaatgatgtgctagaaccagttaccacctgtccatgggagccgattctaggcatctcttcccagctccatgttcagtgacatcacattggtagcttaaaatcagctatggtggtctttatctaggtggtggttacataactgtatgcatatgtaaaaattagttggactataaagcaaatatcagtacactttaccctatgctattataccacaaaaaaatatttttcagaaaaaagagagaggagcttacagtgaaaaattacataaagaagcaattcactattagtgagtcagtagtgacaaaaaccaggattagcaacacaaggactttaataaagcagcgatttgaaagagaatataaaataatagtgtttttaaaaaggcaagaaaggaaaatatgacagactatacctaaagagatgtggttacaaatttccaaatagaatgaaatcacaaattctcatattcaaatgtgcttcatgtttcattcaggatataatttggagattgctctaagaaagacctgatagtgaattgcatatgaagaatgatgcaaaatgagagctcaaggattacttctaggttctaattgacatgggaaaaaatgggaaagaaataggtttggaggagtgaactaagacctgtgttgtagttgtttaagatgcttattcgagcgccaagtgtaaaagtaaagcggcaattagaagaatctagagctcaaggtgtgcgcagtgaaaagaatttgggaattatcagaatacagatggtatttacagccatatttgtggatgagataccctgaggagaaaatgcagctagagacaaaaggacatagggctgagccaggtgacttcaaagtttccagactggatagagaaggagacctagcaaagaggaccaaggagggcctgtatgttgcatatttcatttctcagtgatgctgttagtatggtgtactaaaaagtaacctgtacaagaactcaatataacagaaacctagatcctgcttagttaaattataaaagtgctctgtgaacaatttttctatctgtaaaatgaaagtaatgactctttttcagtcaatttaataggatacacatgaggatccacagaatttatgaaagtaggtatgctttgtaatctaaagatgcagcggagtcatgtcctggcttttctatcagaatactcttagaggaccatgttgaaaatggctctattctaatttttttttatattctttaaagagtaatattaatatacttggtgaaccatcttgaggtcctggtacctactcttttctgttctagttggctaaaggacttgtcttactttaggtatatcatagaaaaagctggagggtgaataatcctaatcagaagaaattaattcaaagtcatgatgtctagggtctttctaattttgccgtcaacaaagcccatcaaaggtgaaagacacagggctttgccatagcacacagccagcctacctagccaaggcaaccctgttctcaaaattcagctcctagagttgatagagaaaactaatacttttgcttattatatacatttttctctgtttactattttagagtttctcaacagtaaataaaactcctataatagactagggatttctaatctgggtgaatattattacaaaaatatttttttcctagtgatggggaatgggggatggaaggatcatctccctgctttcatctaagatcctgaggactgaagtttctaaaaagtcttaatattccccgattatatactcaaaggtgtttttaacttggcactacatttaatccagtaaattttgaccaatttttaaaaatgtaattagagtccttaagtgatgtgctttcaccaagtggccaagcattgtataattcacagaaggaccattcctctgaaatgtatgctcttagtgagatgtgacttcacgaatgtaaaacagtgataatttacccttttttgtgtttctctctcgggccacatgctaattattatctctaagttacatttcatagtattcacaaaacacagttatgcattaagtacttctgtcacccaattatgaacgtgaagtttgtgagagccttgggaatttctcagactcttacatccagaaagtggtagatctgagattcaaacccatgcagtttgacctctcagccacgtacctgacctaagtaggagcttgtcttttaggcagctatagtagaactgtctgaaatgccattataggaccaataactagcatatgatggtttttctaaatacagagactactaaatttattttaagtaaagagggccaggcgcagtggctcatgcctgtaatctcagcactttgggagcccgaggtggccagatcacctgaggtcaggagttccagaccagcctgaccaagatggcgaaacctggtctctactaaaaatacaaaaattagctgggcacggtggtgcgcacctgtaatcccagctacttgggagggtgaggcaggagaatcacttcaacccgggagacggaggttgcggtgagccgagatggtgccactgcccttcagcctgggtgacagagtgagacaccatctcaattaaaaaaaaagaaaaaaaggaaaaagctctcttcattttaaatttagtagcaatttcaaggcttaaaaatactagtgaagcataaactctttgaagaaaacaatgtcttatccaaagaatgaactgacccacaagaagtacatactagaaaatgttttaaaactagaggcacttgaacggaaatagcaccggacagggaaccatctcatgggaagttgagtcccaattctgacggtaaatttttttcttgactttgaacaaggctttttacttttttcaaatctatttctcatctatgagatagagtcagatatagcagttcctttgtgcaaagggcataatcattgtggaaaagatgttatagtggtaatattttgagctacttgagaacagtactcaatgaaggtaagacagtcatagtatataaaataatcaaagccataatcagaagagtctgtacacttatataccatagttctcagtaagattgactgtcctggtcatagtcatatttttttaagaaagggcagaactatccaattctaatagtgcattgaatcccatttctaaagtcacagtatgcccattttgtggcatatattctgcctactgctaatattcctttagacagatggagtagaactaatgtactggaacatggctttcatttattttcttaataacctttgccatgatcaacagtgaatcacatcaccaaaggaccagatctggattgtgaccttgatttcttgatttagagaagtaaaaaaaaaaatacacatttttcataaaatcaaggtgtagaagaaataagttaatataaatatgaaatgccaagtcccttgaaattcatttgaacttttaaaatatctctttatcaaatcaaagatcaactaaaaatctatagcttaaacaatgcagcattttaaaaaaatttttttctctctcgatcaaatacagttagttgccttggaaaataactgagctatcatttcaccaaaacatgtcaaaccaagatcgcactatttttatcaggaaaaatgaaagagtcaaaaactcatccaagggagagtaaaagttgtgcttgcatttacttataccaaaaagtaggatgtagagaatactctttgataaaattagtatatgataagctggaaaggccttcagataaaggaacaagaatttacaactgtaaaacatgttgtaagaatgaaaaaacagaatcacctattgtcagtggcactactaaaacacattttcaacaagcttaaatatttcaaacgcctatcgaggtcgtgtgtttgaagcaaattcatcgtgtttcatatggcatacttcatatacaaaagtaataagggaaatgttcaaaattcaaattcaaactatcagactttaaatataagtgtccaatgcccagtggtcagacctacaccatggagagaaatttgactgaggataaacatatccataaaattccacagtattttattccttccaaggcatgttttatcacactggattgttgaagttcttgttcataaaaaggagagaacttttctgccaagcaaattaatataattaaggaaaccaaatgtgtcagcctatgttgaaactacagcagagttgagtaaaaactacaaggaattccttccagaaggaaaaaatcataataatacaatgtggtagactgagaacaggtttttaactacactaacttgtagtcaaactactactctgcttcttgcttaccctgcaactcacctgaataaattactcactgtccctgaaccttaggcatgaaatcagaatagcacttacctcagagactgctgtaagaatataatgaggaaatgactaacctggtagttttctctcttcacttatcctttagttccttgactctttctgatatttttattatattttattttatttatttttagagacaggggtgtcactagtctggtcacctacctagactggctctgaactcctgggcttaagcgatcctcctgcctcagcctcccaagtagctgggactatagatgccagccacacctggctttttctgaggtttttaaatctaattttttaaactatatttcataaataagagaaagatacaaacacacctctcatgacaaagtagtttaataatctggtagatctaagggagagactataaaagtagacattgttagagcagaatttcagagaacttccactaatattaacccaatgcttggctattacagaagagataactgtttacaaaggctgcccatgaccctttgatcagcaacatttatgaaaaagtcatccttatagatgtgaaaaatctatttccttataacttgcattcacacatcactgttcttccttctgaaggcattcatagatttgaagactattagatgcctgcattaagactattcactagcctaatattcctaaccactacaaaccttctgtcaagtgacataatttctcaaattttcatcattttgagccctctttaaaagatatattccaatatgttgaataatccttaaataaagctgaacatcatattccagcaatgtttttaccagcacagaatagtaataatgctaatattatgaacatttattgcatacttattatatgccctaaatatttgagatgcatatattttttagtgtagtaattttttcaaattttgtatttagtcatccagtaaaatgttagctggcacctacagtgaggcactatagaataacggttaaggattcagtcttcagagccacacttactggatttgaatgcagactactatttactagtctgtgacctgggggaaaataacttagactttctatgcctcagtttcttctattgcaaatgagattttaagatttgttttaatatcaagctatctatgtgaaacatttagaagagcgcctagtgcatagcaattgtcaggaatgttaatagttaccattattagtactgtagagaccaggtaaccatgtggaggaaatggacaactgaacaagaaataatataactcaacattgaaataagtactgtttaaaaataaagcatagaaggagacaggaagtgctaagctggaaggttttggggatggaggttagatatgtaggtgtaagaaggctgccatagggaggcagcatttgaaaaaacctgaatgaaataaaggagtgagccaaataactgcctagtgggacagtctgcccagaagagggaaaggctagcagaaaaggccctgaagtgagatgagcttggcagagatagtgatatttagggaaagcaagccatccagtgtggctagagaagaataagcaagttaggaggtgaatcagaaagttagcaggggccatatgatgtagtgtttcataggtaatggaaagaaagcacatagagataaaacctcttatctaagttgacagactgatacctattttctttgactctaaagcctgtaactcttaatcacattgctgcccttgacatgaacaatatattagattggtgcaaaagttattgtggtttttgccactgaaaataatggccaaaactgcaattgcttttgcaccaacctaaactttactcatattaaaattccatcagattttttggaagtcaagacacactgatggcttacattgtgcccttgtcagctgaaatatttaaatgtgttttttaatttttttattatgctttaagttttagggtacatatgcacaacgtgcaggtttgttacatatgtatgcatgtgccatgttggtgtgctgcacccattaactcttcatttaacattaggtatatctcctaatgctatccctcccccctcccccaccccacaacaggccccagtgtgtgatgttccccttcctgtgtccatgtgttctctttattcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacattcgggttggtcacaagtctttgctattgtgaatcgtgctgcaataaacatacatgtgcctgtgtctttatagcagcatgttttataatcctttgggtatatacccagtaatgggatggctgggtcaaatggtatttctagttctagatccctgaagaatcgccacactgacttccacaatggttgaactagttgacagtcccaccaacagtgtaaaagtgttcctatttctccacatcctctccagcacctgttgtttcctgactttttagtggtcgccattctaactggtgtgagatgatatctcattgtggtttttatttgcatttctctgatggccagtgatgatgagcatttaattatactttaagttctagggtacatgtgcacaacgtgcaggtttgttacataggtatacatgtgccatgttggtttgcggcacccatcaactcttcatttactttaggtatttctcctaatgctacccctcccccagccccccaccccccaataggccccagtgtgtgatgttcccctccctgtgtccatgtgttctcattgttcaactcccatttatgagtgagaacatatggtgtttggttttctgtccttgtaatattttgctgagagtgatggtttccagcttcatatatgtccctgcaaaggacatgaactcatcctttttatggctgcatagtattccatggtgtacatgtgccacgttttctttatccagtctattattgatggacatttgggttggttccaagtctttgctattgtgaatagtgccgcaataaacatgcgtgtgcatgtgtctttacggtagaatgatttataatccttagggtatatacccagtaatgggattcctgagtcaagtggtacttctagttctagatccttgaggaatcaccacactgtggacagtggttgaacgaatttgcactcccaccaacagtgtaaaagcactcctaattctccacatcctctccagcatctgtggtttcctgaccttttaaggattgccattctaactggtgagaggtggtatctcattgtggttttgatttggattaactgtgtttttttatgggaactcttgctaacttggttctaattcctcttgtatatctgtaactgattttggaagaggtttatacgtattatagttcatcttgctcaattattcctctcagctgtgtgtattctgataaacttgcctgctacattttcatttcaaatcctaataaaaagagtggactagaatagaggataaaatagtttgttctgactgctacaaatacctgcaggcttgcatgagttcattaaattatctctaagatacacttgtacaacaagttatgaacctacttttaacttttaaaagttaatccacaagtttattaaggaagatttgtctaaggttctatataattcacattaatttctaacctagtacatttatgagaaaaagaaaatcggaaattagtttagcatatatttatcaaacacaggaagactactaatttttactatctatgtttctaagatgttaatcttcttaatcatgtgtcctaattttttgccatggatattatacttactcaactgtagattatagttattatctgtttgaaaaatgaatcaacatttatctatcttatgacttatggagcccatactaattaatacaaattcctgaaatattactgacagtgattctgtgactttatctctaaacaaaatgtgtttggacctaagatatcaactctgttacagtagtgagattcagtctcactatctctctagtaccttgaaaccattttggtctactattagtatgttgaagaaaattaccactatgaatggataatatatacaaaaaataaaaaggaattggaactttacccaattactttttcttttcatcatgacatcatctgccataaactgagcctcatccctctttgttctcttgactgcaaacctggttataaaagcctttttttctttagcttttatcccaattctcattacactttggatttaaccctcttgatactattcgtagaagcttgaatcttcttttccctctgtccttaattaaattgtccatttatctcttttttctgcacataaatttttttatttttttaaatttttggttacagatatataataaatgtacatgtttatggggtacttgtgatattctgacacaagatataatgtgtaatgatgaaatcagggcaattggtgaagccatcacctcaagcatttatcatttctttggtacaaacagacacacatacatattttccaaattagagataggagtctcactctgacacccaggctggagtgcagtgatgcaatcctagcttactctaacctcaatctcctgagcccaagcaatcctcctgcctcagcctcagttatgactgcaggtatatgaccccatggctggtgagttaggccattcttacattaccagaaagaaatacctgagacgggaggtggctggcaagatggctgaataggaacagctctggtcttcagctcccagcaaaatcaatgcagaaggcgggtgacttctgcatttccaactgaggtactcggctcatatcattgggactggttagacagtgggtctagcgtacagagtgcaagctgaagcagggttgggcatcacctcacccaggaaacacaagagatcggagaactccctcacctagccaagggaagctttgagggactgtgccataaagaacggtgcactgtggcccagatactatgcttttcccacggtcttcgcaacctgcagaccaggagattccctcgggtgcctacaccaccagggccctgggtttcaagcacaaaactgggtggccacttgggcagataccaagctagcttcaggacttttttttcataccccagtggcaactggaatgccagcgagacagaacctttccatcccctggaaagggggctgaagccagggagccaagtggtctagctcagtggatcccactcccatggagcccagcaagctgagatccactggcttgaaattcttgctgccagcacagaagtctcaagtcgacctgggatgctcgagcttggtgcggggaagggagtctgccattactgaggcttgagtagggggttttcccctcacagtgtaaacaaagcttcctggaagttcgaactgggcggagcccaccacagctcctcaaaggtgctatagccagactgcctctccagattcctcctcttgggcagggcatctgaaagaaaggcagcaaccccagtcaggggcttatagataaaactcccatctccctgggacagagcacctgggggaaggggcggctgtgaagtcagcttcagcagacgtaaatgttcctgcctgctggctctgaagacagcaacagatctcccagcacagcgctcgagctctgctaagggacagacttcctcctcaagtgggtccctgacccttgtgcctcctgcctgggagacacctcccagcagggattgacagacacctcgtataggagcactccacctggcatctggcaggtgtccctctgggacaaagcttccagaggaaggaacaggcagcagtctttgctgttctgcagcctccactggtgatacccaggcaaacggagtctggagtggacctccagcaaactccagcagacctgcagcagaagggcctgactgttagaaggaaaactaacaaacagaaaagaatagcatcaacatcaacaaaaaggatgtccacacaaaatccccatctgaaggtcaccagcatcaaagaccaaaggtagttaagtccactaagatgaggaaaaaccagcatgaaaaggctgaaaatttcaaaaaccagaatgcctcttctcctccaaaggatcacaactcctcgccagcaagggaacaaaactagatggagaatgagtctgacaaattgatagaagtaggcttcagaaagtgggtaataaattcacctgagctgaaggaacatgttctaacccaatgcaaggaaactaagaacgttgagtaaacgttagaggaattgctaaccagaataaccagtttagagaagaacataaattacctgatggagctgcaaaacacatcatgaaaactttgtgcagcatacacaagtatcaatagctgaatcaatcaaacagaagaaaagatatcagagattgaagatcaacttaatgaaataagtgtgaagacaagattagagaaaaaaggaataaaaaggaagcctccaagaaatatgggactatgtgaaaagaccaaacctacgtttgactggtgtacctcaatgtgacagggagaatggaaccaagttgaaaaacactctttaggatattatccagaacttccccaacctagcaagagaggccaacattcaaattcaggaaatatagagaacaccacaatgatacgcctcgagaaaaacaaccccaagacacatactcatgagatccaccaaggtagaaggacaaactgttaagggcagccagagagaaaggttgggttacccacaaagggaagcccatcagactaacagcagatctctctgcagaaatcctaccagccagaagagagtgggggccaatatttaacattgttaaagaaaagaatttcaacccagaacttcatatccagccaaactaagcttcatcagcgaagaagaaataaaattttttacagacaagcaaatgctgagggattttgtcacagccaggcctgccttacaagagctcctgaaggaagcactacatatggagaggaaaaaacggtaccagccactgcaaaaacataccaaattgtaaagaccatcgacactatgaagaaactgcatcaactaacaggcaaagtaaccagctagcatcataatgacagggtcaaattcacacataacaatattaaccttaaatgtaaatgggctaaatgccccaattaaaagacacagcctggcaaattggatagagtcaagacccatcagtgtgctgtattcaggagacccgtctcccatgcagacacacataggctcaaaataaagggatggaggaatatttaccaagcaaatggaaagaaaaagaaagcaggggttgcagccctggtctctgatattaagagactttaaaccaacaaagatcaaaaaagacaaagaaaggcattacataatggtaaaggaatcaatgcaacaagaagagctaactatcctacatatatatgcacccaatacaggagcacctagattcataaagcaagttcttagagactacaaagagacttagactcccacacaataatattgggagactttaacaccccactgtcagtattagacacatcaacaggacagaaagttaacaaggatatttaggacttgaagtcagttctggaccaagcagacctaatagtcatctacagaactttccaccccaaatcaacagaacatacattcttcccagcaccacatcacacttattctaaaattgaccacataattggaagtaaaacactcctcagcaaatgcaaaagaatggaaatcataacaaacagtctctcagacaacagtgcaatcaaattagaactcaggattaagaaactcactcaaaactacacaactacatggaaattgaacaacctgctcctgaataactactgggtaaataatgaaattaaggcagagataaataagttctttgacatcaataagaaaaattcataatgtaccagaatacgtaggacacagctaaagcagtgtttagagggaaatttatagcactaaatgcccacaggagaaagcagcaaagatctaaaatcgacgccctaacaatgaaattaaaagaactagagaggcaagagcaaacaaattcaaaagctagcagagggcaagaaataactaagatcagagcacaactgaaggagaaagagacacgaaaaacccttcaaaaatcaatgaatccaggagatggttttttgaaaagatgaacaaaatagatagactactagccagactaataaagaaaaaaagagagaagaatcaaatagacacaataaaaaatgataaaggggatatcaccactgatcccacagaaatacaaactaccatcagagaatactatgcacacctctatgcaaataaactagaaaatctagaataaatggataaattcctggacatacaccctcccaagactaaatcaggaagaagtcaaatccctgaataggccaatagtaagttctgaaattgaggcagttattaatggcctaccaaccgaaaaatgcccagaaccagaaagactcatagccgaattctaccagaggtacaaagaggagctggtaccattctttctgaaactattccaaacaatagaaaacgagggaatcctccctgactcattttatgaggccagcatcatcctgaaaccaaaacctggcagaaacacaacaaaaaaaagaaaatttcagaccaatatcctaatgaacatcaatgtgaaaatcctcaataaaatactggtaaaatgaatccagcagcacatcaaaaagcttattcaccatgatcaagtcagcttcatccctggattgcaaagctggttcagcatatgcaaatcaatagacgtaatccatcacataaacagaaccaatgacaaaaactacatgataatctcaatagatgcagaaaaggcctttgacaaaattcaacaccccttcatgctaaaaactctcaataaactaggtattgatggaatgcatctcaaaatagtaagaactatttatgaccaacccataaaaccatatgaccaacccataaaacctaggcaatagcattcaggacataggcatgtgcaaagacttcatgactaaaacaccaaaagcaatggcaacagaagccaaaattgacaaatatgatctaattaaactaaagagcttctgtacagcaaaataaactatcatcagagtgaacaggcaacctacagaatgggagaaaatttttgcaatctatccatctgacaaaaggctaatatacagaatctacaaggagtttaaacaaatttacaggaaaaaaccccatcaaaaagtaggtaaaggatatgaacagacacttctcaaaagaagacatttatgtggacaacaaaaatatgaaaaaaagctcatcatcgttggtcattggagaaatgcaaatcaaaaccacaatgagataccatctcatgctagttagaatggcaatcattaaaaagtcaggaaacaacagatgcgggagaggatgtggaaaaataggaacacttttacactgttggtgggagtgtaaattcgttcaaccattgtggaagacagtgtagtgattcctcaaggatctagagccagaaataccatttgacccagccatcccattactgggtatatacccaaagtattatgaatcattctactataaagacacatgcacaagtatgtttattgcagcactattcacagtagcaatgacttggaaccaacccaaatgcgcatcaattatagactagataaagaaaatgtggcacatatgcaccatggaatacaatgcagccataaaaaaggatgagttcatatctttgcagggacatagatgaagctggaaaccatcattctcagcaaactaacacaggaacagaaaaccaaacaccacatgttctcactcataagtgggagctgagcaatgaaaacacatggacacagggaggggaacatcacacactggggcctgtcagaaggtggggggctaggggatggatagcattaggagaactatctaatgcagatgatgggttgatgggtgcagcaaaccgccatggcaagtgtgtacctacgtaacaaacctgcatgttctacgcatgtattccagaacttaaagtaaaaaaaaaaaaaaaaaaaaaaaaaaaaaaacagaaagaaatacctaagactgagtgatttataaaggaaagaggtttaattggctcatggttctgcaggctatacaaacatggcactcacaactgcttatcttctggggagcttcagggagcttttactcgtggtagaaggagaagagaaagcaggcacatcacatggtggaagctggagcaagtgtggcggggagctgccacacacttttaaacaaccagatctcatgtgaactcactcatcaccaagaggatggtgctagctaagccattcatgagggaaaagcccatgatccaaacacctccgaccaggccccaccttaaacactggggataatattttattgtgatttggtgggacacagatccaaaccctagcacctggctaatgtttttatttttatttatgtagagacaggattttgctgggtttcccaggctggtctcagattcctggcctcaagcagtcctcccaacttggcctcccaaagtactgagattacaggcatgagccatagggatgcctagcctacctatatattttatacagacatcatggatcattctatgcaataaaattgttttctttagatattttacccacggtttctatttttaatttcaatgcttttgtgtttgtattttagcaataaatatttttatttaatatttatttgataaatatttatatttaatatttatttgataaatatttatttctcttgagtgagcttccttcatatggttatgaccttacatttatacttaggttttctctgagcatttaaatatatcctttttggtgtttattttttaaatgatatgatgtttgagatttacttcaaaataacctgcaacaggcagtagggggagtcagataatggaatggacaaaataatattggttatcggttgctgattgttggagatgagtataatgagtgcatgctagctcattatattgctttctccatttatacgtaagtttgaaattttcctcaatgaaaaattaaaaataaaagagattgtatgttagtaccagctttttagagagtactaacagagccctaataatgcacaccaccaatttttcttaaattgtgtttatcataattttaaaagcttttaattctcagggtagttttaggtttacggcaaaattgaaaggaaggtatagagattttccgtataccatttgcccctaaacatgtatagcctcccttattattaacatcccccatcaaaatggtatatttgtcgtaattaatgcatctacaatggcacatcattatcgtccaaagtccacagttcatgttagggttcactcttggtgttgtacattctgactttggacaaatatatgacatgtatccactgttatactaccatacagaattgtttcactgctctaaaaatcctctgcacttcacctacttactccctatcccctaaaccctggcaaccactgatcttattactgcttccatacttttgtctttcccagaatatcatgcaattagagtcacagaatttagcctcttgggattggcttctttcacttagtaatatgcatctaagtttcctccatgtcttttcataacttgatagctcattttttaagctctgaataatgttccattatctggatgtacaacagtttatttatctattagcctactgaagtacatcttggttgcttccaagttttggaaattatgaataaagctggtataaacattcatgtgcaagcttttgtacagacacgagttttcaactcctctgggtaaacaccaaggagtgcaattgctgaatcatatggtaacaatatgtttagtaagacaccaccaaactgtcttccaacataattgtactattttgcatttccaccagccatgaatgagtgtctagtgctttaaattctcatcagcatttggttttgtcagagtttttttttttattttggccattctaatagtgtgtagtgatagctcattattgttttaatttgcatttccctgatgatatacgatgtggagcatcatataataataataagatgtcatatgcctacttaccatctatatatcttttttggtgaggtatctggtaaggtctttggcccatttttttaatcaggtcattaattttcttagcattgaattttaagttctttctatattttggataacagtctttatcagatgtgtcttttgcaaatatttttccaaggctgtggcttacatttttatccccttgaaagtgtcttttatagagcagaagcttttaattttaatgaagtccagtttatcaattttttggattatgcctttggtagcatatctaaaaagtcatggcaaaagccaaggtcatctagattttctcctatgtcatcttctaggacttttatagtgtgtgttttgcatttaggtctgtgatccattatgagttaaattttgtgaagggagcaaggttactacctagatttctttttttctctgtgcatgtccagctgttctagcaccatttgttgaaaagactatcttttctctattgtattgcctttgctcctttgtcaaagatcaaattactatatttatgtgagtctatatctgggctctctattctgttctattgatctctctgtgcgttcttttgccagtaccacacttcctagattgctgtagctttatggtaagtcttaaagtcaaattgtatcctatggtagctttattgtaagccttcaagtcaggtaatgtcagttttccaactttattcttcttcagtattgtgcaggatagttttatagcagtgaaaaatgcaaataatgtaaatgtccaaccatttgttcatgactagtgaaataaaatttggtggttatgatgaaatacactgaattattaaaagcaaactgtcagtcttaggtaagtaaatgcaagtttctaaatctatattttaaaaagcaccatttatatccctatctgtctaaacatctgttgagttttttaaaacgtcattgtttccatttataatatcctttatattttcttagctctctaaatggtgtatatcttgttgacctgaaccactggtcccctcacttaaacatgtttctttctgttgaacgtattgtagcaattcattttctcattttggtcatgagttgtgactattgtcttttatgaaagtaaacattcagtcctaaggacaaactaaataagcttatcttttctgaatgtatcgtatagatttgtaccaaaaataaaattggcccaaaagccccactgttgaagatatgtatcatgtaactttatttcttaaagattgtattagagttccaagaaaaagcctacaatttattataaattaaatgaagcataacaatagtgtgttttttaaaaaaatctcattcccacaaagcaaagtcagatctaaaaggaaaagtggccatgaagttctctgtaggcttgttttattttatcttttcagtgccttggtacatagattagcttaaacatttgaagaaatatgtgccatgaagaaaagtttttgttggattctatgaatacatttttatttatcagatttagtttgctcacatttactatttattgtagtgtttcttatgctatcaacaaacatagctaaatgttactacattttaatagagtaacactgatttcaaatctgtaaattaaataatgaaaaaaataaatgagaagaaaaagatgttaatattaattgaggaaaattttctgaggtctgctattgaccaagaaaataaattatatgtaaaattttacagtggaaaataaatatatagaaacttggcctcctcagtactatcctttcagaaattaataaaaaaggtagaagatattattaagtcagataaatgccagagaaagggctttttaaaaatctataagtttgaaactgtttcatagaaatatgtcaaagtctgaacttccctgacttgattttgcgtgattggcattcttcaagggacaaagggagttttctggtgcaatctgcctaatggatgtccttttatttatttatttatttattttgtttcattttcctttcctatttctcagatgttcttagcttgaaaggtttattccataggttcagtggtcttctttagaccagaaagaacttaggtaagacatgaagttaaggtcgcactgagtgcactttccagtagtcaacttagatatttgtcaaaagtagtatgacatttggcaaggtaattgacagtagcactgactttattctcttaacatgttgacagcacacaaaagctcaaaatctgctttttaataagtggatggtacccctaggctaaagaataatgagtgtacattttggggcatcttctctttatttaacctgccatgctgtactttatgtattagaagtagacaccacagttgtctggtttgaaaatactggtcttataagtcagtatccctctgcataacagagatgagctagcttttgccaaaaataaaagcagggagagaaagataaagaagggtttgtgaaattcatacagtagaatttcaggaaaatacagcaccatattacaaatatacgtcactgtttactcaatttatatctgaaataatttgtaactactcacctgataatagattttagcatcccacaaaaatacttgtcaaataaatattctacattttcaattagaatgagaaaacacttattaaatgcattttacaaaaagaaatattatatggcttttgaaataaagaggaaatcttaatataaaacatatctagttgcaattgaactgtcaaattagcttaattatagaactttatataaatatttccttactaaaagattttatttcataaatgatctcttaaaagtataacaatagcaataaagattataaatacctttaagaagtgagtcattcattttaaaaatctaccacaggtaataaaatattatgaaacttaatacaccacacacatgagattaccagtaaaactgagaaaatctgaataacattggtggatttcattcatatcaatatcttgattgtgaatattgccctatggttttgcaaaatgtcaccattggagaaactaggcaaagtgtacaaggtgcctttcttaccactgcaaatgaatctacaattatctataaaagtttcaataaaaaaaggaaaaaccctacatttttatggacagaagtttaaattttcaggcaggagaatataatcaatcttatttctgttgcacgaaaaaacctattgtattaaaaaataaaagaaaatacattctaaatgcaaacataatttaagaacgaatcaatctctaataaagtcaatagagaaatgcaatgagtaagcaaattattccataaaaagtatggttcacatgcagaaaagaagaaaaatctttttaagcaaatagttattccttctttaaatcctagcatacgtctaacctctttcttcattctcattctccaggtttaaatctaagctttcttcgcatttagagtctaaaaattcttaggaatcagtttatctctgaagagttatatatagcatcaaggaaaagatacagtttcacacaatcacgcacatgcacattatcttgccctttttagaactgatagtataatttagaggcactatattagagtatgaaaactttggtggcttaacccaacaaaggtttatttgacactcatctgaaagttcaatgcagtggtgggggatttgctccacacagtcattcagggaacaaggattttttctgcgggtgatttatcatttttctaagacgtcaatgtcctctaccatatttctacacctgactggcacaagcgaagaacccaaacacccattatttagagaatggaaaagcaaattgtgacactatcaggatacaggatactactcaacaatgaaaagaaacaaatgattgatgcacgcaatgtgcagtattgtggattaaactaagtgcaagaagcccagactcaaaaggttacaaactctataattttatttatatagggcattctagagaaaataaaaccaaagggacaaatgagtagttgccaagactaggagctggggaagggattgactgcaaggagatgaggggatttttgaaggttttagagatgtgtatattttgattatggtcatgattatatgattatatacacttttcaaaactcatcaagttgaggctgggagcagtggctcatgcctgcctgtaatcccaacactttgcaaggctgaggcgggtggattgcttgaggccaggagtttgagaccagcctgggcaaaatggcaaaaccctgtctctactaaaaattcaaaaattagccgggcatagtggtgcgcagctataatcctagctacttgggaggctgaggtatgagaatcgcctgaacccaggagatgggggttgcagtgagccaagcttgcccctctgccctccagcctgagtgacagtgccagactgtctcaaaaacaaacaaacaaatgtcaaaaaaaaaactcatcaagttgtgtgattacaaagaatgaatttttttatatatgcattatatattaacacacctgactctttaaaagtttaatacatgctttatactttttatctcaactttcaaggttagaccaggagaaacatattttttaaatgtctgcaaaagtatcctcccttctgtgccactgtaaggggtggtcagcagagcagcagcagcagcagctctgggagctatttagaaacactcttttgcccccttctccaccttccctttgcagaccttttgaatcaggatgtctagttgtggagcctaggaatctgtgtgctaacaagctccttgggtcatgccaaagttttaaaagcaatgatggtttataagaaaatacaaatcatgattatttttccagcaataaacatatacttcacttatagtaaatttaaatctgatatggttatttccccccacattcctatttacaataccattttcattttcacattgtaacattctactgtcatgttaactaccttttaaacaatttaagttgtaatttgagcttgtgctatattaccaatgcattagtaacactcgtacaaatcaaagcaaggaagtttccaacttctctgccaaaggattgagaaaggcgtcttctgatcttagattaattttacaaatactaaaattttaaaaataaaatgttaactggtcttagatttgtgaacatgaaggcatatctcttaaaatttccttatctaggttaagatgaaataattaccaactctgaagaaaaggctaaaataagacagataatgtaagatatatgtgtgttgtgttgggaaataaaaggcacaaatttaacagacatattttcacttgcgttgtgccagacttgctcagaacattaatgtaagctttgcccatggcttgctgagtggtccattctcctcttgagacttagagaatggaacagtaaccttgtgaccagggtcactgccatgctcccagccttgttgatggattttagaggcagcctaaactaattccatgaacagtgaaaatgcatttggatttaaatgttttataggctgtctgtcacttaccttctggaagttagcttttactctgcttcattaaaccaacttacagtattcacaacagactggcattcacagaaacgaagtcatacacttatgaaatcctttatttattcaagtagcttggagaattacaaagagtatgagcctaaaagtcagtcagacacaaatagatacaatctcagctctgccctatctgtgtgtattgggacaacatacctaacctcctccaggttctgtttcctcacctataaggtaggaattagaatagccttgcaagcatggtcattgtgaaaattgactgagataataggataattattattttttattgtttaatgaacatatcttaagagtcttatctgcttcaggcactgtattccctaggaaaaggaaggcacacaattaaaataagacatgattttccccctgaggagttccatggttctcaaagtggttggtaatccccttctagggattcctaaaactgtgtggagatattattggatgttacaaagactggaggtgctattgatacttcatgttcatggattctaaagattctaaaatgcatgggacagcctgagcaacagcaaaataattatcctacccaaaatgccaatagcaccccaattgagaaacaccgtagtagaggaagctgaaatgaatcgactataataatggatagaaaacaaaacaaatttcataatagatagatgcagtaagcacatcattaacaacatcataaccatcattgtaataagacaatagtcctttacaagacagtttgcatcatttcatttaatcctttgcaacaaaccatcagggagtgcactatatatctgtgcttcacaattttcatgtgtgtaagaaccaaatggggatcttgttaaaatgaagcatctgattcaataactgtactttaaacaactcatcagggggccacactgagttggcatgttatgtataatcgtagggaacactgttggtattgtggccaaaccccctgagacacctgttaccatttttgtgctttctgcgcccacctcaaccctgcgcaagatttacttccaacacctgtacctgtgattcccctgggcaggcactgtggctactggagctgctttgccaaaatccgatataaagttgtaaatgcctggaagtttagatctctctagggagaacttgagttaatgactagctggtatgagagtatgaaacctcaattcctttgccaaatcaggacaaactctgaggcatcacttatccagagtcccctgcagaatttagttcaagctactgtcttctggactatgcctaaaatcatacctttacttgcccttctatttccctgccctcctttcattactcccaccacagtttcctgtgggaacacttactcaataaatcactcgtatataaaacattatcttagtttctgcttctggagaagcctactctaatacatcctcaatttctctcttttcctcaactcacgcatccttttggttcaccttccaaattacatcccaaatccacccatttatcaccaaatccagtgctacactcaggtcaaagcttccataattttacctggactcatgcaattgccttttgacaaccccaatccattttctgcattttcctgagggatcgtttgaaaagtaaatgatattatgtcacttttatgcttcaaatattaccactacttccttttgctcttagaataaactccagacatcttactatatctacagttgtttacattctcaggtccctacctccgtctttactgacatctgctaacaaatcctagctttgcccattttccttcagccgcactggtctttgttttttcttccatgtgtatttcacctcaaagacactgtgattctgactgtgctgttctctcagattttctcatcattcatctcagttcaaatgttactttaaaaaaagaaacctacctgactacccgatctaacatagaatcccatatcctccaacactttccatcataaattactgcagttattttcttcacaatatttgttattatgtcacattaacttgtttgcttttgtttgttactgcttacttattgacatgctctcaatgttattagaatatgttaataaattcttgagaccagggaccttgtgaaatgtatcatcaatgtctatagtaccttgatcataacagaagcttcattaatattttttaaataaatgaaatataagtgattctcatttaagagatgacaaaaataaggctttatatattacttgtccacagtcacacaaggtcactcagtagccagtggtggagctgggactcagctgagctcttggtcatgtgttatacttttcccctgtttctggagtttgttctgctcaagaactctgatcaaattcagcctcattcagcctcactgttgactcacagactttcccttagtatttacaccacataatgctagaatggaacttcttaggttgatattgaggaaggagaaaaataggaaagctaagtaagataagtggaggaagatagaaaaaagtggtggagacaataagttggttaaggggctgtcggggaaaataactactctagaggatagcaatcatttattttaaaaagctttattaagtgatgcaaatgattctgctatgggtaatgagataaacacccagcaagcctaaagcttgctaattaccctgatctaatcacttacattatgtacatttcagaacatcactgcgtactctatgaactccatgaatatgtacaattgttatttgtcagctaagaactacattaaaaataaagcaataaagtatatgttgaaaaaattaattataatacaaagaaaattacagactaaggttactatgttacataaaatttataattatagacatcttatggatttagtttgatagtctagctgtagatggctgggcatcaggtaaattggccctgaattcctctcattgcctcttcatatggatttacaaaatggtaaatggaggcataaaatccctaaagaaaactacttccctctccttctgcctttctttcattcatccatttattcatccctgttcattcatttaacagctatttataaaacatagagagcgagcaagagggtgagagagaatattattttgtctgggatgtcaagataagtttctttgaagaagtttaaactgagctctgaaagaagactaggaattaattattgctactacttagtgtatctctagtatgctaaatagaaatcaaatagagaaggaatgttttgggcagatggcaggggtgaaggtcctaaaaatgtagggctcatgaaacataccttctttctctgtttcatcttgaaatctcatctctaacaataaatacaagtaactttcttgaggttatttttccccagaagtatgtggaagaaatgcatataatgtatatagtatatataattgtgcatattattacataaattatgtaagtatgtattatatctaacatatctgtagagacagttgtggatgattgccattgaaagctaactttcatttgagtagtgcagtttcacattaaactgaacttgggcatgaatttcagaaagagtatagaaagggttaggccctttttaggcccaacctaaaattttaaagcctttaattgaaaaatttatgacagtttcaggttagtcatttagactaataaagtttagcaacatcacatcatctgtaataaattgttgcttatcataaacctattagggaagaaaagtttaagtcaagaaaatgtatatataaaagtaatgcttattttatgggaaaagtaatgcatagtaatgcatagctcaacatggaaaggtatgaaatgaaaagtaagaggaatgactcagtgtgttacagaaaagggaagataagtttgtgataatatggaggcagaaccgaagtttcagaaacagaggctaagaattttactccccagctctgttaaccttctagatcactggcaaatggaaaaaaggatagtggatggatcaggcttaatcgcagaaaaggtttcatgatatttggatacagaaaggttttttaaagctaattttaaatgaattaaacatcagaagcaaatgagaaactgatggttgctggttggccttcctctgaggtaaaaggtcaagtgattgcttgaaagatcatctaacttggcctatgaaatggaatgtgttcattttattcagaacttattcatgtgtcaaactttagaggattgtataaagacatcggcaaaactcttgaactatctgatacgtctatttcatataaaatgcaaaaaattgtgtaattcaccctttcaaagaaccataatcatttagaaggcagtatgagaagcatttcatttagcctatcaaggtgacctaagatagttagtttagatgtgtaagcatatgctctagtattttgcacgatatgctttgagttccattatgagcatttcaggtagaaattcatttttcaatcattttcttctctttttagacacatatataatttaatataattttagagacctcattatattataattttgtcctctcttctccactttttaaatgttacatctttcctatttgattacagtatattaaaataataatgagcttgtcagtcttatgattgacatatatagaatgtcttattttagctaggtcgaaaaaatgaaacaattctaataaaatatgtatggtaaatatgatagatagacttattgcagcaaaggaaacttgaaaatagaatttatttattcattacctgtgtttccatggctacatctcaggcacacgaccacacccacagtagcatttatacccattcatatcacccctttcctggtcagaatatggagagaggggttgccatattgggtcctaagatacagcaacctgcagcacatgcttttactaaattgcagcctctcacttattttctcaggtctgtattattgtacatattttaaagaagtgtgagtcctaaggcaaaatttaactgcgaaatatataagtagtacatcatttccccctagaatgtaagctccaccagggcccagatctttatcagttttgttccctgaagtatatcatgtacctagatcagtgcttagcacctcgtggaatacacaggagagagacagagagaaagagagaatatataaattacatatcaggctgacctgctattccaaggcaggaatgtgttcagttaactttgagtttttattgttctttgctacctgtcagactttgcacatatcccattatctttcatcactaggcccctattgtacaactcttttaaagtatcttgagtaagattagaattttgaggtaccttttcttatttccctgctatttaaaacaagagacagaaaactagcactaatggagtgtccatcatgtgtctggcacagtgctatacatgttaatgtatatcatctttttaaacaaagaagactgaaattggtctaatgcaacatgactgtatgctgcctttatcttcatcagggtgctttcaataatttggacagctgcaaatgagattgctactggatagctgtgaatcaatttaataatgcagattaacttgaaacatgagagagacatctatgggattttttctgccagatcctccttagtaaagcatggactatctattaatattgctgctgctggactttttaattctatgaagtatatccagatccccctttacataatttttaaggactatggtgctaacattttagtatatctctagtatgctaattgggaatcatagatatccttcttaataaaatcatgttcttttgggagctttgcaaccttcatgtaaccctggaccactgcaaatagagttccacatgtagataaaacattgttgaaataatttatgagttggaacctaatacaaatggattcaaattccaactccacaacttattagctaaacttagattcctgagacttagtttatttgtaaaacaggaaattatttcagcactgttgtaagaattagagaaatcatgggcaataattgaagggtagatactcaataaggatgctataatcattgatagagggtagagataggaaatagtaatattttacctttacatttgtattttccatttcaacatatgttcagaataaaggtttgggattgtgacttaaattcacagtccctattcaatgcccatctttcctccaaggcacaaattgaattgtacttcctccagctatgcctatctcacattgatctcttccagtatcatttatctttcctgtagtgaaaattgcttgcaaacacatgccagaaagcctgtgttaaatatgaaatttttgcttccttcattatatgactttgggcaagtcagtttacatttccaaggttcaatttccatcttattaaaatggctgtggaattgtactgaatattgtattagtctgttttcatactactgataaagacacccaagactgggcaattgacaaaagaaagaggtttaattggacttacagttccatgtggctgcagaaggctcacaatcatggcagaaggcaaggagaagcaactcatgtcttacctggttggcagcaggcagagagagagagcttgtgcaggggaactcctctttttaaaaccttcagatcttgtgagacttattcactatcacaagaacaacacaggaaagacttgcctccatgattcaattacctcccaccaggtccctcccacaacatgtgggaattcgagataagattttggtggggacacagccaaaccatatcaaatattaagtaagataacgaataaaagatattcaaaaactttatagtgctttataagttgtctcagttatctgtggctgtgtaataaatcacaaaaagttggtgagctaacacaataagggttatttctcaactctataaagtctaggatcagctgggtagctcttctgctcaaaatggtgtccaaggatggcttcttcactcactcgtctggtgccttaactgacctggctagaataactgattctagctgggcatctctattaccatatgttttctctggcagcatagccagaacattttacatagtggttcagggatcttaggagagcctattccaagagaaactcaagtcttaccttgtattatgcttgttaatgttttattggccagagcaaatcacaggacttatcccacagccaatgtgtgaggtgacaacacagtcacatggatcccaggaggtgtagttcatttggggccaccaatgtaacagtctacacacaaatgtaagcagtaattgacattcccatttcatttctattactttgctataccacatattttggcatttgttttgcctccatagtcttcttcattggttcacgtgtgtactccttgtttcaagatgataaattttctagtggcaaggactctgttctaacatcatgttaccttgattctaacatcaaagctaatatttaatgatatattggaatatgtaggctttgatggttttgtagaagccgaatccttcccatatctgccacttaacagccattgtggccctgagcaagtatttgacctctttgagcctcagttttcccatttgcaaaatgaggataataatggtttcttccttcacatgattgttataaaaattaaattagttaataatatgagaaaagaatagtgcaggtccagaataaattttaaatgttagtgttatattttactgatataaagatagcctgatgtacttgtttaatttgtatctgatctctcatccatgggccccagtttaatacttcataaaggaatagatttcttgagtaattcacacagaaatattttacagcctcaaaatttggagtatttatatataaaataaattctatattttagcactgcattctcacaagttagtgaaggccttgatatttttgggcattggtgtttttaattctaaaaggaggaaactattctggttgtattcctaacctttttgagtttgggcagtcttatttggtaatctgagttaaatacattttaaaatagttatgctaagatattttaattgagaagcttgtgatatttattgaaacttctatatagaattcacttacctgtaacatcctatgatataaggatattttggtattgcttacatgtgaaaatgttaaagtggatataggcactcaatgatagtcaagttatccctgccactatgctaccctttagaatttaagacctccttttgagcaaggaatgtttctggcagcatcaatagcaatcaattttctactcacattctctcttttccacccagtgaattttactgccttatgggcagcaacagttgtaccctctgattgactccactactctcctcttcacatccaaaaacaaaatccgctgacaaaatagctttgctttgggaagagattgaagggattagaccacaaaatgctactttttgggggtcaggacaagtagaagttgaaatagtcaatatatttattttgcaaacactattttaattaacttttggtcattttaacaataacttcatagatatttaaaaacctgataagtatcactttgcttttttgcattagaagctattaaattatctatatatttttcaaatatagagaatattgcccacatgaagtacatattgcccatatgtagttcacaacacttttttgacgttttagtgagtctgtgttgctggttcttcgatacgtgtgcatttccttttattttttttctcttgatccaagaattttctttaaagagatatgctttccagaagaaaaggaacataaaagtacatatgtgttttagtgttcagagtatattcaggtgattcatattggttgggaggggcaggagatcaggtaaaaaagggtgaagaaaagaaagaggacacagttttcctggaaatggaaggatgaaaaagaaaaatgcttgaacaaatattgtttctgttttctcattgatccaggaaaaatagtttagaagtatattcaaattgcctaggtccatgtttttaatataacaggaaaattatacaaatcaaaaaatcatctgcctttccccaaaaatgtgtgtttttttacccatttggtttaatatagacaaagagtctgccatttcttccttaattaagcatgtattaagtgtttacactcaagcgtcatacaaagccctcaaatatcttaaagcccagtgtggcagacagaaatatgaaggaataaggtcaaagtacaattatggatttcctaataaatgtctgtgctttgtaagaggagggggtgggcatcagggagttgtcatggaaacatttatagaagagaaaacacttttaaatgcaaaggcagccactaaaaaaccacagtgattgaaggacccttctaattcaaaaatataaaaaataaaagggaaagtgtaagtaaacaaaagaagaaacaagatgataattttccccaaattcagtcaagatttaggatatgaagaaagagtattgaaaatacattgtcatgcatgtattaaattctgtttgaaattctatcagtaaatgtttgccaattttttggaggaaaagattacatattttggtgcatatttattcatggaacaaatgctatgtgccagaccacaggagttactgggaacaaaatggtagggataaaactagtccttgccttcatggagctgaaagtgaacatgaaccaaatgtttccctcaagtcttctgtactcccctttacaaagtgaaatggcacaggcctgaagtgttctgtgctttataaagcgtgcaagtagttttgtcagctttctggaaaaggcctaatattattaggaagcaaatttgcatttaatatctacttaactcaggtcatattgttttctgttttgactttaaaaagaaaatgtgatgggtaataacaataaaatgggcacaattatttagaagaggcgtgtttgtgccaagaaaattacagaggcagagtaagatttgcaaggagatggcatttttctcataattgctctctggatgtgtgtgcagcaggtttcatttgagggtggccactgttgagaacttctttcacagcaaagtgctgctacacctaaagttttatctgctcttccgtggtttcatcttagctaccatagcaacactaacagtgctattccaccctcccatcaacattcaggagaaggcttctcttgtctgcacgggattgcgcttacatccacttagagagcattcccaattcatcagatgtatatcttttagaaacggtttcctgaggagaaaaataggtattttgagagatggttatgatatttttagcccactgagcaattttgatagccttatcatagacacagatccaggttctgtgggttctaaagattatactgttaaaagtggggaggggttggggatggaaatactgttttttgaaaagaatacaaatttacaaattcaaaattagatacaaaaatgaatatttacttaggatgagaaaagcaatcacatcacattacaaagctcggaaagctgatatataggtatcacaaactccagaaaaagaaccttgtcttgttttttgtattttttttttttttttttttttttgagttggagtctcactctgtagcccaggctggagtgcagtggctcgatcttgggtcactgcaagctccgcctcccaggttcacgccattctcctgcctcagcctcccaagtagctgggactacaggcgtccgccaccacgcccagctaattttttgtatttttagtagagacagggtttcaccatgttagtcaggttggtctcgatctcctgacctcgtgatctgcccgcctcggcctcccagagtgctgggattacaggcgtgagccaccgcacccggctgccttgctttcattaactgtcagacattcttccataatagtttttcctataattttatatctgtatactcattgatttcctctttatgaaggacttcgtaggagcatttctggagagcaattagaaaatgtctttccactagcatagtgatccaaatcaattttttttttattcttgacagtctgaaataacttctttcagcttcacagctcattattggttatgacatgtacatttttagaattgttgcaaaatttaggaaatcctctatcaagtttattttgtatgtgaactgtcagatttggaagaatatttcacagactagcttttggctctgaacattccaaaccgtttttctcctccactacccacacagttccagtgtcaagcaccagaggacacgttcatatcacagtacaaaatccaactctggtaccttttgtcgggaagctcaatattgacagcccaataggtgataggaatattccagtcctgacagctggtaactgcaaaactttaggtgatctgcggtcatttccacacaattaaccatatagggaaatgaccccaaatcacctaaagttttccttcctaaacttatttaaaatatacccaagtgaaattcctcttaccctcatgcaaaaaaaatacttaaggctattccatcgccacctgaccaatgggaagtatgatagaggggtagttggtgttgaaagagacagtggtcttgactgattgcaattaaagtatgttaattttgccagacaactgagggacactgaccttgagctctaggggcttctcagtgagcctgcatttgtttaggatgcattgaggcaacgcttgcccacaccaatctcccttagcctacatctggccctaaagagagtccacatgtctaaggtttgcttaacattcctctcaggctttccaactccctcttgctttcgttttctttatccctgtcacttctttatccaaccaaagactgagtgatcaggaggaaaataagactgactggcagagaagatgtgcatgcatctgtcattcggatcatctccaatgctctgatctatgttctttgttattaaggctctccaaaaattattttgaagaatggactgagtttacatctctgatatttcatctgtattctgccttttcatttttgtagaaggcacataacagatgtacaattaatataaaaaagaatgagtgccagtgacttcagtgaatattgatgaaaacatttcttctttggtgtgtaggggtgagatttttcagtgaagtgctgccagcatttgctctgcacagtctctagaacttctagaatgagacattatgcagccatatcaacagatcagttgaacatggagaaggtgataggaagcttttgttaaactgtgacagatgaactattatcttattcttccccgtttcctaccataaaagtaggcaagtggggagagatactgatgtgttgatgcaatagcacccactgacgcacaaaaattgtttctttctgaatatttcgagaaagaactcctgtgttttcaggcttgtagttcagccacatgtatccataattgactgcagtatggaataaaacttacaagatagctatgaaagttgactgttttgtcatctagagacttgataactgttttgttgcaccaggcatgaatgttttaggcagttttttgtttcgtatgtcatgatgccatattctaaatgagcatcaccacttcccttggcatatttttgaaacactctgcaaagcattacatggttaattgtcagaaaactgtcactgaggaaagtggaaagtgagatcctcttccccagtccctggcaaagagcattttttttttcttttttttggtattggtaagcgtttaatatccagttctcaaaacaaccccccccagtaacccccataccacaaaataacaataacctgatgtatagcatttgcaaattgtcattatatatatatatacaatttaacttctgggatacatgtgcagattacagtatttgcaaattgtcattttatatatattatatatttaatgtaagttctgggatacatgtgcagaacatgcgggtttgttatataggtatacacgtgccatggtggtttgctgcacccatcaacccatcatctgcattaggtatttctcctcatgctatccctcccctagtcccccaccccccaacagccccccgtgtgtagtgttcccctccctgtgtccatgtgttctcattgttcaactcccgcttatgagcaagaacatgcattgtttggttttctcttcttgtgttagtttagatttttggaatttcctgagtgatagaggtgaaaggagaatattttcttattcataagtctcactgaaatggggcttattataaatggttaattatccaaaaatcaaagtgaaaaaagtagaaagagttatttgtagaataaaacagaactcaaggtatatccagggcctccatgttcatcaattaatccctaaactacacagcatttatatccgtaaatatgttatagtaaatctggaaatataaaatattttaaattgataatgttagggaagccaagagtcacagagttaagagggctgctctgaactgtttttgtttttgtttctgtcttatagcttgtttaaactagaaaggaccaaatgccgaacctactcatgtacagatgagaaaattgatatccaaggaaattaagtaacttaccctaaacctacaacctgctagagatagtcagggctaaattctatgtctgctaattaactcagaactctttcactgaaatatcctgcatatctctatcaggatatctctatcctgatggagaactctttctctatcaatcctgcattattgaataattttatgtgatgtgacactcagtttgcaaattagactgagcagtactttggatcctcaggaactcctgtttttaaagagatgccatgttctcttttgttcattatcattgaagatagaaatgtcaactcttaaaaacataagattttgtggttgaaatttttccttatattttatagaaagtctctgcatattttgtgctccatgtattgatttcctgttgctcctgtaacaaattattacaaacatggcttaaaacaacacaaatttgctattttatacttctctgggtcacatgttcaaaatggatcttactggctaaaattaaggtgtcagcaggtctgttttcttcctggaggttttaggagagagcccattcccttgtctttttcagctcctacaagtcacctacatttctgaactcaaagccttttcctccattttcaaagccaacagcatcgtatcatccaatctccctctgtctctgaccctcctgactgtctcttaaaaggacccttgtcctttaagattaggcccaactggatcatcccagataatctccccatctgaaaattctcaccctaatcatatttgcaaagtctcttttgtcatctatggtatcatatggacagattttagggattggaaggtagacatattggagtgggataaagcattattctgcccaccacactgccctcttaacttaaaagaattattttaacttgtttctcactagacgttgctttagttttacagtttcttcaggtttatcagaaatagaatgagaagtagcgatcatctcagacatttgcctaaaataaatataatttctgacacttacaaaatgtatttatctctctcatattccagtttaataatggagaccttacttgttatgtatttgtgttttttttaataataaaataaggagaaaaaagaaacggaattgtgagattatatttagattggggaaataaataattccttaggttctttaaagggtgagagaacaaagccccttcaatagaaacgattttgtatgacattgtattaatttcctagggctgccataacaagtcaccacaagcttcctggctcaaaataacagaaatttctctcaaagttctggaggctagaaattcgaaatcaaggtgttggcagggccacactctctctgaagtctctaagaaagcatccatcctgtcctgcctcttccatcttctggtggctccaggcattccttggcttgtgggagcatcactcccatctctgcctccatctttacatcatggtcgtctctacgtctccatgtgtccttttcggtctctcacaaatatactttcattaaagttagaatcatcctaatcttcatccagatccttagttatgtcttcaaaaacctatttccaaacaaggtcacattctgaggttcaagatggacatgaatttcgaggggggcactatttaactcgctacaggtataattatgtatgaaggaattattctttataattaactttctagtttgtgttacacttctctttgcttaaaaaataaataacagcaaatcattagctgctttcttcttcggtgctgtggacgtttttttctgttattattaatattgatccagttcttgggaattttctcaatgctaaatgataatgagaggaagaaagataacaatgattctcattgaatgttttttgctatattcttggcatagtgctggatactttacaaacatccaatccccataacaatcctggcaagtagttatattattatagtacacataaaaaactgaagttcaaaaaggctcagtaacttgaccagcattatatacctaggaagtggcaggggtcagaatcagatataacaaaatttctctctcttccaattttccagtattctcatcttagggtccattctgtccaaggccgttcctcagacacatccattctccttcagttctcacttttgaattcacctccaagcttatacactagcaattgacaactaatacatagccttcaagctttttgcaaacaaactacaacaatagcacaacaacaactagaacttcaaaagtttgaagagtagtgaaaaaagagaaaacaaaccaatgaacaagacatcactaaacagtcctattggatttgggaaccacaggaagcagatggaaaatgctgaaacatttctctagagtcattgaaaaatgacctctattaaattggaaagaattttagggttccggtcttagatcacaaatgaaataaaaacagtttcataaagacacaactgtttctgagtaaaatatatctagaagttccttgacttactaaatgaatttaccttgggaaaaaacatatttcttgaaaaatattttaaatagaagggctatccctctaaaggctctcttataacataactttgaaagtaaacataagccaacaaacaaactagaaagcaatattgtcactatattggttaataaataaaactgggaaaaaataatatgaacattttgaatactggtccttaaataggataagtatttgaggatgttgacagaatcagtaaatacattaacaattctttttgataaacatttaagtagagcttttgaaaaaaattttcttcctttctttattatactatccctcaatggttgaaaatgttgttttttgacatgagggatacttcctttctcttattgattgaactattgtgttctagtcttaaatttattctctttttgtaagaggatacaataaaagtatgagtcaaagaatatattggggatttcaaaaaattcattagaaatggaatttaacataagctcttaatataagctccatcaagttcaagacatttttgtaaatgatgataccatccatttgctccattcctaaagaactgagggtcctgggaatttaactatgtttatgctgtcttttctgcataattaactgaagaaaatgggtatcctttacagatttttttaagattaggaaacaaaaatcagtcaaaaggagctaaatcaggactataaagtggatgcctaatgatttcccatcaaatgtctcataaaattgcccttgattgatgagaggaatgagtaggagcattgtcgtggtggagaaggactctctggtgaagctttcctggatgtttttctgctagaactttggctaactttctcaaaacactttcataataagcagaggttatcattctttggccctccagaaagtcaacaagcaaaataccttgagcatcccaaaaaactgttaccttggcctttgctattaccagtccacttttgctttgcctagaccaagttcacctcttagtagcaatttctttgattgagtttattttcaggatcatactggcaaacctgtgtttcacctcctgttacgattcttcaaagaaatccctcaggatcttgatctcatttgtttaatattttcattgaaagctccgtttttgtctgtgagtgatctgggcacaatgattttggcacccagcaagtggaaagtttgctcaactttaattttgcagttagaattgtgtacgctgagtcaattaagatgtctatggtgttgactgttgtttcactggtctttttcaattagggcatcaacaagattaactttttttcccacaaagtgatgtggatggtctgctgctgagggcttcatcccacaacatggtctcaacccttcttaaaatgaggtccatttgtaaactgctttcttgtggggcattgtcctcataaaatttgtgcaaagcattaatcatttcattattcttccaccccagcttctccataaatttgatgtttgctcttgcctcaattttaggggagttcatgttgctaataggggcacctttcaaactggtatcttatccttcttcatgcttcaaactagatcctgcccagacatgttataacaagttaatacaagttattttggtacaaaaaaaatgaaatctatgcatagttttttcataacacacattttctatgaactttttgaagactctcttgtacatggcatatccacctttagttactgaataaataaataaaagatgctcttgcttaaattgttcatgtgtgctagaactttatcccgagcccttcattctcatgttttgcactttcctgtggtgattttacataaacccatgagtttgttaatatctgttaaattgatgacagccaaacctatggctccagcagagattctactcctgagtgtctgacctctatatccaagcacattttatgcttgactacttaaactacttgagtgatcctagagatcttaatttccacatattccaaactaatcatatcatcctttgcccaaaacctggcatttctgcagatgtaccaccacccgtatcattcaaccagttcagacatctggggtcaccagatgtttccctcatactcaggacttatctggccaccaaatctggagatacctgtctcctaaacttttctcatatccttcaccttatctccaattcttctgctcacctacattacagtaagacctaatctgtctctatccctagattcttgactccattcaaatgagtacccctctgccattaagtagttttataaatccttaaatagcttgccctagctttcagcctaagatcaataataatggtgattgccatttttgtgcctattatatgtgaaacactattctagacacttgacatacatatatttgcattagctctcatctgatatcagtctggtaagatagatattaccctaattttataaatgaagaaactgaatgtcagaaagcttagatgatttactcaagactactgagccagttcatgatggagctagggttcaatcctaggatgatggtctggatgcaaaaccttctgttccactggacctgttgctgaattgaaacttgtaagatcaggacacaaaggctgttgatgatctggaatgctcagatgctgatcttccctagcatgggcagttgcttcagtaataccaaagtattaccttctctttcttctctcttttttaacctcatacatatgtacccttttaaaaaattcatggaagaatacattcaggttgttaaaaaattcaaataaagtgaaagtaattagaataaattatacatcctccacacagccccaatctcctcccaagagagctaatcactttcagacactgatgttgactgaattcatttaatctaaagacttagatctcttctcctctatgaagtttctttctgtctatcatttctctttattccctctgttctctgcctctgaaacttctacccagcattctttgtgccacagactgctcgagacactgagcacagcctatataactatatttaaaattgtataaaattagatgcacaggattacaaaggaaaccaattttattaaaatgcagttatctaaatattaaaaagtataatataggaatacaattatgaatgcatcaataacaaaatctagcaacgtatttgatagatatgttaattctgcactactgatgagcacagattgtattttgagatacttgcagcaataatactatcatgaaaatacctgtaatttttgctgatagcaaagtgacatgtactgctaatactactgtgatttttgcctacatccatatttgggggagttattaaattttagttagagtatattttaaaacatgtaatttcttttttctatccaaaggctccttgaaatctatccatggcctcattttagtattactgagcttttaggatttccactatcttcaatatttcttgtactttctctaatattttctagtcttttacactgtgttctaaggttaactttctatttagatattttactccaatggtaaagaaaatttattatattacattataatcattgttttctacctagccctgttataattttatgagtaaattacatataaatgcattcaatcactcaaagaaaagcttccaaaggaaagagaaattgaagtaaggttgatgtggatttcttgaaaggaataattaagaaacattttgcatattattaaaagcggttatcagataatcattctttctgcaaaattagataaacccagggatgatccaagaatccagagataataatcctatattaacctttgctgttactttatggttagtctagaaacaatgcagtggtctttcaatttggaaatgaaaatgttaacatgtaaggtagtatgaaaataccttcatgaaaagtatgaacaaataaaaaatatggtcaagaacttgtaaagttgtacttacatgttatatggtaaattttaagaggtgatttttccaaatagaaactaccacctaaagaatataaaaagaagaaagggggagggaaggagggagagacagacattatttttaaatgaataagctaaagaacatttataaaacaatcaaaattttttttgcagttggaataataggttttttatacacattcattatgttgtaaatgttttcctctccattaatttacattaatgtcatacaggactacaaaaaattagggttcagagttatagataacctataagccaatgcaaacagtcgatcaccagtgtttctgtaagaatgaggatggtttattatttacatccttttactttgcagtaactattcaagggagaaggcaaacagaaaatgcatcaaatctcagtattattgtctatgtttttctgttgccatcagctaatgctctcattctgattcatacccacccagcttctccactgaagtcaatgagaaacttcctttaaaggctgcagagtcacactcacaattgcctacagcagatgggtaaactaagtctgagccctgccccttctcccagtactggtcccctgaaggccaaggcctgagaaatgtttaaaaatacttgcattccctgacaacaagataaatttgtaatgtggattttttttatttctctgaacaaatcagaacatttgacaacactggacctgctttccagctatacaacaagcagcaggttcctgattttgccattttgccccatcaagttcaatggggcatgaactctccagcaggttcatcatatacattatacccagaatgaagtcctagcttttcagcgtagaattcaacaacgttcatgattctgcactcccctgcttttttttttattatttatttattttattattattatactttaagttttagggtacatgggcacattgtgcaggttagttacatacgtatacgtgtgccatgctggtgtgctgcacgcactaactcgtcatctagcattaggtatatctcccaatgctatccctcccccctccccccaccccacaacagtccccagtgtgtgatgttccctttcctgtgtccatgtgatctcactgttcaattcccacctatgagtgagaatatgtggtgtttggtttttttgttcttgcgatagtttactgagaatgatggtttccaatttcatccatgtccctacaaaggacatgaactcatcattttttatggctgcatagtattccatggtgtatatgtgccacattttcttaatctagtctatcattgttggacatttgggttggttccaagtctttgctattgtgaataatgccgcaataaacatacatctgcatgtatctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgtcgtttcctgactttttaatgattgccattctaactggtgtgagatggtatctccttgtggttttgatttgcatttctctgatggccagtgatggtgagcattttttcatgtgttttttggctgcataaatgtcttcttttgagaagtgtctgttcatgtcctttgcccacttgttgatggggttgtttgttttgttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcagttttgtcttttgttgtcattgcttttggtgttttagacatgaagtccttgcccatgcctatgtcctgaatggtaatgcctaggttttcttctagggtttttatggttttaggtctaacgttttaagtctttaatccatcttgaactgatttttgtataaggcgtaaggaagggatccagtttcagctttctacatatggctagccagttttcccagcaccatttattaaatagggaatcctttccccatttcttgtttttgtcaggtttgtcaaagatcagatagttgtagataggtggcgttatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctctgaagaaaggcattggtagcttgatggggatagcattgaatctgtaaattaccttgggcagtatggccattttcacgatattgattcttcctacccatgagcatggaatgttcttccatttgtatgtatcctcttttatttccgtgagcagcggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacgatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaagttgttgaattttgtcaaaggccttttctgcatctattgatataatcatgtggtttttgtctttggctctgtttatatgctggattacatttattgatttgcgtatattgaaccagccttgcatcccagggatgaagcccacttgaccatggtggataagctttttgatgtgctgctggattcggtttgccagtattttattgaggatttttgcatcaatgttcatcagggatatgggtctaaaattctcttttttggttctgtctctgccgggctttggtatcagaatgatgctggcctcataaaatgagttagggaggattccctctttttctatttattggaatagtttcagaaggaatggtaccagttcctccttgtacctctggtagaattcggctgtgaatccatctggtcctggactctttttggttggtaaggtattgattattgccacaatttcagatcctgttattggtgtattcagagattcaacttcttcctggcttagtcttgggagagtgtatgtgtcgaggaatttatccatttcttctagattttttagtttatttgcgtagaggtgtttatagtattctctgatggtagtttgtatttctgtgggatcggtggtgatatcccctttatcattttttattgcgtctatttgattcttttctctttttttctttattagtcttgctagtgctctatcaattttgttgatcctttcaaaaaaccagctcctggattcattaattttttgaagggtattttgtgtctctatttccttcagttctgctctgattttagttatttcttgccttctgctaccttttgaatttgtttcctcttgcttttctagttcttttaattgtgatgttagggtgtcaattttagatctttccggctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggaggaggttgttcagtttccatgtagatgagcgattttgagtgagattcttaatcctgagttctaatttgattgcactgtggtctgagaggtagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtctgcttggtgcagagctgagttcaattcctcggtatccttgttgactttctgtctcgttgatctgtctaatgttgacagtggggtgttaaagtctcccactattaatgtgtgggagtctaagtctctttgtaggtcactcaggacttgctttatgaatctgggtgctcatgtattgggtgcatacatatttaggacagttagctcttcttgttgaattgatgcctttaccattatgtaatggccttctttgtctcttttgatctttgttggcttaaagtctgtttcatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatagtgttatgtgtgaatttgatcctgtcattatgatgttagctggttattttgcttgttagttgcagtttcttcctagtctcgatgggctttacattttggcatgattttgcagcagctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctccaggataatatcctgcagagtgttttccaacttggttccattctccccatcactttcaggtacaccaatcagacgtagatttggtcttttcacatagtcccatatttcctggaggctttgctcgtttctttttattgttttttctctaaactttccttctcgcttcatttcatttatttcatcttccattgctgataccctttcttccagttgatcgcatcggctcctgaggcttctgcattcttcacgtagttctcgagccttggttttcaggtccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcgttctccgtccagctttgttccgttgctggtgaggagctgcattcctttggaggaggagaggcactctgctttttagagtttccagtttttctgttctgtcttttccccatctttgtggttttatctacttttggtctttggtatggtgatgtacagatgggtttttggtgtggatgtcctttctgtttgttagttttccttctaacacacaggaccctcagctgcaggtctgttggagtaccctgcagtgtgaggtgtcagtgtgcccctgctggagggtgcctcccagttaggctgctcgggggtcaggggtcagggacccacttgaggaggcagtccgcccattctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctcgctgccaccttgcagcttgatctcagactgctgtgctagcaatcaatgagactccgtggggtaggaccctctgagccaggtgcgggatataatctcgtggtgcgccgttttttaagcccgtcggaaaagcgcagtattcgggtgggagtgacccgattttccaggtgccgtccatcacccctttctttgattaggaaagggaactccctgaccccttgcgcttcccgagtgaggcaatgcctcgccctgcttcggctcatgcacggtgcacgcacccactgacctgcacccactgtctggcactccctagtgagatgaacccggtacctcagatggaaatgcagaaatcacccatcttctgcatcgctcaggctgggagctgtagaccagagctgttcctattcagccatcttggctcctccctccactcccctgctttttaagacatgctgcctgctctcctcaaacaatggtgacctccaggcctctatcttgtaggatccaacttggctttcatctttttaggaagcctcctgtaatatccctttcttcaatgtcgattgttcatgaaattccttagcatttagttgtggcctctcttatgacaccttatcgtgggtacattgagatttaattttattagtatttaacatttcataattgtgtgtgtatgccttcttttcatgcattacataatcttttcacaactagaccaagttctgatatctgttattaggagccaaacccagccctgtatttacttgctgtgggaacttgggcaaattattgatcccctctaatcttcactcagtcccaatatttgtaaaatgggaataatacctactcatgaagttattgtaaaacttaatgaaacactgcatgaaaagcattttgctcagtgtcagggatgcagtaagaactcagtaaaaatgtttgtgttataatttctctaccattgtcactctcttgagagctattaaatgacttatccctgatttcttcttacctataggccttttattgccctagaagtttgcacaactaactttccacaattcttcctggtaataatattaccgtgaaaatattcttccaatattttaagattccctcatcattatattactttaatttctgtgtaaagatcatatagaatacaaataaaatgagatcgttatttgctcttcaggtaccacattaataacaatttctacctaccatgtattgatcgcctattatgtggcaggcactgtgctagatatttatttttcttgccttgtcgctagtgttcaaaactccacaaggaaagtattttgacacgaattttatggctgagaaaactgaggtcccgagtagttaagtaaattatttgtttattctacatctgtgtggcagaactgggttcgaaatgagatctatatgtaaaggctatgcactttttgctaatttcctattgccttgtgtttattatctagttcactattgagccattcagatacaaattagccctagtaaacctttgtaatttctagaaatattgcaattgtatatgtttaatgtacaataaattcttcttaggctatcgctaataatatttctaataccccaatatggctttcttagaaaataaaggctacttgagggctgggtgcggtggctcacgcctgcagtcccagcactttgggaggccgaggagggcgatcacgaggtcagaagatcaaaaccatcctggctaacacggtgaaaccctgtctctactacaaatacaaaaaattagctgggcatggtggcaggcgcctgtagtcccagctactcgggaggctgaggcagaagaatgcggtgaactcgggaggcggagcatgcggtgagccgagatcgcgtcactgcactccagcctgggcgacagagtgagactcggtcttaaaaaaaaaagaaaaagaaaaaaagaaaagaaaggctacttgagaatgaccaagttattatattaagactttttccagatgcaagtaaaaattacgttacattgttttgtgttgtagcattaacaatgctcaatgttttgattaataagtgtctgatttgatatatcagttggatattacttgtgaaaacacgatctgtctcattgttggatattggtttttgatagatcagatttaatgtattacatggacatttatgaggttcttctacatacaatataattgatttaatacggatctggtttatggctggtgtatttaatttcaaaatatatctggcttaatacttaatgtatttgttttgatattcggcattttgatgcaatgttcaagtgtatgatttgataagaaatatattgctcatgggcatgaagaaaattgtaaaagaaaattatcagtagacagtgaacagatgtgtaattatgcagaaataatcacatttttagagcagaaatctaaagtgaaaatatgtttcaaaaagatgtgttagttttgtttaggtaaacattggattctcagcttcattcaattaaacaaacaataacaacaaacaataagcatataagacctcccaaagtcagctatttttttaacaaattgaaaattaatttactttgttgagtctttcctcatgtgatagtaactattttatatattttgataagctgttacttgaagtaaatatatttctacttgtagtttttatgtgtttctgttttgaaaatctacagctccgaaacatcatgatgaatgttttacagtcttctagttcacagggaaacagaatgcaagagacttaccagcttctcctaggatgcgttaggagtcagtatactttttagtttatgtatgagattgttttgcctgacttaccaatagaatgaattttaatgctctcctgctcatttgtgatttctctttcctaggagagaacttcctataattccctcagaaccatccctgtccctattgttcatcatccttatcagagcagtcactccagcgaatctccttatctcaaaacccagaagtcccaagacactcttcattgcctgtcctcttttgcctcccaaatttgttagcttgcaggttcagctgcttctttctacttcttttgaatccaaatatttctttctgcctcaacgaaaatccttgcctacatacctaccttacaaccaaatgttagtcacttagttcctgttatgttctattcccaagctgtgtttcacacttgaacttccatctactgaatttcattttttgctactctatatttgatacctctggatcaaatataaactgttgcattgaaagctttctgttagatagccctgacttaaaggattgcagccttattccttaataatatcaataggaaagactaaaaatatagacagtttgctgtgaacgaacaatggactatcatatactctatacattctctggtacaacatacatgacaactatccaagttagggatgtggaaacttaagctcgttgaagttaacacagtctaataagaggaatgtcagatttcacatttcacacccgggcggtctgactctagactctgtgttcttagatccaaatgatatcacttattgttatagcttccattccacataggcaatcttacaacttcataaaattattccatttcttccagctgctatccctccccccatagtccactgtctctttcttttcattctttatctctctttccctcgttcactcattccttctcatgcttcctttctcactcactctcttttaaagtttttttactgtgctaagcaccaatgaattttgcttcaaatcactgactctaagaggtttctaataggtttcttgctgacaaagagaataaatgttaacttttccctcttaggttgttgctctcgtttcttttcaaccaaatttattctgattaatcttacttatttttctaagatttaacccagttttaagaagatttccatatgagcaagttataatactatctatatttgcattttagtatgttttgtatttacagattttgtatctaccaaaatgcatcttcttgaaggagaatgcacctctagatgcaaactaaaactatcttttgcctctttctttatcctctttcatagctttctgtttctgtttctatgttttattcagacaaaataatgcaaatttgtgcatatctgtgtgcagagaagagattgaagcaagaattgtataaaatgtgccttcatattgagtatatactgtaattattttttatttataatttcttcaaggcatagaacaaaacccactctaatctgtcactaaataatgctgttaatgctaattttttctttttaagtttttcagtaattacatatataatctagactaagaaaatcatattctgaattaaacattgccacaaaattttacttccaactcgattctaggatatttaaaaccaggaaatgatactgtctcctttcacttctggtctgacaccgaatagagtgctggtgcacagtccatacccaacaaatgttgttggatggacttgaatgtgaatcacctgcagcactctgtttaatgattcagcatctattccactagagaatgcaaaagaagcagatctggagaagagaaaaattttatagcactgtcattagtggtcacttctaagcacaaggaaacttaaaagtgtttcacctacaatttagagtaagaccagcctcttcaggtgtacttcaggtaaatagattacaagtaaattgtaggcatttctttaagtgaaaaaagcttttagatgattacagaaagtctcacaaaaataattttatcatcattgaaactttctgtaattttctcctaagtaaatttcacttccaaatgtgtcatttcagtttgagataaaataatcctaaaactatggcttccatttgcttccatcaatctactggaaaacaatgtgattatatacacacagaaaaatgttatgttctgattccagtattggcttagtatcttataccaaactaaccctttcacaaaagcagccagaacctgaaagagatatgacccttgagagaagaaactgcacaaggaaagagtcgcagttacatggcttttcccctgagcacacttccaagtccacacacagatcaagacagctagcattcaagaataaagttgcagttttactggcttggagtgtcacaggatggagttagggttgctagacatctgaaaattaagagggaataccagaaagatgagaatcagaacaggaagagtcctaaaattggcattcatactgcccttaaattcttggataaccctgaactgtgtatgcacaggggagaaaccatgctggaaaaagcaacggctagaaggcccaagatttaagcgtaacttagctgccatataccacagcgtagacaaagtttggagttcaagccctgccaaattaaaagggctgagtaaactcatcaggtattccattaaaattccagaatgaatctgtaggattaaaactatgtctcagtacaaatacaagttccttaaacaaaaacacaaacttgatacattggattttacaaaaacaaaaaaaattctacttatcaaatattctattaagaaaattaaaaaggtaagccatacaatgggagaaaatatttaccacacatacatatctctgacaaagaccttgtatctcatatataaagaactaaaatcaataatgaaaagacaaatagtataataaaaaataaacaaaagattggaacagtggtttcataaaagaaaatatacaaattaccaataaactcaaaaatacttaattaacatcattagccaccaagaaaatataaattgaaaccacaatgatatacatttcacatccaccataatagctagaattagaaagactaatagcaccaaatattggcaaaaatgtggagtgactagaacttacatatattgatgatgtaaaatgcgtaaaaactactttggaaatctgtttagcagtttcctaccaaactaaaggcatatatagcctatgacttagcagttccaatctcaggtatttacctaaaagagaggaaaacttccatccataaaagactcatattggaagcaacccaaacgtccaacaatggggaaatggaaaagcatagtggtctactcagacctcaatactgcaagaaataataatgagctactgatacacaaaccagttggctgtatctgaaaagcattgtgctgttcaaaactagccagagtcagaagagtacatgccatttgatatcatttctatgaagctcaagagccagcaaaacaaatctgtcatggtgagagaaatcagagcaatagtgcccagagggtgaggaagagggcaaggaaaatttctggagtgatggaaatgttctgtatcttaactgaggcagtagattcacaggtatattttttaatgaaaattcattgaatttgagactcaaaatctgtgcttttcatgataagtaaatttgcatgctacaaatggttgtactgtgtgatttgaattggatttggattaaatatagcatgattatggtttggattggatggacagttggactggattaaatacagcataaccagatgataagaactgaaaatagagtatatgcctactcaaggaagttcctgactcacccctctcctatacatcatatcctacccaacataaatacatgggtgtcctggaacatgtcccattttcatgccttattcttcacttctattctttaggattatttccttttcctggggtttactcttttaataaattgggaactgctgcattcaatgaggggcattttaactaaggaatcctgataacaccaacagctgagttattcttgctagctagtaatttccaaaagttcagccatgaaaaagattagtaattgaatctatgcaagattaagccaaccaagacacaggtttcactgaagcttctaaaatattacttgtaaaatgtttactgggattagtcctgtttaatctctgaccaaaatttctattcttcctttgttcctctgtctttaaactttgataatgataatttttttcatcaagccactttatagaattttttccacattgatgagaaaaaatactgattctctggcttctttgaaagacattctatccttatttggagtaaccatgttattatgaataacactattatattacacctttattttctcattgctgggccaagaagttagtgagatactgaattgtgacaactgatcaccatatagtttctttttaatgaccttgtgtaatgtgtaatagactgtgaactatcatcaccttaaaatgtcatcatgttttcataacatgacaaagttataatgtaaaaatgctgaatttagtaattgaaaactgccatgctcagcgagtgatattgccaacaccaagtcctaatttaagagttagtttactcattttccacttcattttataagaaaatcttcccattttgcttttcagagaggattgtgttattatacgggcaattctttttcactattaagcaataatcaaatgctgagtttttccttaactcttatgtagttgctcttgcccaaggcaatcaatttagttaagtgttacctgtatagtcagtctaaaaaaagttgtctgccctaaagctgcttttgatgcatgagtgtaccttgttttatggggcttattgcactccacagagattgtgtgttcagtaaattaaaggtttgcagcagccctgcatcaagcaagtctattgatgccatttttcccaacagtgtctgtcacattttggtaatgatcacaaagtttctaactttttcattgttattatatctgctgaagtgatctgttaccagtgatatttgatactactattgcaattgttatgaggcactgtgaactgtacccacatgatggctaacttaatcagtaaatgtgtttgttctggctgcttcaccgactgacagtttactcatttctcttcctctgctcaggcctccctaatccctgagacatagcaattttgaaattaggccaattaataacctacaatggtctctaagtgttcaagtgaaaggaagagtcacatgtgaggaagacaggttgaaagccaagacaggctaaaagctaggcctcttctgtcagatgattagccaagttaaatgcaaaggaaaaattcttgaaggaaattaaatgtgctactccaatgaatgcatgaatgataagacagggaaacaggtggggtgcagtggctcacgcctgtaatcccagcactttgggaggccgaggcgggcaaatcacctgaggtcaggagttcgagaccagcctggccaacatggtgaaaccctgtctctactaaaaatataaaaattagccagacgtggtggcaggcgcctgtaatctcagctactcgggaggctgaggcaggataatcgcttgaactcaggaggcagaggttgcagttagccaagattgtgccattgcactccagcctaggggacaaaagcaagacttcatctcaaaaaaaaagaaaagaaaagaaaagaaaagaacgtgaaacagcctcattgctgatatggagaaagttgtagtggtgttgttagaagatcaaaccagctgcaacaacattcccttaagcaaaagcctaagccagagcaaggccctaacttttttcaattctattcacctctatgagaaacatgagaaagctgcagaagaaaatttagaagataagagcttggttcttgcggtttaaggaaagaagccgtctccataaaatgaaagtgcaaaatgaagcaacagatgctgatgcagacactgcggcaggtgatccagaagatctagtgaagatccattgatggaggtggctacactaaacaacagattttcaacgtagataaaacaggcttatattgaaagaaagttccatctaggactttcagagctagagagaagtcaatgcctggcttcagagcttcaaaggactgtctgactcttgttagggcctaatgcagctggtgatttgaagttgaagccagtgctcacttaccattctgaagatactatggaccttaaaaattatgctaaatctactctgcctgtgttctataaatgcaacaacaaagtctgaatggcaccacatctggttacagcatggttcactgaatattttaagcccactgttgagatctactgctcagaaaaaaaaaactttcaaaatatgactgcccattgacaatgcacctggtcactccagagctccgatggggatgtacaaggagatcaatgttttcatgcctgctaacacaagatccattctgcagcccatagatcaagaagtacttttgacttttaaatcttattatttgagaaatatattttataaggccatagctgccatgtaagtgatttttatgatgaatttggacaaagtaaattgaaaaccttctggaaagcattcacctttctagatgccagtaagaacattcactgttcatgggaggaagtcaaaatgtcaacattagtaggaatttggaggaagtccattccaacccccatagatgactttcacaggcttaacactttagtagaggaagtaactacaaatgtgatagaaacggtaagagaactgtaattagacataactgtaattagacatggagcctgacaacgtagctgaattgctgcaatcttgtgatgaaatttgaatgaataaggagtcacttcttatggaagagcaaaggaaatggtttcttgagatggaatctactcttggtgaagatgttataaacattgttaacataacaacaaaggatttagaatataacataaacttagttggtaaagcagcagcagggcttgagaggactgactccaattttgaaagttctactctgggtaaaatactgtctaaaagcatcacatgccacagagaaatcttttgtgaaagaaaaatttgatgaatgtggcaaatttaattgtcttatttttaaaaactgccacagacactccaagcttcagcagttaccaccctgatcagtcagtagccatcaacatggaagcaagaccctccaccagcaaaaagattacaacttgctaaaggctgagatgattgttagcagtttttagcaataaaatatttttaattcgggtatgtacattggcttttataaacatgatgccattgcacacttaatagacttcaatatagtgtaggcataacctttatatgtactgggaaaccaaaaagtcatgtgattcactttattgcaatatttgttttaatgctgtggtctggaactgaacctgcagtatctctgaggtatgcctataattgggaatagtaatgtatagatatgaaggagctaattgaaatgcaagcccatctatgattatatgccaaaaatgactgttcttgagtagttctggggggcaaaaatcatacttttccataggaacaaatatcttcaaatttgcaatgtccaatgtgataacccactagccccatgtgactaatttaaatttaaatgtgttaaaattaaataaaatttaaaaattcaattcctcaatcatattagccacatttcaagtgctcagtagccatatgtggcttgtgggtatatattggacagcatagacatagaacactgccaacatttcaaaacattctatgaaactgtgctgagtcatacctacactttttgaatcttttggtatctatgctacttaaaccacaatggtttaccttaataatggtaacttaaatacctttattctgatggaacactatgtatagtctatatatagtagaaatatcattgatctgtcacaacattccgttattacttggtccttattaccaatgtttgagaattggaatatagtaatagttgaatgaatagggagttcaaggtatggtggtcttgtgaccacgagaaagaaagaaagtgaataattcttcaacaaaaagtatttatcacttgcctactcctgataatattgggccttgtgctagacataggagaggtgatgatactagcatgaaaagcatgcagttccagcctaccagaagtttacagttacatggcatagaacaaagtcaaaagaggtaagtataatgcaatgtgctaaaatgctgctttaggagtaaatacaaggtgcgataggatcatataaggggacactaaccaaagcctggggtcctggagaatttttaggaataagtgacatctaagctgatcccagttatgaaaagattagtagaagttagagaggatggtagaaagtagaactgaggctggccatggtggctcacgcctgtaaccccagctctttgggaggcagaggtagctagatcactttgggtcaggagtttgagaccagcctggccaacatggtgataccccatctctactaaaaatacaaaaattagctgggcgtggtggcatgtgcctatagtcccagctacttgggaggctgaggctggagaatcacttttacccggaaaacagagactgcagtgagctgagatcacgcctctgcactccaacctgggcgacaaagagagagtctgactcaaaaaaaaatacaaataaaaaaatgtagaactgagaggggaaggtgaacaggaaaacactccaagcaaaagaaaatgaatatctaagaaccaagggcaagaaataatacagccatttagggaattttaagtatgagaaatgagaacaaatgctgttcatgaaggtgagcccaactagagataaaattgatttctgttataaaagtagaaatgtctcacttattttaggatttaggttgttttacaatataatttcaaaagcaaactttctccctagtattttttcagaatccatatgcacatacctattaacagtggttgggaaagggaaatatagatggacagatggcaagatctagcaattttatcataaattttatgtgtattgggtttcttccaatcttcttccattataattttatgtaaacatattattcagtttaaagttaaggtgtgtcaatggccctcctggcctgactaggaataaatcagttattagagcaaagcaactatgagcatgtaattatgaataccctaggacttatacactcataaatcataggactcaaaagctaactattattttactgtatatgttaatgatggtatttaaaaattctaaacataaaacaaaaatatttgggcttttattcagtattctttactgtatacctaaaaattatgaatttgactatgtataaattaggccttaataaacttgactttcaaaaaatcttattaaaaaacaaaaaccttcaattaggtatttacacacatgtaattttcataaatgcataaatgtaactacacttgtcttttagagcattatttttactgttctgcttggcttttccccattcttctcttttttcacacctccagccatatttttctaccttcaaatgataacaaatggaatacatagtattattccatatttttctctaagcatttttaataacgtactaacatgtttacacatatactcatgtatttatataagtcctggtcattgttggtttaaaaaataggattacattataaatactttctgtgtcttgctttttaatattctgcaaacacatcgtagaaatccttccatagcaccttgtatagctctagtagattcattttaatggttccataatgtttcctggcaggaacacatcatcattctatgactgatgaacattaccactatttccaatttgatgtcacaataaacaatgatgcactgagtattcttgtattttaatccgaaatttttatttctcttggatagattcctgggaatggaattgctggaccaaaagacatctatgtattttttaatttgaatagatgttgcttttgaaaaaggctataacattttcctgtttccactagcaatatgtgagagtacacttctccatacatctccaccagcaatagatattaagtattgccagacatttaatagatataaagcagtatgcccctcattttattttgtactcaccactaatgagtttgggtatttttcatatgctgttggacatatatatttgtactattttgcattgcctcttcagatgccatctatttttattttgcacacgctattcttttctagttaaatcattagagaagcatctgtataattttaaacattaactgtttgtcccccatgttccaattttttccaaatttgtcagtcttttcttggctttgtgaatggtgttttttctcatacaaagctacttttaaatgcttcatataaaccaaatgtctaactttacatatatatatatatacgtatataagtatatatatgcatatatatacacatatatgtatatatacacacacacatatatgtgtatatatatacgtctatgtgtatacatatatacacatatgtattctggatttaataagttggttaaaaattccttccttatatgtattacatatgctcccctggtttttcttatagggattttattattttattttaaactatttagtccaactgaaaattatttttttttctttttttttttttaattttttttttttattatactttaagttttagggtacatgtgcacattgtgcaggttagttacataggtatacatgtgccatgctggtgcgctgcacccactaacgtgtcatctagcattaggtatatctcccaatgctatccctcctccctcccccaaccccaccacagtccccagagtgtgatattccccttcctgtgtccatgtgatctcattgttaaattcccacctatgagtgagaatacgcagtgtttggttttttgttcttgcaatagtttactgagaatgatggtttccaatttcatccatgtccctacaaaggacatgaactcatcattttttatggctgcatagtattccatggtgtatatgtgccccattttcttaatctagtctatcattgttggacatttgggttggttccaagtctttgctattgtgaacagtgccgcaataaacatacgggtgcatgtgtctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtcaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcaaaaattttctcccatgttgtaggttgcctgttcactctgatggtagtttcttttgttgtgcagaagctctttagtttaattagatcccatttgtcaattttggcttttgttgccattgcttttggtgttttgggcatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagccaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacttccggtagaatttggctgtgaatccatctggtcctggactcttttaggttggtaaactattgattattgccacaatttcagagcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccccctggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttgtctcttctgatctttgttggtttaaagtctgttttatcagagactaggattgcaacccctgcctttttttgttttccattggtttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatagtgttatgtgtgaatttgatcctgtcattatgatgttagctggttattttgcttgttagttgatgcagtttcttcctagtctcgatgggctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctccaggataatatcctgcagagtgttttccaacttggttccattctccacatcactttcaggtacaccaatcagacgtagatttggtcttttcacatactcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcaggtccatcagctcctttaaacacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggagctgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcttgctgggagaaccactgctctcttcaaagctgtcagacagggacacttaagtctgcagaggttactgctgtctttttgtttgtgtgtgccctgccccaagacgtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactgggaaagggaactccctgaccccttgcgcttcccaggtgaggcaatgcctcgccctgcttcagctcgcgcacggtgcgtgcacccactggcctgcgcccactgtctggcactccctagtgggatgaacctggtacctcagatggaaatgcagaaatcacccgtcttctgcgtcgctcacgctgggagctgtagaccggagctgttcctattcggccatcttggctcctcccccctgaaaattattatttagagtacaaaatgatttgattttattttcttcctgtcaattatgccaacaacattcattaaaaagtgaccagctttttagatagacaacccagaacacaaatgcatcagatcaaaacccataaaatatagtgtgtaataataattatatatgttttattactttaacataaaaacatgaaatagtcatttatttaaaattatatattattctgtattatttatttttattacaaaatgctatataaacaacaggacgagttaacagggtcaataagtagtaactgatagtagtactaattaaataatagatgtgacaaaagtataacaatattttaataaggttttttttctgtcctctgatacagcagttatttttaactctttgctgacaccgtgctggatatttacatttgtagtgtgtatttaagacatataagtgtgaaactttttaaaaggggaacataaatactacaggactaatttaacagatattaactgtattaaataacaacagcaataacatgttcttttctgtccccaaatatagtaggacaattttactctttcttctccgataatacttcaatgaattgcctgtaatttttggggcttccttttcttttattcagttgtagaactgaatatagtcaaacataaaatgcactttggtgtgcaatgctgctcttatcaagcctgcattacgttgattctggtgtcattccaatgtgatgacaccaagctaaatatactcttaacaagcatttgactataaaatgagagttcaattattagcaataatgtttttcaactcatagaaattagttccagctctccaaaaagatgtccatactctttgattctacaagctttcttttaaaggccaggcttttgtcaatcgtctttgcatctataaattcatcatataagctaaatatatctaaggtgtccaccatttttaaacactctgaagcactttggatgttattataagtgaaatctctcttaggaaaatgattttaaagcacaagagtaatttgaattttgtgaaattggtgctagattctaaagttacagttttagtaaagaaatagagaaagtctttatagtagcatgatttataatcctttgggtatatacccagcaatgggatcactgggtcaaatggtatttctagctctagatcctggagaaatcaacacactgtcttccacaatggttgaactaatttatactccaataaatatgtacaattattatgtgctaataataaaaggccttcaccccaaaaaaaaaaaaaaaggaaattgaggaagttctgtgtaacttggctaccttgttgtggtgacttactgttttattttttatttttattgtttcgtagtaaaaaagttttgaagtagttgtatttttttaatgtgtcattgtttcactctgagtttttgttacaatctacacataccatcaaacaacacaggtgcagtcagttcatccttttttatactcctatggtttttttcaaaaatcatcaagcaagtttggaaatatagtatataaatttttattttactgtattcttttctgcattgtcactcaatgtatttccaaattagagaaggacatttcttcttgtctcacactttgaaaatggttttatgatagtccaacattttagccattcatagtcatcttgtagtcatatgtctaaaggagctagttatctccttccatctctattaagtaaaaatcctcaagtttttctgcacattttgaggtaactgaaaagtgatcaaaaattttaattatgaaagctttaatatcacaggtaagcaatgttgtacacaagctgtgcagttcattttgcaggtaagatcttttaattttcttagataagaagtttatagactaaggccgggcacagtggctctcgcctataatttcagcacattgggaagccaaggcacgcagatcacttgaagccaggagctcgagacccgcctgtccaacattgcaaaaccctgtctctaccaaaaataatacaaaaattagaccagtgtgatggtgcacacctgtagtcccagctactcaggaggttgaggcaggaaaatggtttgaaccctggaggtggaggctgcagtggtctcagacgagctactgcattacagcctgggcaacagaatgagactctgttgcccaggctgtaataaatataaatatttatttttataaatatttataaaataaatattttattatatttataaaataaatataaaaaaaagtttatagactaaacaaaacttgcttaaatttacacttgcaatgtctatagaatatgcaggtagagggcaagtatctggacaaaatatcagtaaacttttgctttatgttttctgcagttttattaaaatattcataaaaatcagtgaggcgatcgagaccatcctggctaacatagtgaaaccccatctctactaaacaaaatacaaaaaattagccaggcgtggtggtgggcgcctgtagtcccagctactcgggaggctgaggcgagaatggcgtgaacccgggaggtggagcttgcgtgagctaagatcatgccactacactccagcctgggcgacagaatgagattccatctcaaaaaaaaaaaaaattcataaaaatcaagaagatgatttgaagctccatttttaaaataaaagtacctaaaagctagatgaatcagtttttgttgccattatttgacacaaaactttactgcagaaaacattcaagtaagatctgaaagaatcagctctatagagtaagaggccaacacgtctgttagcaaaattttgtccttttgttttcccacggcacattttatttgaaacctagtaatgaggaaaagtagcttcattccattttatagagctatcaggggaatggtacaataatgtatgtttcttgatgtggtatgcccaaactaactcatagccactgtttttaactgtgcattggtgtcttttgggagacacagaatcttttgattgatttagaagtattccctgtcttattccaaactatgagattcagtctgcatatgtgtttttacatcgttttcctccatcatacccaattgcaaatttcttttctgcagattgtgcagtagtttgtcttggttatttgcctccctgatccagttatttctgtccttccatctgtaataagataacattgtcatttagccttatttttcagcgatattcgggtcatgctggcattggtattataatcattctcatttttattatctgaactctcagaaaaaaaccagtatcgaaagttaaattaacattatcttggtatcgagatgataccaagaaaaccgttaatccacagacaaaggactgttaatactcatgaatacaatgtgcttaagtaacacacttaagcctcagcactcacagcagtgcaacaaggggtgattcattattgtgaacagcaaatcacagttgccaacatcagcagtcaggaggaaaaacagtgacagcaactgtgggaaacataatctatgccatatccatctgctacaaaaacagtgttgctttcagctattttttgagccgtggtatgggtttgatactaccccccctaaccttctgtacccattgccaaaaacctggatttgttgcctccctgaaagtttactcatgacatggggcttttgtgctatgactgggcattggaggcaaacctgggcaattgtcaccctagctcttcctattaagcttacatttatgagcatttccgtcaattcatctattcaatactttggttgagaaactggggctggattatttgttgtagcctcaaagatttttttggtctcacttgaatccagttaagtgctcttcttacttttctgttagaattgtaatcttccacactgctgtttccctggagtgtattctacttgttctaatttatttttccctttccgactgtggaactcactacatggattattctttttcttcgtcagctcatgaggattcaggtctagttgttgaagtagcctagggactggcagtcttgctaattgtagaaggtaaaatatcctctcttcctgtgggccagaacaaacaaggtgactccattcccctcctgagacacacagaagcagctaagggctctccagtcttctggtctgacccaaggcacaggactccaggatagggaggtctctgtccatccattcaactctttctggccagtttaaaggcaacagaacatgtatattaatggtaacaaatatctaaggaaggaagtccggaggacttgggagccacagatctctgtgaaccaagctttcctcaaacttagtttcttccttgccttccctgcaggttgcacttgttttcgcagacacacccagcctgaaggagagaatcaccagttcttttcccacatgctctacctagagccccaacctttctaaccttctgtcttccagagcccagcagccatttgtttcaagaaaaagttggcagcggagggtaaagaagctacattcagttttctattttcctagaatgcttttaaaaactttaaaaaatatatttagtattcctgataatctccaaaagaacaggcaagaaataagatttagaggtgggcataacacttcttttctaggttaaaaaattgatttttttaaaaaagttgatgtttattttaaatacattcatatattctttttgaaagtttgtgccctatgataactatgtcagagcacaaattaaaattttgacaaaataacagataaattatcataggccaacaattaaggtagcagtaaacaaaaccatatatattttaaagtcagtcttaagtacttaaacttgagtttgatcatgatttattgtgctgtataaattcagaagaattgatgaatgctgctaaattattaatttgcccaaagtgtgagaggctaccgcccagaaccatgtgttataaatattaaagccatcccatctttaggacttatgtgggcaatgaattataaggaccactgtaaatcaattctgggttaatcataactctttgcgcctgtgattcacaatcacattatcccccactgaccattagttaaaattggaaagaagtttgcagcttagtgggcaaggctagaatttatttccctcacattattctcaggccttttcatttttatttgatgaggaaaaatagattttcattattcaagctttattttaattttcaaaagctctgctttgtttcattcctaagaatcagaaatgcttagagagcaatggctacaaaatcaacaggcctcgagggtccagagtcatataaaccaaatattcattttttccaatgatcttgagaagtaagcaacctttttcttaaaagcccaatttttttttaccttaataccgtgatcatatagaactgaggaagctgcatgctttctgtggcccttgccgtaaactacatagcattatatttctttacgtaactgttgtttctcaaactccataggctataccttacaggcaaaggctattctatgtcacatgcttttgcattcctatggagaatctcccagaaatttatatttaatgtagtgcaaagagcataggaagatagccttgatctcacattccaaatctaccgcaaatcattggtatgacttagagcaagttacaattacctcacctgtgaattagatatcctatcagctgtctcacagtgttgtaaagaacaaataaatgtgtatgtaaatggcatttttagcagttgaaacatgtttggtaaatgttatctattatcataagaaataaatggaggacagagggaggattttctttagcaaaggaaattcctatctaacccttttggtttaatgtcacttttccataattgttcccactgaatgttttttaataagaaaggatcatcacttctgtgtctctgaagccatagattttggagtgagcttttaagaaatttactaaattaaagattcatgtgagaaagagtattgtcctcccgattcaaatcaaaattggtgagataacaggtagcgataagtctgtttgtggcatggacttctgtagttagtacaggaggctgctacctaatgaattaaaaagcaaagtgctttcagcatcagctcatgatggagatgtcagaacaggagcatacaggacacaagtaatctatatacaaatagaaatgtgtcataatccctaacatgttgaggaacataggtgcaggttttgaaaatgcactttcccattcttcactttacttggcaagaaatgcaaatattcaagaaaataacattgaatatttacagttcttcacctgacaaatggaaaatttcaaaaaattttaggctagaggaatgtgcataaacgagaaatggtctccaaagcatatctatgttttcaattggttaggtactattgataaggaatttaaatatttggggttttcttatacagctatttcagttaccagaatatttgagacttgtcctgattccttccaacaaaaattaatttcccttttcttttacgactttaaacaaaatctgttcatatgatccttaccataatgtgattcgtgttacaacaattttgtacttgacttatctccactactgagttgtaagcagcttgatgatgggggcccaagtcttacctttatattccttatagacttaaccttcaggattttagagttaatgtgtaatgattgttagtaaaattgaatttaaacaacaactgttaaagaaaaatatagaaatgggaacaaaacctagctcctagtgttatctgggaagtgagaaatttatcacggggagtctattgatatctcaggcactattacgaggacacaggtgctgagcctcaatagttaccaatgtcaatcaataaccatagcatcctagcatctctactttggggtctggagattgaaaacactagaggtagatatcactttggattatttttcttcctcataatgagacctggaatatgctgacatgaagctcccagattcacttttgctttcttctgtttaacctagtatgaaggactctgctggtgtggaatccattagtaaataaatcaatggcatgtgattcagttgcctgtctaaacatggcctcaagaacagggctagttgaaaaattttaagaaaactccattacctagtcagatggattgaaaatttttaggccagtccttcaattattattctgttgaaaggtgacttcagactttgttgatgagtattttatagagttttcatttgatggttaaagaccattcaaaaggcagtgattatatgttttaattgatgaaaaaggccagggccatttttaaaagctaaaatagtttgggttactatgcaacctttcattgccattgctacaggctataatcacactgttttaatgattctctttttaaaaatccattcataattctttggaacattagtattgcaagagacagcatatataatggcaaggataatgttactatacatttaagtagagctctacagttcacaaagcattgacaacaatgctagaaaacttttctaacagcaaagcaatatgtcgcctactggggaggtcccttgaggtttgtaaagaagctgccaggggatccaggaggccagactaacagtttaaaacagaagataatcacaaaaatcaaagtaggttgttagaggaagcttcaaggtcactgctactcccaatcactgtaaatttagacctagggagctataagcaggtctgcaagttggttgcaaagatcagagaaaagaaggaaactatgggataactctgtgggtgagaaatcaatgcagacgaaacctaaccaagtgtttttccttctctcacactaacactccaagcatctcctagttttataattatatcaagccccacgtatataaaattgtttccgatgatattactcatttttttatcatcagcatcattagtaataaaaaagtggtgtgcataagctgtcaggattgttaaaatgcatactcccaggccttaaacatcaaacatcatcatgcagtaactttgggattagatctagaatctacatttctaacacaaaaatcccctagtaattctaatggtggtagtcttcgcatcacattgtgagaaacactgaccgatagcacctaaactagggtctagggtaccacagacactccatgagtaatacttgaattaaatgctttctttagggaaaaaacttttgtctgtttcaatacctcatggtttggttggggttcacctcaacaaaagacagtaagtatccactgagcacagttaactggactgaaggttttaggccattcattgtttcatacaaaactttttattgggtatccaatattggtgggatctaagcaaatttattaaaaggcaacaattaaatatttcttctatatttgcttcctttacctttatgttttgatattccattcttttttcagtaccaaaaaaagtctcgcatgttcttctagtttttcttttcttaaaacttggtctttaaaaaattatatttaatttattccactacggaaatttattttgtgtgatgtgacatagtgctctaatattgacatttttgcaataatcacctgtctcacgttttttgaatatttcatatttgccacactgatttgatttatcgactttctaatacagtcttttttttaaagagaggtaaaagttttatgatggcagatgattcttttttttattattattatactttaagttctgggatacatgtgcagaacctgtgcaggtttgttacacaggtatacacatgccatggtggtttgctgcaccaatcaacctgtcacctacattaggtatttctcctaatgctatctctcccctagccccctgaccccccaacaggccctggtgtgtgatgttcccctttctgtgtccatgtgttctcattgttcatgtggtgtttggttttctgttcctgtgttagtttgctgagaatgatggtttccagcttcatccatgtccctgcaaaggacacgaactgccagcaattccattactgggtatatacccaagggattataaaccattctactgtaaagacacatgcacctgtatgtttattgcagcactattcacaatagcaaagacttggaaccaacccaaatgtccaacaatgatagactggataaagaaaatgtggcacatatacactatggaatactatgcagtctaatacagtctttatataacatttatatacttttaaaaacagtaaacttttgttctgttccactgattttctattcttaaatacattttgtactgttttatttttaagctttataacatgtctcattacttggtattctaagtctctgataattattaattttttaattttcaaaatttcattactattcttgtctgttttctcctaattaaatttgcaaaggtcttaagaggttctaaaataaccttcaggcattttatttagaattacattttgtattggagaatctgaggaaaatttaaatgtcttttgtaattatgcatctgcattcttaggaatatgttatgtctatacagaaacttgttcaagttgtcttcagtcaggtgttaaggtattcttcatatagctcctactaatttattgttaaatttctctctatgtatttatatttaatgtacatagatatttttactcaaactatcatctcattaatatattaatagaaaagcaaatcatttgtatatatccatttatgatcaatctatttttttaatctgaatttttaaaatactttttcacttgattctggtgggcttcttgaatatatcatcaaataatgataattttgtctctactggatgataattttttcctaatagattgcaatcatagttttgtttccatccttttttgcataggataaagttgttacaataatgttaattttggattactagcaagcataattttctttactttaatggcaatgcaaagagagtttaagcttgtaataggcttgctgttgtttgaagtattctgtatctcattacggattttttttcttcctggtttaccaatagatagataacaggtagacaactgtttataattttgccaagtatctttcttgtgtctattgaaagatcatttaaaaattttataaagcctcatttgtaagatatgttgtcaccccagtaacatttctaatactgaaccaatgttgcttttccttgtttaataatgttacattattcttttaatataagcaaactaaccttggagtttaactattacttctatttattttatgaatttcttaagtccatttttatatgtgaaaaagttgaaaatataccttattgagatgtttaggatagtaggttgggcttttattgggtaaatttgtgacttagtgtatgagtgattactgaggggaaaaaaaataatcactaaagacattgtaagtgaaccagagtaaagttgtgttccttaagtgatgatagaggaggttgtggaatcgttttattttcctcattgcaatgcccaccagggagttttcttctaagttcagctgcaagatatccataggccacatgtgacaatagattaatttagaaggacacaggacaggagatatagctcatcagcagggcagcattgtcattttttcttcaatgtgagttgtacttgcagctttcatttagaatagggatcacatgcaagatgatacctatactgagtgagtacagaagcccacctggcttagaagcctagtaacccaaggcgtcagtagctcttgtcataaccccaaaggcatagctttcagggtccccagaaggggcagtcccagtcacatgaatcactgaactggtagaagcacaaagacatggcttcctttcatgcattttttgttctctcaatccaaatgacattttccactcaggggtcattttactataagcaacgtggcctaaaagtatagtaaacattcgacctttcccatgttttcagaacagagatataaattaaccaaagtacaaattctcattcagaataaaagcttacttagaaatacagtctgccctccatatctgcaggttctgcatgtgcagattcaaccagccatgaactgaaaatatttttaaaacacaatagagagtaataatataataaaaatacaaatgaaaaacaatacagtgggccgggcgcggtggctcacgcctgtaatctcagcactttgggaggccgaggcgggcggattacgaggtcaggagattgagaccatcctggctaacacggtgaaaccccagctctactaaaaatacaaaaaattagcggggcgcggtggtgggcgcctgtagtcccagctactcgggaggttgaggcaggagaatggcgtgaacccgggaggtggagcttgcagtgagcggagatcgcgccactgcactccagcctgggcgacagagcaagactccgtctcagaaaaaacaaaacaaaacaaaacaaaaataaagcgcaacaactgtttacatagcatatgtacattgtattaggtatcataagtaatctagacatgatttaagtatactggaggatgtgtagagattatatgcaaatactatgacattttatataaggacttgagcatccctggattttggtatccacaggggttctgaaatcaatccccaacagatactgaaggatgattatatgttctattatttttagcataattaaatatataccaatgtaatgtttttcatcctgtctatgtaaattaaaattccaactttaaaccctatttcttcttttgttcttcattttttcacaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggtaagatttgtgtatgaccaaataaggggagagatgaaatttagacaaagaatatccatttggttaccagatctggtttattacattttgtttcctttgttaggagaagcacaataaacaacaacaacaaaaaagatagttataagtagttgttcaataagacactcattacctaaaacatgaagtattgttttttccataagtagcgggaaaaataatgctacatataactggttttactctcaaaaaattgacatggaaaagaaagtaggtgtgttagtaatttctattagaattaaactagtagtctagtctgaatttttagcaacaaatgtcacagagttaagaaaatgaattcattctgaggatacaaaagcataacataaacttcaggaccaagttaaagctctgatggactgaagcagataatgacagggatgtttccacctgaatttttcaaaggaaatggttaagattttggagttccccgcttaacatcaaagtatatgtgagattttgtcatggaaatcaaggagataacttattgagacattatatccattttcaaatcagaatttctatgatgaaggagttgtttacaatggaagatttttaaatatatattttagattaacaatgcatatgaaagacttgggcctcaaaggagtgcacaaagattactgcatttcattatatctcctaccaaacaagcttggacctaagacagattaatatcttccacatagaagtatatccattttatactgaaagtacattttgtttattttctagattttcttctacctattctctagaatctaatgacagtccaagaggacagttccagatagtactaaggccctaaatttcaaacaacttgagttatatttctccaaattttaggataacaaaaaatccaggcattttgtgtgtatgtttttttttaaaagaactaaaaatcagtagttcacaatttgtgtcataactcttccattagcaaaccataaaaatctaaacctctctcatgacatgcaaaatgaagttagattaattctaaggtcctgtactagtcagcttttctgtgtagcaaacaactctaaagtataagtgatttagaaaagttacttctcattcatgaaacaaggctgtaatttggttgtgttatgcttcaagctgtgggtcaactgcagtcctactctgtgcaagcttctcattccaaggcccaggctgaagaagccgacctaacagggacatgctgttctcattgcaaagagcatttgtaaaagaggctggcagaaacctgcagtgcctcctgtgtttcttgcttggatgtggcatatgttccatctgcccacagatcacaaaccaaagcaagtctcatggccaagcccaaaatcaatagagtgggtaaatgtaccccacatatagggaaggaaggagtaaaggattatgaataggctggacgcagtggttcacacgtgtaacctcagcactttgggaggccaaggcaggtggatcacttgaggccaggagtttgagaccagcctggccaacatggagaaaccccatctctactaaaaatacaaaaattatccaggtgtggtggtgcatgcctgtaatctcagctacttgggaggctgaggcatgagaatcgcttgagcttgggaggtggaggttatagtgagccaaaagtgaaatacatatgcattaactgggaagcaaaatactaaataataatcaatcaaaatacatttattgacgagcaaattctaagaggaacaaactacaaaaatcaattatgccatagggaatccgtctgtaaagcacttggcatctagttggagatataagacccatgcacaagaaacaaagaacaatatagacatttctataaatgtgtgttgatatatatgtatataatatcagtattatttatttatattattttaaattgtgtagttaaggtactgaaataattgaacagcatacagagtagttaagcaaaggaaaatgagtgaaagctctccagagaaggtaagcctggaacttgaccttgatggggcaaggggaaatacggagaaggaacaaatagaagagacccttctaagggaagaaacacaccactgcttttaatttagttgtgaggatggaaaagcataatagaatgaaaagggatccagggtttcatggtaaaagaccagcagaaatgtttaatgcatgcttaacattacagagctagttgagaaaaggattattgattattgattagttatggttaattggctttttcattgctaaagatgttcttgcttttcagacttgattttctggctttttttttttttttgagacattgtttcgctcttgtcacccaggctgcagtgcagtggtgcgatctcggctcactgcaacctccccatcccgggttcaagtgattctcctgcctcagcctcccaagtagctgggattacacatgcacgccaccatacccagctaattttttgtatttttagtagaaatggggttttgccatattgggcaggctggtcttgaactcctgatatcaggtgatcctcccgcctcagcctcccaaagtgttgggattacaggcatgagccaccgcgcccagcgattttctggattttttatgtaaaaaataatgcatgaacgtaatagtaattaaagaaatgtttaataaatcacaccaagtgttgcatttcttattagccctgcagtgctttacctatcagagattttaattctcagaaaatgtactctagtgaactgctaaaaagtattattaagcattaagcattatttttcctttgtttgatatgcagtacagatgttggcagtttaaattgtttctttctgtggagtttcttggtaacgacaccctgcatcctgattccctggacatatggagaaaaggagagccaggaaagaagcaggacctggcgatcatcagtgtgccagctcctctctttatacacatgtgccacattaatttatcacccaaaacctctcgctaaattcagaaaatatttgcatttgttccatttttttatagccataaggaaaaagagatcttccctttctgttaactgattttaaaaattataaagatcatcaaatttaaccattttagtacactgtggtcagtatgttttatacatcagcatccggggccattgatattacatattactattgtgattattttcactgaaaatatagtatactaggtgatttttaataattcaatattacttttcaggtgactatatttctataacacaacttctaaaatattaagttactttaatatgtaataaatattagtatgtaaaataaaaaatatatagtgatacagtaactacatttattatctgctacctgccagacgtcttatatgtttatatatttcataggcactttagaacaatcatatgaggcattgcacatttgttcattatagcattgcttattagtgcatgactgctatgctacaagtacatacactgagtggatgagtctgcacctggacaagcatcaaattcaggttcggagacatgggttatatcaatacactcacatgtatgattgtatgtgagcgaacacacattggaatgacttcaaggaaccagtaagtgctagaatttatataaccatagaaatggctagaagagttttgcttccttttgtgtcctttctgcacataaactagataacttggcagcagaagttaaagtcagtctttttttttggtcatcagatgtgtgcgtgagtgtggtaagtaaggcttgcagtgaattctctacctgacacgatttgtcatcagatgttttatgtggttctcatcttgtaacttcttagtttaaaaacatttagtcatatgttgcctcattaaaggcattcaagaatgaagaaaactgaatttttcgggttgacttcattgtgcaataaataaagttaactccagtgttgacttcagaatcttaacaatgcagaaagctaaaaagataaccaaaaagtatgagctcaagtctattctcaaatcttaagtggatattgggaaaaattcattagtttaattttatagttcatccataaagaggtcacattttgcttattggcttctagaccctaaacttgggatatagaactacccaaagtcacaaaaacaattacgtgttccaagttgcatggagaataatttttcttagattcatgatagtgacacatatataaacagttgttcaaactaatcgcagaatttgagaatttttagaaatggaactaacagtagctatgccctttctgacagggatgaaagtagtccacaggaataaacaacttgcttagaatcacaaaaaaaagcaataaaattggaaaaaattcaaaatttctgatttcatatccagttttctggtcactgtacattctgtcttcccttatatttcttctaaaagcatataagaataatgtcaagcttatattcttatattgtccttactatatgctagactctcagctactacacataataacccgtgaggtaaatactgttgctgtcctaattgtacagatacagaaactgagacatcatgaagtaaagtaacttgtgcaagttcaggaagctgtcgattattagagctgagactcaaacccagagtctggctccaaaaactgggtctcttaaccattctgctatactgcgtttcacaaaaatgacacacacttttaacaagtgtgtttcaaataaacacttagggattctcttttttttttattattatactttaagttctagggtacatgtgcacaacgtgcaggtttgttacatatgtatacatgtgccatgttggtgtgctgcacccattaactcatcatttatattaggtatatctcctaatgctatccctccccactccccgaccctaggacaggacctggtgtgtgatgctccccttcccgtgtccaagtgttctcattgttcaattcccacctatgagtgagaacatgcggtgtttggttttttgtctttgcaatagtttgctgagaatgatggtttccaccttcatctatgtccctacaaaggacatgaactcatccttttttatggctgcatagtattccatggtgtgtatgtgccacatttccttaatccagtctatcattgttggacatttggcttggttccaagtctttgctattgtgaatagtgccacaataaatatacgtgtgcatgtgtctttatagcagcatgatttacaatcctttgggtatatacccagtaatgggattgctgggtcaaatggtatttctagttctagatccctgaggaatcgccacactgtcttccacaatgattgtactagtttacagtcccaccaacagtgtaaaagtgttcctatttctccacatcctctccagtacctgttgtttcctgactttttaatgatggccattctaactgctgtgagatggtatctcgttgtagttttgatttgcatttctctgatggccagtgatgatgagcattttttcatgtcccttttggctgcataaaagtcttcttttgagaagtgtctgttcatatccttcacccactttttgatgaggttgtttgttttttccttgtaagtttgtttgagttctttgtagattctggatattagccctttgtcagacgagtagattgcaaaaattttctcccattttgtaggttgcctgttcactctgatggtagtttcttttgctgtgcagaagctctttagtttaatgagatcccatttgtcagttttggcttttgttgccattgcttttggtgttttagatatgaagtccttgcccaggcctacgtcctgaatggtattgcctaggttttcttctagggtttttatggttttaggtctaacattgaagtctttgatccatcttgaatgaatttttgtataaggtgtaaggaagggatccagtttcagctttttccatatggctaaccagttttcccagcaccatttattaaatagggaatcctttccccatttcttgtttttgtcaggtttgtcaaagatcagctggttgtagatgtgtggtattatttctgagcgctctgttctgttccattggtctatatctctgttttggtaccagtaccatgctgttttggttactgtagacttgtagtatagtttgaagtcaggtagcgtgatgcctccagctttgttctttttgcttaatattgtcttggcaatgcgggctcttttttggttccatatgaactttcaagtcgttttttccaattctgtgaagaaagtcattggtagcttgatgcggatggcattgaatgtataaattaccttgggcagtatggccattttcacgatgttgattcttcctacccatgagcatggaatgttcttccatttgtttgtgtcctcttttattttgttgagcagtagtttgtagttctccttgaagaggtccttcacatcccttgtaagttggattcctaggtattttattctctttgaagcaattgtgaatgggagttcactcatgatttggctctctgtttgtcttttactggtgtataagatctctttctatctctctctctctacacatgcatgcatgcacacacatagacacacaaagagtagaacaaatcacaatccttggtacttcacaatactctcataatgggtccataaatagctacttttattcatttatttgattagttttatactccttagttgtagtcttttttcctataaactattagaatatttaatttaatattataactataagaatttttttcctattaagtattagaatatttagtgctttactttgtatttttacaagtaaaaatacaaattattcaaaaaattattcaaaaagagaacattagatctttttacctctctctatcttgatacttcttacactttacctcttgtttcctacctcctgttggaaagctcctgagctccttgagttcacacgtgtgtttgtacatctctagtgcccactttcttgtttagcatgcagtaagcattcaataattatttcatacatgaataaaagatctacttaactttttggctaaagatcagcccatttacttacagccagataaacctctgtgcattttgcttgcttgataatttctaaagtcttccttcttatcataattattttttctttcttggtttctataatttttcatccaaccaataaaaaagctaagaaaaaaaatctaagaagaaaaagaaaacaaacacagcacctgcctacccttctttccaactccctgctgtaataatttttatgctttttcccacaaggaaagtaaaaaacattcctttaacttgacagcataatcctaatcctttaataccccaattggaatggggtgctttccaagcattctgttcaccattcagcaaggggaaaaaagcagcccccattgattgcccacttagtagctccaggattggtcaacaaatggcttaagctctgtattcagctggttaaaagaatctctcagaaaggtacataaaaccagaagttaaacagttaactggcttccctttagagatgcaaaatataaactagccccaagctctgagagcagaagtgacattattgagacacatttgtaaacattaagcaatatcaaagtatacattaaactatatagtatagacaatacttgcaggaaaaattttaaggaaaacaaaatcagtgaaggttagaataaaaatggttactagacttgagcagggagaattcaaaaataaatcgaatttggatatgagagcaggtgcaggtaaaatactcaggaaaacatgagagattcacataaataaaaacggccatcatgtgttgaaaggatgatgagaaggaacaacttcactggaaataatattagttgagggatttaggtagagaaactaaaattgaatgtgatagactatcaacagctgctagttataaagcatctactacactaaacacttgatatgtttcatataatgcttgccacaactctgtgcattgcatttcataaatttgaggaaactgagcctcagacttaaatatcttgccaaattcacacaactaataacaaacagatctaggcctcaggttgaagctcgtgtccttatgcagcaccgttcaccagctttgtggggctctgagaagagaaatatctgtacagacgaggatttgaggagtctgaggtgttaggttagcttttaattgaagaaggccatttgcaagtattctagctgggaagcagtaagaatactacaaaagaattaggaaaagggattagaaaaaaagataagtttggagaaaggatagggagaacttggtgaaaaatcaaagaagtgcataaaatccaggaccctgaacaagaaaggctatgcagatttaaatggcaacaaacagccccctcttttctcctacttcttccagctgtcttacttctccttttcttggtcatctattacaagtttgcatcagctgtatttcatcatttttagaaaggcagtgattatttattttaattatgatcatttactacccggtaaataaataattatttctaagaaccatacaacctacagatttctattctgttgttgctcacatcacagtaacatattcctattggtattgttcttctctctcacaatacatcagacttttttttaatttatatatatgttttatttaattttatgtgtgtatatatataccactaacatcagctggtttcattgtatccacattttctgttccagatcaagaaaacaagataattaagatgggcagataattaagaaaggagaacatttgaagagtctcaaaataaaagcaagaaagaggacactgaaggttcactctcaaagggagacaggagtaggatgctataataatatatatattatatatatttatacatatatttttgctttaaaagaataacattttatgctataagatgtgaaaggaaattgttttcttttctcatataatacacatctatttagataaggactagcctctggaatccatacaaaggaatatgctattcctatttcagagcaacctcctctttaaaacatctgttttgaattgaggatttttaacttaaagaacttcaataaacaagaaaaatgagtaagcttttgtctatcattctttttctgtttcctgaatccttgtggagctacttttatgacggatatcctatgagttttagcaagcaccctgactgctacttctagtggagaatccaaataatttacatttattttagagtttagtctaaatagatgacagaataagtatagttagtgatatttccagtatgtgaatttttcaaaaatatttatgggctccatatgatttgagattagttttattagtcttgccaaactgtagccaaattttaaacaattataaacctttactctcaagaagcatatagcattctcactgctaagcacaaacctagacatcaaacagcaaccccatggggtagatttttaagtgatacaaatttccattcttcttgcactacatcatacagcattcagggaacactatattcaagatgcaacagtacccttaatgaacaagcatctttattagatttttctgagataagtcctgagctacagggaagataaatgactagtgcaaggtgcaaggcagtatttcagctggataataagcccatgatgctggaccaagctgcttttcaagcagcaagtctgattagcctttttacaaataagatttgtgctgtttctagatctcagtaaatattgtttattcagaaacccattggtttacaaaaagcatagttattttactgatataatctaggtgttactaaaggctttttaacaaaatattccagaacttaaaaccacaaatttacactgcacttgaaaatacacacacacacatgcgcacacatacacacgcacacacacatactctccagagtaattataagactctctccaaaactcttttattcccttatagttaaatcacatttttaacactcaaaacactcattctactcaacaaacataacgtcaagacactttttactgtttgaaaaattcagtctacttttaaaaggaaaatttgatgtcatcaaaaataatcaaagaacatgctactttttcataggtccttaaaatattgtaaacatagtgacatcatgggaataaacgtgtgggcttacataataattatgtctatagaggaaacaatcatagattttgagcactgagtgagcctttggcatgcatttagataactctctaatttttcaaatgtgaaaccaagaagggaagtggggtgccctgcccagagtataacccttggttaaaaccatgccctggagaccactagtccaggctcccagtccagtgtcccatcccctgccctgttctgccagttccttttgtttaaaaaagtcagtttttatccctaaaatttaccagtaaaatatatgttttcacaaacatagtcatgtcaatatattacataaaagagcaggaatattcattaggaaatactttcaacagggtcacaaacataactagaacatctgtttaaaaattgtcattacttcatagacacaagaaaatgtagcacaaagatgaatagagtgctttggaatgtgttctctaacttataaagaaactatgctgtagactaaaatagtagtcgacattcattgaaaactcaccaggtgccaagtatcactataaaggccctaactatgttaaataatttaattctcacaataagcttgtgaggtaaatattattagtagctttattttatagaagaggaaactaaatcacagaaatgatttgaaattttccaaaatcctaaaactgataagtgacaaagccaggctttgaacccatgctgtcaaagacaatactatcctggctcatattcccacaagtctaagaacatgcaccagtgctggaaaaggataataaggatctaaattgtcttcatgactgccgacatggctgtcttccttcatattaaaatgctgttgggcattttagtttaaatgaaatgcagaatattttcagaaacttaaatggtatgccaataacaaagggtcctccattacagggagggagagatccatctgaaattgaaactgtcttgcatcagctgaccagaagtaaatatattgaaaattgaaagctatgggacgatactgaaatattttcccttcctctcatcttcttttgctacaagttagtttaagactctacttaatcaaaactttaattcttccttcatggaagttttaattcatcattacattttaattggtggaattcgtaattgcctcttatctatcccatttcatagttctttgagcagctcaaataaactaacatcataattggtcagacagtctactcacatgttaaacgtttactaatatgaaacagaatctgatacttctagacatgaattattactaagataaaaatataagaatttttatatggaataagagtcattattctatatagcccaggtaagtctaacataagctctaacgatttctgtctttgtgaacgtagttctctgttttaataccaatttcaaatagagaaatatgtacctcaatgtgttcatttacttttttcataataatccattctgcttctgtcattttataaagctctttattttttaaatgttagtaactaatgaaaatgatcaaaatcaacatgtttttattttgtatgttgctgcctaagaaaacatatttaaaacttgcatcttttttttttttttttttaattatactctaagttttagggtacatgtgcacattgtgcaggttagttacatatgtatacatgtgccatgctggtgcgctgcacccactaatgtgtcatctagcattaggtatatctcccaatgctatcccacccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatatccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagcggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgtccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggcatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgatacccttccttccagttgatcgcatcggctcctgaggcttctgcattcttcacgtagttctcgagccttcgttttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttcaccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcttgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatccgcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccactaaaacttgcatcttaatgatatttttaccaatgttccatgagcaatgtccatggcatgacagaaaggaactggcacgctaaaaaaaatcgtgagatttctactctgtaaggtttttaatctttatccaaaatagtggttttgatagtaaaatttttgttctgatgatttttctcaattttctgtgtattttccattaatgaaccaagatccctttagtactccctaaaaaaaccatcgtggcccttctagggagcctcttatattcttggtgctaatcagcatgaattttactagtattaatttcctcttttctgcatgtttttagcaagtgcagaaatttgccaaacaaattacttcttaaccagaatgtattcagtaaagtgactcaaaatcattcattaaggtagatgagaaaatagactgggtctcagaggctgtaaatatcagaccagcctgactcaatttaggacaaggggaatcattgaagggtttagtaaagcctagccataatcagaagcatgctttttgatcagtttgaaaaaaaaatatgcaatgaaatgaaaggaattgactagacgagagagtaccacataggaggccatgctgtatctataatgtctccaagaaggcagagatttgtgtctgttttattcagagacgtattccaaagtgcctggaagaaagcctaatacataatagctgtttgataaatattagctgagtgaaaaaattcatgaatgaatgacccaggcaaagtcaaaggcctgacctggagtgaaggcaaaagaaatgaaagggaaggaaaagatattgtgaacttagtgttgagcatcaaatggacacagaaatcaacggaaagaggggagcaaaatcattttgaaatctttagcctcaccggctgagagatcaagaagtcattaacaaaagagaagccagaagaggaaactggtttgagagtgaaagtgctaattttggtctaggtatgttgaacttggggcaccagaggatgatatacccatataaggaaatgtagggaatatgacaaagaaatgacaaagtagggtgggaatttgagagagaggctggagcgatggttattgacttgggcaaactctccattaaaacagtaaaagccaaagatagccaatggaaagggcatagagataaaaagaaaaaggttgaggcaaaaatgtgttttcaaatgtctcttttttgcattcctattctttccattccatggtcacaaacctaattaaatctcttagcacatcatgttgcctgtctcctggatacctgggtcatccctttctctccagactattcacatctaatacattttgtggacctcaccttatgaccagccttaccataaggcttctatagaaaattcagctctttattaaatttccatgttttatcttccctgtaccactgatgtcacatttttgttaattaatcatttcttgtgttcatacttgacatttcaaatatattctaaattcttagcttgcaaagaattacaaaatctatcttacacttcctttttcatcttccataataaagtaggtgttcaatgaatttttgttaataatatttgagggggaaagaagacaatcctatcatcactatgactactaaggcaagcagtttactagagattagaattcatgtttattcattcaatcagtaaatatttattgagcagttacttagtgcttgaaactctttgatttatctagagataaaacagtgaacaagactgacaagattattactttcctgaagcttacattttactagcaagtcagaggaagacacagacaataaataagaaaacaaaataaatgggataattttatattggaaaatttgccttaaagaaaatataactgggacagagaataaaggtagatcagcatgggggtgggacacagaagactatccaaaggagggaacattttattacaacctcaaatggaaattttggaggaagaatatccaatgcataagaagcaacagatataaaagccctgcattgggaaccagctgggagtgtttaaggaatgactaggaggccaatgttgactcaaagagagggaacaaacaaggcagtcatataaaaggagattaaagagttagttgggcccagatatacaatagaaccttgaaaaacatagtaaagacttaagagttttttctaatggcaaagacaagccattggaaatttttaaagaagcattttttacctctggctcttaaagtagagaaagatatatggtgagaaggagagagtgcagcagaggcagtgagcaagagtgaatgtagtaagagaagttaggaagccagtgcagtaatccaggagagagagggtgatgactcagtctagggtggtgtaattgagatgtgaaagtggcagctacaggtctctcatagctgtgaaactgataggactggaaactgtttggatgttatatgatgggtgaggtaaagagagaaatcaggataagcttattttctgaacaaataaatggatgatggtatcattaactgaactggtcaagcatgaacccaaagtaggttaacaaacaagggaaattaatacctcggctttgggtttagtaagcttgagatttttattagacagattaatctaagttataacagatgtataaatgtgaaattcaggagaaaacaaaataaataaaaattacaatttgaaaggtagaaggtacttatgaaagatttctgtgttagatgaaggactttgagcttgatgatgttagagattagtagttattaagggatgcttaaatgatctgagagatacactgaagtgggtgggaagagaatcgaagcagaaaaagataggcacctttttataaagttcctaaattctaggaatgagaatggcaaatgacttcattatacgcttttgactgtaagaaaggaaatctgaaatcaaatgttcctaagaaatttatctcacatagcgacatatttaatgatagaatgggctccatgattgctcaattcagaggttcaacaggacaatgttctcaagaaccgaagttcttttcacctctatactcatccatccatggtgagtgagacaaaactgtcctcaggcagacctgccttgtgacagaagtgtcctgtccacagggacagaggtaatatagttccttgttctcattcaggagaaatctcccctctcaaccagaaacagattaatataactctgtctcttcagctttattagttcatcttaggtcatatgtttacccaaatcagttcatcttcttaggtcacaggtttaccacggactgagcagatccacacaagaatatatactgatggcttagactgtgtacctaatgggatggaagaaatgttggaaggtatactatactataccatacctatactataacattccctacaactaatttaaagaattgacagataatagagaatataaggaacaaatgaaaaagaattaacacccacaataaaatagctatcatttattgcacatttattaagtgccagctacttttctaaagtttttacatgtactaactcctttagtccttataacaccccagaagagctgctattatcgtttcattttatagtcaaggacactgacacatagagtagctactcaagttatagttaataaatggctgagctaggatttgaatccagacaaatctgacttcagctgtcatgcccttaaccagtttgctctagttaaatgaaaatagaaagagggacgataccataaactcaactggaaaattataaacaggaacatgagaagggggattgtatgggaaggaagagtatgatattggtttagctatgttgaatttgtaatgacatcaagaagtctgaaaactgtggaacgtatgagacagaaggttgggtaagatggaggaaagaaatatggatttaggatttatcaataaaaagtaacatggggaaaaatcaagagaaactatgtgcagagaaaaaggaacaaagcccctaaggactgatattaaaggaaaaagaggaagaggctttagtaaagaaatgactagaaacatgccttataagtaatgacagcaaactatgaaatctgtacatcctcaagaccttgagcaatttctgtacaaagccattgttgaagggctatttcttaaatgagagaataaacagctgctatagaccgcttcggctcatcctgtgtttcctcactctaacacaatggttctccatttttagccaagcatcaggatcacctgaacggtctgttaaaacacatttctgggctccagccccagaggttctggtttcgcaggcatgtataatttttatttctaacaagttccaggtgatgctgtgctgctgatctagatctagtccacattttgagaaccactcttgtaatacatggtctttgacttctttgctcttattctctcccttgtatctttttcttgcttctttattctcttttttttaccatgttttttggatttcatatgcaaacacatacagttgctactactctacattattttatttaattcttgcaaaacatcactgagagaatgattattgtgcctgtcttatagattataaagcaaagcttagcacaaaggatagatactttagtactgaatcaataaacctaaattatacaacagactaacattctaatttctttttgaactaatattccccaattccacttatttcctttcttctacttgatcaaccatgatatcatcttcaacaaccaaaatcattttttaacggctattttgaccatatcacataatttttaaaatcgttctgtgcctgttgttccttttgcctgtatagaatccttcttattgatcaactcatttctctaacttggcctaatgtctcaaacagtgctttgcctataggaaatcaacaacatgatgttaactaatgcattgggtagcagtctttcagactttcacctaagccaatatcctacttggccactctccttatcccagtaaagtttcatttatttttttcttttattaacataataattatttgacaataaaaactttgccttttatagtcattaaagcttgtttggttttcatggagggtgaagaagaacttactaagaaaagtttttttcacttaaagaaggaaaacaagtctactatattcccaagtctatactccgagtattttctccctgcatcacaccataaagtctataggtctcttgataacttaaaatcacagaaccataaactcaaaactaagagtgatattttatcatctgtttcaaagccatctttatccaggtcactgtgaggaaatgaagtctccaagaggagagatgaatgggccagagtcattcaggtacagcctgacagagttagagttacagaaaatcccagatttccctattatcagtcttgtgtaattctttctgtcgcataactttataactccaaaatcctagtccatctccaaaacattatgatgttcagaatgtgactagctacataggttttgaatcaggcactatgaagataaaaaaaagaaaaacagaataaataaaaagaatcctacaagtttcctcccccagctcaccttgtatatgcctttccccaccaccacctccctgacccagccccccatctgcattccaaggcactagggtactcttggtgcctgcttctgtgagggccttgattcctaggctcacacttcctctggttaactcctgctcaatttcctatctcactttaaatagcctgtccctaaggtgaaatccagccacctttattgccaacttccaatgcctttccatagacagaaagcagccctaaggatatgttccaaaattcactggaaagtggggaaaaaaaataaggacaaaatcatcagatgttaactcaattacctcaattaaaagaactgtctttttttctgagattatatcctttttatatttggggaattatatgttattttatttatgaaaaagcatagatttttttttaaaatacctcaatgaaataaaagttgagcaacctctgtcaatccctccaactttttttcctgaaatttgaaagtcttggaatgcatattccttactcaaaattactgtgcaaagattcagtctagaaaaaggggcacaaaaataagaaatgtgcaaccaacttgctgtacaagaccctctgttttaattcctttttaaagcaacccagtgcttgtatagtggtgtgtgaaacataggagtttctaagcaaatgctttttagattccttacacttaaaaaaagtcctttgggatgttttatgcagaatgctacgtcctagtttaaatctaagaactcttttgaccttcagtgcatgtagaaaaatgtaaaaaataaatgagaaaattaacctgttcaaagaaaagctttaaaaaaattcttcaagcagagcttctccctgttatcattgattaaaataagaaggggaacaaactgaaaggtttaaaaggagttgtcccttaaaatattttatatacatactgcaaaaaaaaattcattctgaaaacaaaggcttctagactcagtttactgaatgcgaaatgatcagactcgtcttattcagatgtgaaggtgaccatttgaggtctcaaatagccattgtaaccaccctgcacaaaatcatttctctgaaaactggctacctctaggacacagattctgcatcacctcacaaaagatggtagtgaaatccctttaggaaatatttaaataatgagccaattcatattcccttcagagtttctcatatcttttgtcaacattgaaaatccatcttatccctcacagcaaacaaccacttcatgtgtttcctaggggttagactgttccatttcctttccaccaaagatgaccttgtgtacaggaccagttttgcaggcagcacaagagagttattctttcgataacataggatttaaaattcaggacagctaaatttcataggaagagctccaaaaggatgtggtcacttggtggagcatatactgtacacagctgataggcttcacaatgaaacacctggtaaagcgtatctttgaatccttaagcttccctttcttctgcatctttacactttggaaatccatgaagctgctgttaggcagagcatttaatggggatcttgcatcacctcaatattcccacttgtatgcctattttgatgcagtcacactacgagtctaatatgaaaaataacttttaaaaggcaatgaaaatgtaagtcaacctaaaaggaacatatatactgagactggtagattcagccatgcattatgcttaatatgttttaagttaacgtgaacttgtttgaaaagagatagaaaaatatatatacaaactagcagtgtttcatcccatttaacaagtatttgttaaccacctactaaatgccagacactatggtaggctgtggagctatagctttgaactatacacaaccccagcctccaaacctcttgctctctagaaggaaaggtgaacaagtgaatgagctattttctgtttggtgtgataggtgttttgggaccacagggaagcagtgtagacctcaggtgaaaattatcaggaaagcttcctagtggaattgatactggaaagattatttaaagaacaattgatgttggttaatgttatgggctaaattttgaagtcctaacctccagtacctcagaatgttactatatttgaatacagggtcttaaaatgtaattaaggtttaaaaaagtcactggggcatgccctatctaatatgacttgtgtctttataagaagaggttagaatacagacatgcacagagggaagaccacgtgaagacacaaggagaagacagccatctataaagtaagcaagatatctcgtaagaaatcaaccctgccagcaccttgatctcagacttcagcctccagaactgtgagaaaattaatacagtcatgtaccacataatgacgttttggtcgatgacagactgcataaaaaacaatggttccataagattataatactgcatttttctcgtaacttttctatgtttagacacacaaatacctatcattgtgttacaattgcccacagtattctgtatagtaacatgcagtacaggtttgaacccaggagcaataggctatatcatatagcctaggtgtgtagtaggctatacggtctaggtttgtgtaactacactccataatgttcataccatgacaaaaatcacctaaagatacatttttcagaacacatccttgtcgttaagcagcacatgactatgtctcttgttcaagccagccagtccatggtacttggttatggcagccctggcaaattaatacagtcgatgaatgacagtaaatgcagtaaatgctaaaaaaaaaaaaaaaaaaaaaaaaaaaatgaactggaacaaaagagacaccacttcgaatggagtattaatcaggaatattaatcaggaagtggcagcaaatgagcctgggaagatacacaaaggacatggggacttcttagcttcattgagaagggcctgagatgcctggccagagttcagactcaatcctgagcatgaagggatgccaccagaggtttttaagtgagattgaacataaaaagcttacattttataaaagtcactctggctgcagtgttgattattagttgtctgagagcaagactctttgaagctgggagaccagtcagaaatttaatctagatgagagatgataccaacctaaaatacagtgaaaatggggggaaaaagtttggaaacgtaaatttgagttataataaaggaacaatgtgagaacaaagttgttagaacaatctctgagtctcctccacgctgtcacatttccaccccagtgcttagtcttctcataatagccatatttgtaagagaaggcaaattccgtttttattagttaatatatttggcaacttctcctaaggcacctgccaactccagtgtatctcaggcttttactcttgaactctgaaacccgagaatgctaaattaattcacacttctaagaagaacatggattgaggcacattctataatacctatatttaaacacttcccagaagtgtgctattttgtatgtgtgaaaattgccaacacaacattcacaaaccctcttaacttgcatctccagccttgacgtccctgaagaagaataaactgccttctaaatgtagttagctaagagaaaagattaggaaaggaggagtagaggaaggagtggaaatggggggaaagaaaagagatttttaccacccactagtttgactgtttagtcaatctctttgtctcaacaacctacttttagtgcatgaaagatgtggttactctctgagatgagagtataatctctgctggaaagtatacatagtcagcgtgtctgattttcttaggagctctacctttggacaagcaggagttagcaagaagtatataaagtcagtgagtctcacacatgggaaaactttatttgccatctatgaaatgttcaaatattagaaggatttatttttattatccttttcttcaaagcactccattttaaatgtcagtaagcttttcaacaataaagatagatttcagcaaattgccagtcaaggtttttcttttatttcctgggtgtttcttaataagtggacttattgtagcccagatgtctgtctgtctagtggccagccttttcatatccacgatcattttctctctctcatcatatttcccaactacgctttactgcatttatcttcttaaaccatgtgtgactttctataccaggaaattttcaagggaacatcacttcattttgcttccaatagaagcccaggcacaaagagaaatgataaaactctggcccctgctttattcataaaacactttgcagagtgcatttagtaatttgccattgtaaccactggcactaagagctttcagggccgagttctgatgctgtatttagttcatactttgactgctcagctaaaacttccatttgtatgcatttattctgcttcacacattatgttgtcagtcacttgcaatatttcaaagtcacagcaggctttttctgacacatatttgtcagaatgaactgccttgattgctattattacagactatagtgcctgagtaaggggaaaaaaaacttatgtagtaccagaatattgaaactgcctaataaaacaatagatacaagagaataaaaatagaataaatgcatataaatggatgctttaaaaggccaacaaaatgtaggattacaaaatagacatatagaacccaaaaacccattcataaaaaggattggaattttttgaaaatgataaggagccgaatgagaaaattccactgccccagtgtcagtgagtaagtgagtatcacatacttcctttccagtaaccagggatttaagtagactctgctaatggatgctgtcattgagagaaattttagcatgaaatctcctactgaacaacaataaaaacacatgctttgaccaaaaataataaaaactatgaggaactaattagaaatccagatcctttatcattcttgataaactactgagcatgtaatctgaaaagacctgtgccccatttggctgctcttttctctaccttttgatcttacccatacttcagaactgaacaccatataagtaccatagaaatccacttgggaatcagggaatttctctgccgatagggatggcccttccttaggattcctcaaatttcaagacttgcataaagcataagataagaaaattaaataagacataataattagttttcaaacctcttatcaaaagtaaattataaaatacaaaaatctaaaacatttttattaatgccacagatcagtagaacagaaaaatctaagctgtgttgctcttgtctttggggcaattatataactttatgaatttgcttcacttcatatgtttctccacatattttcctaaagtaatattcaagaaattatgctggacatgaaaaatctctaacagatccactgtttggaaaatcatttctttttttaaaaaaagaaagttatgatgaagagtaattatcaaaactggaagaaattataaagtaagaaaattgtaaaagccgaaagataggtcatctacttgcttactctatttctagaaataagatttaattctttctaaagatgttgtgtttaatctgaatgttattaagaccccaaattaaggatgactcttttatttctgtttgaatctttataacaaaatattaaaattacttttggaaagctttaggaagtttaaattgttctaaatccctcattgtctcacctactcattgtcttggaacttcttacaaatattaatggctttttgatgcatattgattctttatgtaccatatgactaatagcataactctagatgtacactcagaaaagtcattacagtgatatatacaccaatgggattcagaaagcatttttttaatttaaaaaataccttcattagcatagttttcaaatttgtaaacaagttttatattaaaagcaataccttgttgaatattaaaatgctgagatacttaaaagaactcaaaagttatgcaatatatatcataaaaacattatatatatataaatgtatcttcagtacatcaaggcaagtttaaaacattaacaattttattaaaatatccattttatttgataataataaaaataattgattctaggagtcaattattttttctgagaaaaaaataattgtttactggagtcagtagtcattctactaaattgtttctatttaatgtattagaacagataaatgtattttgtctaagtgggaactatttaaatattaaataaatattttcaaccttaattgtattccacagtctatgggggcattgagaataataagtaccataaagtgtaaagattgggggacaagaaaagctctaaaatatattaggtaatttgtttgtattaattaacctatttgctatttttgaaaaattattgtcagcttagatctactacagatgattatgtctgttactaaataaagtaaatttagcctattcatcaacatgtaaatacctatatcaaataagacaaataggccgagcgcggtggctcacgtctgtaatcccagcactttgggaggctgaggcagacggatcacgaggtcagcagatcgagaccatcctggctaacacggtgaaaccccgtctctactaaaaatacaaaaaattagccaggcatggtggcgggcacctgtagtcccagctactcgggaggctgaggcaggagaatgccgtgaacccgggaggcagagcttgccgtgagccgagattgcgccactgcacttcagcctgggtgacagagcgagactctgcctcaaaaaaaaaaaaaaaaaaaaaaaaaaaacaaataattccagctgtcatttcaattgaattttccataagaggttcaattttttcttgagactttttaacagtatccacaatttcagacaagctcacatgagtttgttttttcaggtagttttaacagtgtgataagatggtttactgccctagagggaaaaggtgtcaatgtgttatcagttggtatgttctgggcctttggtatatatagaaagtctggcattttagtaactctacctaggataatatacattgataacatctatttaagaataagaaattcattagctagccctaccttcagatgatattttattcatatttttatttcttttcacacagtatttctttataaatctctgcttctacttcttaagtatttgtatattggtagaaactcactttatcttaataattataatactttaatgtatttagaatattgtatatcatatgtaatacttaggatactgtacatattttaacaaataaggagtgaatactgaaattaaactgtagattgactaaatgaaccactgttatagagcttcggagatacagaggagctcccaccaaatcctaaaatttttctctactttaaatactctatcatggaactattcgatttgatgggacataaatctttttatcgtaatgtcatcctggataaaaacatgcacacatgcacacacataaaaacaagcaaacaaaaaaccaagtaatactacactctttgattcatacctgtgcaccaaaggctcaagcgtagatgtaggaggaaaaaaaaaacaaaaaactgatccctctacttccagtcacttctgccccaacttcaaagaactcaaactcaaaccactagttctatttgttcgtttgttttctgtggctgagttcttactcaaaatgttctacttaagcctctccttgggggactgtctccaagctacattgaggacagagtctatagctagattgcctaaggtacaaatttcttgtagaacccaatacagctgccaatttgcttttgagggcaatcaagatgttcattagtaattgagttgaaacagagaggaacttcatttgtactgagtcagtgacctggatcgttttcagaatgagtgttgagctgaaatggaccattcatttctacttccattgggatcctgttcaaaaaggttattgctcttaccttcttccaacaacagtgataggaattttcagaagcaaaaaacaaggttttatgtttgccacttgtatcttagggcaacatttataataatgggatttttaatcaatcttagagcataaaataaaccctatcattttagactgacctgttggactaatttcaatgactttagctggtaggtaattgaaataggatgacagtacactggggtgaataagaggtttcaaaaatagacaaagataacaattagacatatttggagcatcaacagaagttagtataaaattacaggaattttagaaattaataaagaggtcttatttatttaatattgaaataataccatttaaataattttaacagcaaaggtcaatataaggcatgctatcaccaagcactattctaagagctttatatacctcttgttacttgcaactaccgtgttttacaaataaaaaaaactggagattacagaggttaagtgacttaagtagcttacccaagatcacaagagcagtatataatggagttggtattcaaacccttatagtctggctccagagtccatgctctcatcccctctactattaccagtctcaatgactggcaaaataagccatcagcattatattgccttcagattctgagtagttctctagagaatgaatgagtcataagggatgaggatgcttggctgaatagttttgcccccattattagagggtaagagcaattttagaatttcatagtgttcaatctccagcgaatagtttttatatagggaaactgaacgaagcaactgaaaaaactatttttactcaaaatttgtgcaagaacttgagagcacatgttaacaaacctttgtaatcagttagcagagcatggctcagaggataagtttttctccacacttctggggagactccagggccctggagcaagcatttgaacggaggccttaatggacttaagggcagagccagcccagtagcagcagcagccctgtcaccaggaagacagtctagcgtagcaatttagcagcagtggcagcaacagctaagttaaggaggcatgtttaccaggcttccaagttttgaaaggtcttagaatcaggcaaaaaaaaaaagtgccaaaaactggaagtaaaagggccatatgacatcccaaagtccagaagtgcatgtaaaatgtgcacaggtgattcccagaattaattgaaaggaaatttacagaggctggaggtctcacacttatgggtgcatatggaccagatgaatactgcttgtttataaagttgtcgtcacacctggctccattgtgggtataggctgagagacacagattatatattcaccaacgaattactagtattctttcccatacatcttttggttatgttcatcatattatatttaacttaaaaaaatgtgttaaaattcaatttgacaaataaaaagttctgaaattaaaagagaaaattttaatttgatagatgtcaggtcttaagaagggatgatgaatggaagattatattcccttttttagattttttagattttgcattctgccataaatttccctgcagtgaatgattggcagactagaataagacatcaggaagaagagatataatgaaagtttaataggcagattgcagacccaaacatagctgagtcatcagtgggaatttccattggtttctcagtctcttttaaatattaaattaagcttcactgttaagaggactcagtactgaagatgggagacctagttcttaaagcgaaaatctcatcaagatataagatctgacccttttgtattatatcattttcaattaaggttttaatgccctcttttcataatggaatctctaatttactttaaaaaattgctttcacatgactcattattttacatgaataccagcattggtatgataatagtgtcaaaaataaagcactattcgtgattttttttttctgatgcagggttggaggcttttctaaaaaaaaaatttttatagaagaagacttaaataattacagttgaatttaagaacattatccatatgaattatttctaacaaagaatatccgcatgtgaaaagtggcgggtatcctgtatttctagctacatttactcagtgttttaatgtcagttaaaatgctatcccagtcaaaacagctcctatacatgtaaaattatggttatttctcaaattataccattttaaagtgaaaccacattgaaatgatattattttgatatgccagcagatacatgtagtcacccaaagaagttttatattacaggtgcttgaagtcagaaaaaggagccttttttataatttcataatgagaaaaaaaggaagtcagagaggtacgatttaattcaaatatacatttgtgtattagaaatgattatggagtaaatgccttatcttattattttgattgaatcttctgtaaagaaatatgagaaatactctctatcaaatggagcagtagtcgcgtatctgcctccctcccccacaacatgtgagtaaaaagtttaaaaatatattttaagaatcaaagtttaaaattataaatatgtcaaaaattgtgacagtctgagatcttatatgacttgcaatctaccaagttagcctgccacagtttcatagatgctaacagaagactcaagactcctgggtcagaaacaagagtttattatgcatagcacaggcagcatgagccttatgttttcaccagttccccttgtctccagagcccatgcagataatacaaagacaggcccagatggatcctgctcacagagggcatttagaaagcccccaatcttacactgagactgttagaaaacctgcccaaacactgccccagagggagatattatctctcttatccacagggggaaaaaaaaagcaaaaaactgacctcgcacctgaagaaaggtactactatctcccaagtgtgttggctttacaaacatccttgaaaagagtccaggatgaaagttgtccccagatatgcagaaatgaaatggagaattgcatcccaacaaaatgtagtagtcaatcctcattattcacgattctgcatctgagaattggcttactcactgaaagtaatttgtaacctccaaatcagttcttgcattgttttcatggtcatttgcagaaatgcacagagtggtgaaaatttgagtttgctcgatgcttaagtttccagctgaggtcaaacaaggtgatattctatcatcttgttttagctctcatgcagtaaacaagtatccttttttcagtgtcatgttttttgcattttcgtgctttctttagttggtgactttgctttttaaaatgacactgaacggtgctgaagtgctgtctgatactcctaagtgcaagaaggctgtggtgtgtcttatggagaaaatatgtgtgttcaataagctcattcgcacttgaattatagtgctgttgccatgagcttaatgtttgtgcatccacaatatatattaaataagccttctataaacagaaacatgcataaaacaagtttacgggttaatctgttgatgaaaatgtagtgaccgaagcctcacagaaacctaaccctgaatttcttgtaggaacaatgattgaatatcagtgaattcagtgtttgcagtgattttatggactatcactaccatgaataatgataatcagctgtgtagtcggcacaaatggcagcacccttgcttccactctggctctcttacagtgtcatcaacaaaacaacaagagtggttcttattatataaaccgtaagtgagatcatggctcggttctcctcagagctcttctgtgactttccctctaactcagaatcaaaggcaaagttatcccaatggtcctacagcatgtgggctccccgccttgccagctctttccctgtggctcctgacatcacttcttccattccccccaacccttgctcattctgttccagctacctggcttccctgaggtttatggaacatcccaggcagcttcctgcctcaagaccgccttacttacttctgcctaaaaagctcttggattttttttttccaaatatctaaatggcttactcctgcattgctttcaggtgtttgctaaaatgtcaccgtctcactgcggccgtcactgaccaacctacttaaaggcacacgcccatccctgccaactctggttctcttcatccctctttctgctttgttgttctctatggcaccaccaccacctggcacactataaatattatgtttacctgtgtccttcccataatatgcagaaatattatgcaaatattatgcaaacaatagtctgttttattcactgtggtatgcccagtacctaaaacagtgcctaaaagtttttgaaattttcagtgacttttttttgcaatagagtaagctctatcttgatctgcttctaaagacagcaccagagaacatttctctgaaacataaataaacgtagagacacagctcaaaactcttgatcagactcagtaaagctagaaagctaattggaaaaaggtagcagggtgttttcaagctgtcttgaaaagagatgagtggtgaatctcttcatttttaaattgggagcaatgtttgtagtagcatgagagtttatattaggctatcaaaataaaaaaatgacttaaaccctattaactcagaaaaatgttgtctctgtaatttctttgtctaatagtaccagatcaaactaatccctcatgaaggaagaagagtgcttttccttgagaaaacaaaacaattagattctagctaaactgcccacaaaacacgaaatgtttcatttaactaagtgagaagacatagcttgtttaaatcctaaataaagaagcagtctccattaatggaaggcaagtcccttacaagcatgtttctctctgcacctaaacaggtatcaagcgaactcattgtgcttcctcatattgccacagagagacacagataaatggaacaaatgccaggcaaactttgaaacggtttgatttgatgttaactctaattctgagttttaccatcagtggttctctcatgctatcataacccaaatttctctaggccttgccaattgaggaatgcaaacaaggccatatcatcatcaatgagaacttcaaattcactgcttcatgtcccacagcagaacatagtgcctacagcctcccttcagtgattcatacagttatggaggtattttgagtgctcatgaagagtcctcttaagatttctcatctaataatgtgtcccccaaaaccatttgagagtcacattttggctgcccaggctcaactataacaatgcacagccacaccaacggtgcaaacctttgggagctgaagcagagccagtttccccacagtactcactgtgtgtccaaaatacatatgtatgtattatgtgtgtgtatgtgtgtgtgtctgtgtgtgtttgtgtataaatagaatatgaccccagagtaagagggttactgtaatatgaaggaggtagcggacagtgtaggctctaaggatcaggcagtgcttcatgaaggaaggagcatttacgtaaacctcagtctatgggccagatatacatatcatcagtgttattatggaatttttggctagaaaaacgtttcttccagtttttctgattcctatatttcaagaaggcaatctctaaaactttgagtgtattagtgaattcacatgaaaaacttatcatataaaaagtagttacccagggtatctcagtgagaaaatgtgggagattgctttagtgtatgctatgtgggatcatctttctcatacatcacctggcttaaacattatttttttcaaacgtattcggattttatggaacctggattctagtgctacaaaggacaatataagataagggagaaaatgagtggaatgagttgtggatcaggacttaataatgtatatacagtggtcaaggataaactctctaatatgtgagcagaaacctgaacaggtgaaggagcaagccatgcagatgcctgcaaaagagcatttcacacaaagggaacagcagtgcaaaggccctgaggtagaagcacgatttcatactcaaggaacagtaagcaggcagagagcagagagggagggtcacaggagtggaagtcaaagaggtggcccagggccagatcatttacaactttaatagccagtgccagggctttgctttagagtgagtaggaaggcactacaaagttttgagcagagaaatggtgctatctgaatgaaggtttaaaaggatcacagcagatgctctgttatggtaaactgtagtggacaaagtggaagcagacagtttcatgtgatatatggcaatgacttggaccataagggcagcaatgtgaagtatgtgaagtggtctgattctgaatagctgagacagaatttgctaacatgttggatgtggagtctgaaagagaagagccaagtatgactccaagtttcttggtttgaacaactagaagggtagagctgtcatctaatgagataagaggcctacaggaagaatattttggggtgggtagggacgtgaaaattgggagatcaattctggacgtgggacgtttgaagctgtggagtatacataatttcagctggacctgcctttgctttgccgtttattagctgtgagatcttgggcattaactcagcacttctgagactcaactttcttatctgtattatgaggatgatagaacctaatgtgtaagttagagttgtgagaattcaacaaaagaagaggtataatgtacctaaaacacagattttaagagaaagtaaaatgaaacaaaatcaagtattaagtaagtgattagtaatttgtgtttatcaaaatcatcatgacagtaggtgtggggtttcttataacagtagaagaattacttttaggaaaatttctatgactgtggtttaatgaaatgaattctaattaaacacttaagaaaggggatccccattgcataccatccagtttcaacttgtcttttatttttaattccttttctgggtttactatggtcagtattctctgctcttccataggtatgtcagttgttttctcatcacttggcaagaaagctaaatcttcagtcagtttggtagagatttctgtacaaagcaataaatgcactcttggctttattcctttgcaatttatatagtccctcagatggtcaagttatcaagatattattctgatgtatttgtctcatgttgttctccaaaattactaattcatactctccttccttaaacctcttgtttactgttaaataaagttttgttttatgtggggtagtgtttttacttcattcatcctgcctacattcagctcattttaagatgtgtcttttatatgcatttgtcttccattttctttacaaagctggttcacacaaaacagtcaaaactgcttcacttccagtgtgctccatcacctcaaaatctgctattttgtttgtacacttcgcacctgagttaggtgctgatgatgtgctttaaaagccaattttgactgctctaaatgctataagttgacattcattaagttgcttggatataccaaattttctgtatcttcttagaagtctctcctcttaaatttccggcttcatttgccatgatggttacatttgttctacctaacaccctttgtttgtgttacattctatgttcctgaacagaaaaaccctgacatgtcactgtgtgttttactatttatacttccttcctgaaatatctctttccctcacccatatgaaaccttactcagttttcaagatttggttctaatattacgtcttcctggaagtcacttcattctgcatttattcatccccacttttcttatcagaatcggttgagtagtagagcacttatatgcatatcttcaactgaccacaagcccctgaagggaaggtacaataactggtttaggttttatttcccaaaatgtcttgaatgtaatagatgatcagtaaatgtctattgaaatagtatgcttcttttaaaagtatgaccttttagtttttatctgctatgtcttcattgtcagcactgttctggcataacaatccatgctagttttattgtgctaaacacaattttattaattcaacaaatttgagcaccttatatattatatataagcaccttttattgaatttggtcctgagaatgcagcatatgcataatcccttccctagaggaactcacaaaatgaaagaaaaaactggcaagtaaataatattctatatgataaatgctacggtagtgatatttttcagagaggtatttaagcatctaaagagtttcagaggaagatggggtttggcatgtcattatgttagatttgggcgatttgaagagtgcaataattattataagcacctggaacagtgccttcctgtggaagccattctataaacactgttgaattaattacatggtggcacttagaatgtaggttcagaggacagtaagaggatatagctaaaggtaaggcactttaagtggatcatggtgttgatatggtttttctgctttattgttgacctaagctttcagtcacttatatcctcatttgagaagtctctggatcttacatgaatatgaaaatgaaaaaataagactaagtagcttctcagataattaggatgaattcataacaacagttcccagaatcttccttaagaaagacacaactactttagaaaatgaacctacaacattaatgtaagaaagaaggaaaaaacaaaatctttataaaattctttttaaatattacaacactccttcaaatgattgtcaaatttcaggttggtatcgggtgctctaattttatttgtaatgaaatagaacctttttatttatcagtcagtaattattaattgtacaaacatctattgaaaacatactatgtgatgacttctttactaggatctagagataaaaagacaaataaattggcttttgccttcacttagcatattccaactgattgaaaagagaaataaataagacaattcagtatatcacagttagagttaagtcagaggtgtgcatggatttttgagaacagaaaagaggatctaaactagactgggaaacaaaagggaaggctttttgaaagaaatggtgtgcttaaatggggtgattttaaaggacaaagacagactagcatggcataattactaggtagaagaatcctctaaccaagtacatccaggtatccaatatatctgttagattctctctctctcttttttttttttccaaaaatctgtgctcttcatggccttagtgataaccaggaggtaccacctatggagaagacttatctttactgcctttgaaaaagcataattctaccatgaagtgtcattgatgggcttaaattatcaaaagagaggtctgcagatgggtttcatggagagcagtggcttcagttgtcaagagtcccaggatataccatcctgtctgtcaccaagatgctgaaaatatatcactgttacttccatttgctgaaaatgaaagtagcactctttaccaaagtttaggtgaacatactgattaatattttagccataagatttataaagtaacatccccatataaatattataggagtgtttatcctgtgaaaaagatgagatcaaggaactggatttattaagccacataacgattttttcttttgttcaaattcgccatgtgaaacaagatttaacgtaatgcagtgtaggatcagcatagtgccttgagatggactccaaatatttctaataagaaatttaaaagaagtggcatattatggaactagtatttcttttcaagattatcaaatgtaatgatgtttttcacctttactatatttaagatgtttctgtaaactttgagtgattaaaagactagcatttttctccttatcttcatacaaacctgagacacaatgacttgttatgcattagctatggccaacaatagcttagtaatattttagttttctgttactgtcagataatttttataattttttatatacctaaagcttttcactcaagcattacacatttctctgtctttataaacagagtattttaatcccaaataatcactatgaaaaagcattattttaatgtgctttaagactatgataccatgagagattactgaaatgtatataaccgttttctcctacactcaatgaactttgagttctgttatctgattttcatagttgttctctttttttttgcattcagactgtttgcccttactttttataattcctattgctacctcccctttcaacatttccatctgtaatatgctatttcaaatgcaatttatttcagcaaatatgcattgaggttatacaatgtgttagtcacattgtatatgtgtatatgctagggattcagagataaatgaaacatggtcttagccttcaaagagttgtcaggtgagaaagaagtagagatataaacaagtaattacaatttgtgtgtgctaattgcaattattaggattttattctccggaaaatgtggcttgtgttcctggattttggcaaggtaggatgggccaggacaggacttaaaagggctcagcatcaatggataatggaagaatttaaagcagagagttttgaagtaaatcttaaaggtgcatgggagtgaatttcctgtggagaaagatatgtgctataaaatttaacaaatattttgtaaaaaatgtgtctaaaataagaacaaattactcacagttagactgaagatactatcccagttatgagctttggatagttacttcgtggcatcagttttgaccatttggggttttattttgctaacattatgttttatagtaggtacaaaatagtttggcatgcttagtaagtgatatctcatgagtgaaatgttgatgcatttactatgagaatttgtaataagagactgcattttattatagtacatcaggttttattgacactacctttccactatcagtattttctaatgagaaaataattcaaaaatagtattagacatacaggaagcctctgagttaatgtggggtcatgtttctaaatatactttctatatgagacaatttgtgtttatgatggaattgcatgtctgtaccttataatcatgcatagaaaatatgtccttaggcattaaataatcaacctacaagaaatttctggtggcaaacatatgtgttaccttttcatatttaaaataccattcttagcataatgcacagtacaaaaatatatattggccattttattattattatcatttaaaatgatatgctaccagacttattttggaaccctgctgaaattcctacatgtacagaaaaaaaatttagtgatatactgaagttaactaatgtcagtaaagcgaaaaactaatgaaactcactgtaatatattcagtctttgaactatctgaatttcaatttaacctcaagattagactttgtatgtgtctccccattcccttgcataatattcacgcaacacactccaaacacatatcttttatttcatgtagcaattttcaaagagatggatgggggaactgcacatcagtttctccagacagtatataggtacagtttgaaaaagtcagtcctcaaaatttttctttctactctacattcctctcactgggctccaacccaccctgcaccttctctctcacacatgaatacaagaaaaatcattactacaaaatttgaagatgatctggacctggacgtttttcagagcaccacttgctaatcagcttttgtggctgttttaaaattccaatgctatacccttgaaatacctaacttctaacagtataacttcttgatgaacttcccaggataaattagtggcaaaatgtgaccctagggattatgtatgtgtaggagcatataaagtctacacatagatactagtaaagtatggcaaaaagcataatttttcacttttacagcagttatatcttaaaggattctttctttgcactaggtacagtttagaacaattgtttattggaacgaatgataatatggttttttacatcttttcattcatatctgttcatgtcaaagatcatttctatgcaccctgaaactcaaggtgcagtaagctaaacttaagaaaactgaaatcctgtaataaatttatatctcttgggatataattgcttcctatccaataacaaagacccaagagaaagaagcaaaagtcatatttttttctaatatactgataaagagaatagcaaccatgaccaaatagaaatcatcaccaaagcctattcacatctcatacaagatcttgacattttaacttggatttataagcctagatttagatatacctacatcaatgatttatcaaaacaaaactttgaatgtctcgaagctgaattacttgcctatggaataaatgggctacactgatactttcacacagtgtttagaggggtcctacggtgcatcagtgtctgcccctagaggtaaggggaaggctgactactttgagttctaggcaagtagcctaggcatttcatccccttgtttcttccaaaacaaatctagttgtctttgttagtgacatggttgttttccacatagatttattttaaaaaagaacccactactaatctcatttgaaaatcactgagtccatccagtgggaccatgccacaagagcaaacactgtaaacaaattagcaagaatctgattctttcgggaagaccagactttgatgaaggcagcccagtgtgcgtttgctttatgatcaaacattctatatgtgtacataggactatatcagtatcaggttctgagatgggtcaataagacaggaatagttagtttgggtttgtttctacttttgccatagaaacgtggggagggggaatcaaagtagctaagcaatacaccccaaatttgaaactgtcctattttaatagagaagatcctaagactgctggaaaagggtctgacagaaccagtttcagagtgcctcgtcatgtttcgctgtggcagaaagcactctgagcagagtgacgttctaaaatactatgcactaaagagaagggtttgatgcaaacttttgacctaggcccttggtgtaaatggagggatttcccttaatcatttcagcctgagaaagttaagtaagtgttacccaaaagggttttttccccattttgagcattcaaaagtcttgggacatgagcactgcattgactgtctggtatagaagcctgttgcaaacttgatcagcccctgcccaggtacaatggaagggatcccacactgggagtacctgggtgtgagctctgccactgctttatactaattgtgaggccttagtacatcatttagcccctctacaactcagtttccccgtctatgaaattatggtgataatttctatctacctcacagggatgtttgtcaaaagtcaatgagattagaaacatgaaagttaaatgtaagtagaacaacactatatatattatcacttattaaaatgaaccaggttgggcgcagtggctcacacatgtaatcccaaaactttgggagactgaggtgggtggatcatttgaggtcaggagttcaagactggcctgaccaacatgctgaaaccctgtctctaccaaaaatacaaaaaaaaaaattttgccaggcatggtggcatatgactgtagtcccagatacttggaggctgaggcaggagaattgcctgaacccaggaggcagaggttgcagtgagccaacatcccgccactgcactccagcctgggtgacagagcaagactctgtctcaaaaaataataatgataaaataaaaaaatataataaaccagagcattcttaaacacaagcaatgaaggtatctgttctacatcctgctatttcaagtcccctttctgaccttctttttgctgctcccctcactaccagttgaggagtttatagagtcaaggggatagatccagcaggagcctgtgcccctcttctagatcattccccaggtgtccagaccccataattccctgctcaaactcccctgaccccattttctgggccaatggatcacttgtccccattacattctccaagggggaacccccccaccacagatgtaactccatacatccaagggtggccaagggaatagctgtttgtgggggtgtcgatggagtgtggacatgtacagcatgtcacgtgcatgtgggcaagaacccccatgggcagaaaagagctaaaagtggaaagaaaaggatatcatgcagctacaattcaaaaatgtattttactttaaaatttgatagtttgacttaaatatttagaaacgtggcatgccagcttccatttgtactttcaccctgtgctacacaaatattaactgtttcacatttgccatcattgatcattctgtgcaattataatttattcccacaatttttttctaattttaggactaattgttgttgaatattttaccctagagaggaaaataaacttttgtctgagcaaaatcccaaccatttcttcatgattatgccacctgctttgtttttgcttataccacagccatctaaccaatttgtagatatcctatcttttataccaggacagtgttgcctgatgggcacaatcctcttctcacatcagtttggaaaataaaaacattataatctctttttttcctttggtatccaaagataagccctttaaaaaagttgaatgtaaaaggatgataaggagattacatagtttaagctttatactcaaaatcattttatattgaatctctgtaatgattttgtgtaatatctttaaatagcatagaatactatttatcagcggtagaaccaatttaaattactttcagccctgatgagaaatgggaagagactgaagtacactacacattggcatttgtacagttggcagctgggcaaatagcagcaacatccacctacttatattaattatctaggttattacagtagagattaaacagagcaggtaagtcaggtaattagcttctttataaaaattgagactaccccttttattcttcactgcttccctaaatcaggaagcactttatgtattacaagcatctaaagaaagtggaaaaatctactgtaaacattttatgttttaaaaaaattattttaatttttcatctttgatttaaaagattgtatcaaaactttaaatatcttcccatctcagtgcaaaataatgcaaaaaagacaattattgccatggcctacatttgtacagggcctttttcttccagtattttccttttatatctattttctcatgtttgcatcatgacaatcttacatgttaaaaaatgtaacacaaacatcttacaatcactttttttcacaagacattatttttcttttattcatcatttattgacaattgaaacattccaaatgattctaatgaatgtagacagatctttccttgtcctaatccctaagctgtcctttaaacaagagccagacatacatgaaacaagccattgactttcgattgaaaataaccttagacattctaatcttttattaagcactgtccccaggggttgtaaactcaaatgccttcaaggagtgacagttaacaaaacttatgatgcgcaccataaatcaaacttgatgtgtgatcatacttcacatttgcttggttagttacattgattttcaaactctctgggtagtatgttcctctcagagcaccaactagtgaccccgccctctctagttccctcttttcttcttcacctccttcttcaaccctgctttttttttcagactcatgacttttggctttatcttcttttcttgacccccacattgctcctttgactcatggcatatatggcgtcttctgttttgaagctttggctctatctttcagacagtttgcaagtgccctctggctacatcctgtcattgctgctaggtgttatactctgaagtataaagtcaaaacaaattatatctaccttaactctgggcacttctggtgggtctgccctgtgcctcaggttcctgtccactaatactcgtgagcgtgagataagatcatcattctagttaaaaatccatcactactataagtattcaagttcatttttggttaattatattgaagtgccagtccatgtttgagtgctgtatttttatgtatagctgtcaggtacaatgctgtgcagtctctggaattaatctattattttctttaaaataaataaaaataatgggcactaaatttgtgtttcagacttcaaaccctccttctgtaatcaatgattagtgtgaatgtataagcactcattaacatttcattccctgttttgatttaaattttaactctcccattatgaataataaacagagtgtctgatcacatttgaccttttgaggcataacggtgctttttttttttatttctttaaatatcataaggcccaataggtcacttccctgttaacttttcttacataagaaatttaattattttaagagaaaaatccaaataatatctcagtaatcttttaagaaataaatatattttctttattgccaacagaacatctaaaaagtggacattaaaaaaatgagtttgaaatttgtttgatttttcaactgtacattaagtatatctgctatataatgaaagcttttttcctccccaaagattctcaaaaaatgtgttccagaaatacagataaataagtaaatggatggaagaggggggtatatttctatcaatttatcattatgtttattatttcacataagacttatcaaagatattctttggttatctttgataagtcttgattataagccaattatgaccaaccaaaaatggtcctatatatgtaaagtataactaacaaagtcaaataaatttataattaattcatcagctccttaaaacatctcacaaataacgtgaacctgtcatatattgcgtgtgtgtgtctgtgtgtgcatttctcccttacatctcaaaggtaataaattggttacaaaaagaaatgaagagaaatgaagtctggagtaacttgccaaagaccttgacttaaataactaaaattatatccacattatctaacagttttttttaatagatagactatcacataaaatcatttataacataatagtaacttgtgagtagtagttaaaagtacatgatactttgatagtgcattttctataagtgtttaataagaaaaggtatctggttcttgtaattatattgatagctaagatttattaaacacctactgcatattaaacactcttctaagtgcttatcatgtaggattttgtataattttcacagccatagtctgaaataagtactattgtggaaaggaaactaagagaagttgagtaacttacctgaggtcacacaccaaatgagtcaaggtactgcaggcaagattggcagtggatcccgagctcacacatctaaccactttgctctactatctcttaagagcagtgaaagatttaggagagaaaggggaaaatggcctgtttctctaactttatattatgcattatttacttactaagcttctgttttatttttgatcatagaatatatatgttattttttcaaggttaaattgcaaagtaaaagcattatagtgtaaggaataataatggcttatactttccactccaaagaatttcctaagcagaggttggaaacaattttcacgcgtcactgaaagatagcttccttcaactggataatgttaatgtttattggcacttaatagccttagacaggacagtattttgaaattcaagagtaatttgaggtaaccagaatatgaatacacccgggaagagttgtcatatttcaaaataaagcattcagtatgttgcacaaaacagttcatctgtattgattgccactaatgctagaacagttagatagaccaatggaactttcacacttgtggcatgaaaatagttcttgaagacctgtaactttgaacaaactaatcctctatgttcattatccatttaatgtggagaaatgttttgggtaaattattgttgaaagatttaaaattcttaaatgtatgctaaatggaaatgtgaaaaaatttattagcttcaagaaccaaattaggcctcaaagcaatgatctttctaaaaattctagatcatcctgcataagaagaagatagagtagcatagcttagataatttaatgtgcataaagaagaaagtcctgtgtctttattgatgacactgaaatttgaatgacaaagacatggcaatctggctttacccattttccgtggcttctgctcacacataaatggctgtaacctccacccccttgttatggttacaaattatgggattgtgtaacataatacaatgataacttaagtttagctttttactttgaaaataaaaacaccttcctgtgtccatgtgttctcattgttcaattcccacctatgaatgagaacattgtgcacatataccctaaaacttaaaatataataataatgaaattaaaaaaaaaagatattacaaaaaaaaaaaaaagaaagaaaataaaaacacctgagagtttccgcaagatggctgaataggaacagccccggtctacagctcctagtgtgagcgatgcagaagacgggtgatttctgcatttccatctgaggtaccgggttcatctcactagggagtgccagacagtgggagcaggacagtgggtgcagcgctccatgcacgagccgaagcaggacgaggcattgcctcactcgggaagcgcaaggggtcagggaattccctttcctggtcaaggaaaggggtgacagatggcagctggaaaatcgggtcactcccacccaaatactgcgctttccctacgggcttaggaaatggcccaccaggagattatatcccgcacctggctcggagggtcctatgcccacggaggctcgctgattgctaacacagcagtctgagatcaaactgcaaggtggcagtgaggctgggggaggggcgcccgccattgcccaggctcccttaggtaaacaaagcagctgggaagctcgaactgggtggagcccaccacagctcaaggaggcctgcctgcctctgtaggctccacctctgggggcagggcacacacaaacaaaaagacagcagtaacctctgcagacttaaatgtccctatctgacagctttgaagagagcagtggttctcccagcacgcagctggagatctgagaacgggcagactgcctcctcaagtgggtccctgacccctgacccccgagcagcctaactgggaggcaccccccagtaggggcagactgacacctcgcacggccgggcactcctctgagacaaaacttccagaggaaccatcagacagcagcattcgcagttcatgaaaatccgcggttctgcagacaccgctgctgatacccaggcaaacagggtctggagtggacctctagcaaactccaacagacctgcaacagagggtcctgtctgttagaaggaaaactaacaaacagaaaggacatccacaccaaaaacccatctgtacatcaccagcatcaaagaccaaaagtagataaaaccacaaagatggggaaaaaacaaagcagaaaaactagaaactgtaaaaagcagagcgcctctcctcctccaaaggaatgcagttcctcaccagcaacggaacaaagctggatggagaatgactttgacgagttgagagaaggcttcagacgatcaaactactccgagctacaggaggaaattcaaaccaaaggcaaagaagttgaaaacttggaaaaaatttagacgaatggataactagactaaccaatacagagaagtgcttaaaggagctgatggagccgaaagccaaggctcgagaactgcatgaagaatgtagaagcctcaggagccgacgcgatcaactggaagaaagggtatcagtgatggaagatgaaatgaatgaaatgaagcaagaagggaagtttagagaaaaaagaataaaaagaaatgaacaaagcctccaagaaatatgggagtatgtgaaaagaccaaatctgcatctgattggtgtacctgaaagtgactgggagaatggaaccaagttggaaaacactctgcaggatattatccaggacaacttccccaatctagcaaggcaggccaacattcagattcaggaaatacagagaatgccacaaagctactcctcgagaagagcaactccaagacacataattatcagattcaccaaagttgaactgaaggaaaaaatgttaagggcagccagagagaaaggtccggttacccacaaagggaagcccatcagactaacagcagatctctcagcagaaactctacaagccaaaagagagtgggggccaatattcaacattcttaaagaaaagaattttcaaaccagaatttcatatccagccaaactaagcttcataagtgaaggataaataaaatactttacagacaagcaagtgctgagagattttgtcaccaacaggcctgccctaaaagagctcctgaaggaagcactaaacatggaaaggaacaatcagtaccagccgctgcaaaatcatgccaaaatgtaaagaccatcgagactaggaagaaactgcatcaactaacaagcaaaataaccagctaacatcataatgacaggatcaaattcacacataacaatattaactttaaatgtaaacggactgaatcctccaattaaaagacacagactggcaaattggataaagagtcaagacccatcagtgtgctgtattcaggaaacccatcacacatgcagagacacacataggctcaaaataaaaggatggaggaagatctaccaagcaaatggaaaataaaaaaagtcagggattgcaatcctagtctctgataaaacagactttaaaccaacaaaaatcaaaagagacaaagaaggccattgcataatggtaaagggatcaattcaacaggaagagctaactatcctaaatatataggcacccaatacaggagcacccagattcgtaaagcaagtccttagtgacctacaaagagacttagactcccacccaataataatgggaggctttaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaactgaccacatacttggaagtaaagcactcctcagcaaatgtaaaagaacagaaattataacaaactgtctctcagaccacagtgcaatcaaactagaactcaggattaagaaactcactcaaaaccgctcaactacatggaaactgacagcctgctcctgaatgactactgggtacataacaaaatgaaggcagaaataaagatgttcttggaaaccaacgagaacaaagacacaacataccagaatctctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagccagaagaaggcaagaaataactaaaatcagagcagaactgaaggaaatagagaccaaaaaaacctttcaaaaaattaatgaatccaggagctggttttttgaaaggatcaacaaaattgatagaccgctagcaagactaataaagaaaaaaagagagaagaatcaaatagatgcaataaaaaatgataaaggggatatcactgccaatcccacaggaatacaaactaccatcagagaatactataaacacctctacacgaataaactagaaaatctagaagaaatggataaattccttgacacatacactctcccaagactaaaccaggaagaagttgaatctctgaatagaccagtaacagaatctgaaattgtggcaataatcaatagcttaccaaccaaaaagagtccaggaccagatggattcacagccgaattctaccagaggtacaaggaggaactggtaccattccttctgaagctattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaagactggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctgtgacaaaccccacagccaatatcatactgaatgggcaaaaactggaagcattccctttgaaaactggcacaagacagggatgccctctctcgccactcctattcaacatagtgttggaagttctggccagggcaattaggcaggagaaggaaatataaggtattcaattaggaaaagaggaagtccaattgtccctgtttgcagatgacatgattgtatatctagaaaaccccattgtctcagcccaaaatctccttaagctgataagcaacttcagcaaagtctcaggatacaaaatcagtgtacaaaaatcacaagcattcttatacaccaataacagacaaacagagcgaaatcatgagtgaactcccattcacaattgcttcaaagagaataaaatacctaggaatccaacttacaagggacgtgaaggacctcttcaagaagaactacaaaccactgctcaaggaaataaaagaggataccaagaaatggaagaacattccatactcatgggtaggaagaatcaatatcgtgaaaatgaccatactacccaaagtaatttagagattcaatgccatcctcatcaagctaccaatgactttcttcacagaattggaaaaaaactactttaaagttcatgtggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcataagtaataccacacatctacaactatctgatctttgacaaacctgacaaaaacaaccaatggggaaaggattccctatttaataagtggtgctgggaaaactggctagccatatgtagaaagctgaaactggatcccttccttacgtcttatacaaaaattaattcaagttggattaaagacttacatgttagacctaaaaccataaaaaccctagaagaaaacctaggcattaccattcaggacataggcatgggcaaggacttcatgtctaaaacaccaaaagcaatggcaacaaaagccaaaattgacgaatgggatctcattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaataacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactggaaataccatttgacccagccatcccattactgggtatatacccaaaggactataaatcatgctgctataaagacacatgcacatgtatgtttattgtggcactattcacaatagcaaagacttggaaccaagccaaatgtccaacaatgatagactggattaagaaaatgtgggacatatacaccatggaatactatgcagccataaaaaatgatgagttcatgtcctttgtagggacatggatgaaattggaaatcatcattctcagtaaactattgcaaagacaaaaaaccaaacaccatatgttctcactcatagatgggaattgcacaatgagaacacatggacacaggaaggggaacatcacactctggggactgttgtggggttgggggaggggggagggatagcattaggagatatacctaatgctaactgatgagttaatgggtggagcacaccagcatggcacatgtatacatatgtaactaacctgcacattgtgcacatgtaccctaaaacttaaagtataataataataaaaaaaaaagaaagaaaagaaaaacacccgtatctgtttcagaagaaaaaaaaaccctaggttaaaaactgagggaaatatgattcaatatatctttcccattaatagggaaaatttaaattgctaacatttttaaggtcatacatttctaacctttttaagatgttacctttggggggaaaaaaagctctctatttgccattctcatcagcatagcctctctccctgggcttctccttggcatttgaattgtccaccatttccacctataggcctgcttctaaactataaccctgctcagatctcaagttacatcacaagagtctgtgttctggaagaataatgcactgaattttaatcatgataattcaggcttagtatctttaaatacaacatagcagatgcaaggttaaatggcagtttcagtctttgactggaattcgccttaagataagaaaagcaagttttagaacatgatcctatgagcctaggaagacagacttagccaaaatattcctatactctgcttactgtaaatgcatgtgattttggttctttcttgaaattggtgttctggtatttgcttaagagattctgagtcgtaaagtgaggagttattttaggagaaaatttttattttgtttagctaaacaattgacagcattactgcccttttcctaactactgaaacttggcaattagcattccagtgttttatgatttataaataatagttttgttacagttctcttcattaaatatgccaagatacatgtttttgtacttatgaatttttgtgtagggaaaatcatttattttatttaaaagtataagctatccacaatctctctgtgtttcaggaggttacaacacataggattgtcccatattattataaaaccaacacaattgtggtgtattaactgttaaagtaaaaattactcaatgacactttttaaagcatgataaggacgactttattcaggaacattgcaaaaggtatagggaccactgcaatgggattttgcagtagaggagagacataaggtaaggttattttcaattgaaattctatggcttgtttatcctatagcattaagagaaaaggaagatataaaattatatatggaattatagttatctatacacacctattcatacacactccagaataaaataaattcaaatgttattagttatctttggataatagcatattagattattgtttttgtctttctgacttttctgtattttccaaatttgtagtagtaaatgtaatgtttagttagatttttggaggatgttttctttatccagaatcagaaattctgaatttcagtattttaaatgaaatccttgtgttctgcttttgaagattacattattaatcacttaaaagatcttagtttgaagagaaaaatcagaatatgcttaattgacataatatattgatgctgaaggactgtgttttcttcatgttgaaaaagtgttctttttgttaccattgactacaaatgcttgagtctcagtatttctatgagataattttgttttgagtttcttttggggtgaaacaaagagaatgctaaattaatgagtttgactcaggtgttctcaaggccagttcattgacaggtgggcaagaaggcatttatagccaagaagcagagtggggctcaatggatgactaagaaacatcgagggtacaggggatgctggctaaaccagccttacaggattcttgccacaaacaggccagggtgatcagatatcacgtggggagtggtagaggatgaggaacacagtatctattgtatagggggagggttcttgctaaactgacttagcacagttcttcccaaaattggattttacatgaagtacacaaatggggctctgtgaagactcgggaccatgactaaagtttggtcaagcaaaactctttatcataacatatttagaaatagatttaaaatctgtaggatatgatatgaaataggtgagtgggggtggtaaaaggctctcttgttcaaggggtaaataaccattgctgaaaatggcaaatctgtgggagtatcttccatattagtccaggctatttgcaaacagaataacaaataacagtttatggcttgataaaaaggaaaaaaaggcaaaatgcctctcctggcttatgactataaggactctgcccaaataatccaatctcattcacacactttatcatgtaaagaagaaaagttagaaattgttaagtactggtgtctgtaccaagtagtgagtgaatgctttgtatccctgttctgaggacaatctcaaaaccttaccgatttttactcccttgctttcactagcttgttctttgatcttgggacttgtcttatcaaaatcatgtgctgttacctgtctcttcccttctagctcagacgtcacatcctcaaagaggtgttccttgactcctggaactgagccaggttcattgccaactctttgaatttccccaaagtagatctcctctcattttaacgtcacaactaaaacaagtgttactatttttaactcttggtaatttccataggagtagagatcagatctatcttgttcaccatcatagtttaatgtctgacctatagtaggtgctcactaaatgacaccagtagttagttagcaatggtgatattagcagtccaaactctgcctggataatctcatctcccttcatggatttagattatcacctatatattaggcacttccaattctctgcttcccatcaacttttctctaccaagttttagacacttatatccatgtgataagggagcagactctagaaccagactacttgggtttctattcttgactctgcccctatttccattcattacattctgtatacaaattctattcagagaagtcaaatcactttgaacaaattgtccttaatttctgtatgttctcagcctccttttctctaaaacacaggggagagaggctgtgagatacagtgtctgacataagttagtgttcaataaatgctagctcttgccattagtaccaccactactactgctgctgctgctgttgcagatgcagttattattctattattattattctcagctatttcaccctatttctaatagaaactatctaaaaatgaactctctgtctctccattgccaaaactatctctacgtctcgtattctctttcttagttcaccgaattcatcttatcaccatccacccaattacctagcagatgcctttgagtcacactcaccttctctcctgcccccagcttccactctgtaccatccagtgaatccctaaaccctgctcatgaggtcttatcaatatctcatacgtatctccttctctctatccccatggctctttttcaggtcccatcaccactagcttctttaccagtcttactgctttcagtctcctacctctgcagtccaactgttccctcagcaaatgttcatcagctactatgtgccagatattgcttacaggcttaagatatagaagtaaacagacgaatagaaaaaaaaaaatccccaccttcatggaacttgcatttcagtggtaaattatataacattaaaagtcagcaagtcccataaaaaaatacaaggtagaaagttgtggattggggtgggatgtttgcaattttaaaacggacagttaggacagatctttttgataaagtggcatatgactgaaaatgaagaaagtatggggatgagccttggagatatccgggagaagtgtgtttcagaaagagagctcacctagtgaggtgggaggacacctagttgctgaagaaatagtaaaaaggccagtgcattttgagtagaggccaaggaaggaaagaggtagaggatgaggtaagagtggcaattatgggccagatacatgaagctctggaggccactataaggatactggttttactctgagtgaaacagaagctattgtagcaatttgagcacagaagagacatgatctgactgctgcactgaaaaccgcctgaaagtgggaaagatagaagctgggagaacagttaggaggctactatggaaatccagatgatagatgctgttatcttggacatgagtgttaccagtggagacagtgagaagtgttcagagtctggatatatttgaaaattgatagctgatggattggaagtggaatctgagagagagaggtttataaaataagacaaaaataaaggatgtctctcaaatgtttggcctttgcaccagaaagatggagtaccatcagtagatatggaaaattgcagaaatcctaggttgcaatgggggtggaagggaaattattggtagttcagtttggggcatattaagtttgagatgtctattggacatcccagtgggagatcttagccagtttattttataagcctggagttctggggagaggtcctggctagaaatataaatgtaggagttgtcagcagaagagaagaaggctgaaggctgagctttaaggcattcacatgttaagaggtgagatcaaaaggcagtacaaacaaagaacaccaaaaagtaacagccagggaagcagaaggaaaacagtggtatagcacccagagggcacttgaagaaagaaattcaaggaaggattgatttaacaaataagatttagaattgaccactggattcataatgaggagagaagtttggggagaatagtgaggataaaaatagtgaggataaaaatccaattagtctgattaaaatgagtttaggagaattgtagaagagaaaatggaactaataagtacagacagctttttcaagtatttctgttataaaagaataaagaaatggggtggtaattgaaaggagaactggaatcaaagctaagttttaagattataaaagtatattatgtatgaattctaatggaaatgatctagtagagaggcaaagacggatataggagaaaaataatcagccaaggagaaaagtccttcagaatgacatgaggaattgtcccttgatgggaggactgacactttctccattataaaatgagggaagaagagccacctatgcaggtgcaactgggttggatggcaggaagataaagtagttcacatctgatagtttctgtttatcagtggaatataaagtgagatcaacagctgagaatgaggggatagaggcagtctcacaagtttgattatgaaattgctgtctcagaaaataaaaacaaggctactagaaaaacagtatttttttttctttctctgtgaggttacagtgtaaatctccaaatctgatagaaagatgaggcactcatcttcaggtgtttaccacctgtacacctgaacattttcttctacttgttcctgttatagcctcactgctacttgatgcttgctagaattaattaacaatgctatattcttggtatctaaaaggcattttatatatgttatataactggatctttataataaccttgaaaggtagagtattttgtccttatttttcaaaaggtaaaaccattttggagaggtcggataacttgcccaaaagcataagagtaataattcgcaatatctggatttcaaccctgatctgtgtgattcaaagtgttatttctatgctttgtaaatatacctctacatagaaagacattatatttcttcctttaaggatgaaaggcaagtacaaaatatttgcatctatggatgtctagcataatgcctggaaaagagtggccctcttataagtacttgtcaaaagacagaatgttttttatttaaccatcacaataacattatactgtccatttacacagatgagaactaaggctaaataactcactcatgatcttatagcaagttagaataagtgaccaatttgtaacactaactcagatcatctaactcctaagttctcattacttgttacaggcaaaattgtgtccctacaaaattcgtatattgaagtcctgagccttagtacttcagaatatgactgtatttaaagacggggtttttaaagaggtaattaagtgaaagtgaggtccataggatgacccttaaaaaagatgactgttgtccttacatgaagatgaaattagtacacaaacacacgcagagagaagacgacgtgaagacaatggggaggaggtgaccatctaccaaggaaggagagaggtttcaggagaaaccaaccctgctgacaccttgatctcagtcttctagcctccaaaactgtaagaaagttaatttctgtggtttaagccacccagtctgtggtactttgttatggcagtcctaacaaactaatacaacatctctcccactattgtagaaacaaagcatttcacttcttccatgggtgtcaatatgttgaattactaactcaatatgttgaactatatggccttctgagaaataattcagttgtgccaaagtccccagcaatcataatcacttaataaatagttttggataaataaatcattaacaaataaatttgcataacaaagataagcctctaattgctccagatcagacttccttgaactggagaaatgagtgactctgcccatcaatgaactgaccttgagaacacctgagtcaaattcattaatttagcattttctctttgttccatcccaaaagaaactcaaaaaaaaattaccctatgtaaatactgagactcaagcattggtaacaaaaagggcactttacaaacatgaagaaaacatagtcttttggcatcattacattatgtcagtgaaggatattctgatttttctcttcaaactaagatattttaaatgattaataatgtaatcttcaaagcagaacacttggatttcatttaaaatattcaaattcagaattcctgattctggataaagaaagcatcctccaaaaatctaactaaacattacatttactactacaaatttggaaaatacagaaaagtcagagagacaaaaacaatcatctaatatcctatcacccaaagataactaataacatttgaatttattttattctggaatgtgtattaataggagtgtatacataactataattccatgtataattttatatcttccttttaatgctataggataaacttatttgcaaatcttttaaaatctgtatacaatttgcacagtagctacaccaaactttatgtaaacattctttttttggctttgataaaaataattgatctcatcacatgatcctatatgtgaaacaaccttgtgggggtacatacatataaaatatgctttcttcaaacaaatgctaggctataaaaaacgcacaataagataacttctgaggcaggtgtggaggaaggggcttctgagaagaagtactgtcactctctactgcatgtacttctgtgttatttaaggagcattcattatttttgtaatttaaataatttaaaataacactgcagtgaacatatttgtgtataaaactcttcctaaatttcaaattatggtcttggtataaattcccagaaatgtattattaaatcagagggtctgaacattttgaagccttttgataaaaactggcaaattgctttcctaatgagttgtcatgagtatattcttgaggaaaatagtaaacaattgaaccagaaagaaatatttctcatcacaaatttaaatgagcttggctcaccacagttcaattctaaatacatacccttaccccttttcactattttctctcactgagaaagctgaactagataatcatttcaatataatgtacatatacatagtgcattatactggaatgattatctggtttgaactttgaactagataatcattccaatataatgaaatgaaaggcttattttatatataatatgttgttttatatataatatgttataacatttttatgtaatattataacactttatgttatgtagctttatatataatagtttattttatatatattataacatacataatatatataaataagtctttcattttaatatcactaaaaaagcatacttataaaatattatatatgtatttagtctgcttgacttttaataaacacttgaaagtctttttctgattataaaaaactgtgcaatagcttttaatatcaggttattttattgatttaaaatgtgaaatacaaatagatgtcatctttgttacaaaatatctatttccatagttaatttgattactttaaaattctaaaataaacttaatgatgatctttggatgtttcaaatgatagattgattagaacaaattttattcagagcatgaaataattaggttggtttcctattttcttgaaagataattatcagattattcaaagcgttttatggatgtgttatttttgctttaatgtggtcaataggtctagacacagaagttaaaaaacagcacaaaaagttcaaatagttggttgtattttaagcataaaaccaaggagagtagcaaggtatcatgaaaagtgtccagggttttgttatgggcagacctgagttcaaatctcaactttgctgtttattagctttgtgacctaaaagttattagaagttatttaactttgcttagttttagtatttttcatttatagaatagaagaggaaaacaactgcaatggcttttaacactgtaacttaattgatgcttaataaatggtagctatttttatcatgctgaagacaagaaagatgtgtgctatttcacattttttaaatagaaaataaattatagtatctattacctgaattctatagctatgctcacatactagagactattttatttccatctgcacataagaatttacatatatatagatattttctcattttcattctctgagatctgacatataattttatatactaatttcaaatataagtatatttaaatataaagtttttaagtaacatgtaaacagtgtgtgtgtgtatgtatgtgtgattataatagtcctaaccatattcattcattcaacaaatattcattgaacacttttacatatgctcagtattgttctaggaatcatggaaatcaagaagtcaaaaaagtcaaaaaaagtgacaacaattcttacctacatagaacatgtattcaaatgcggggcggggaagcagtgaaaaggcaaataagtaaaaaatatagcacatattaaaaagtgatagctgctaaggagaaaaatggtcaagaaagtgagataaaaattgggggggttgcaaatttagaatagagtttagaaaagaaggccttactgatatgccatttgaataataacctgaagaaagtgaggaagccagccacatggatatgaagtaaaagctttccaggcagagcaaacagcaagtgcaaaagtactgaggtggggacatgcctggaaaagccctataaatgccctcatgggggtattatgaggattaaatgaatttagcacatgtaaaacaccaagaatgtatctgctacatagaaagagctccataaattttagttattatttgcagttcttagcattagtcattttatttaaaaatcattaagtaatatttttatatttgtttcaaaattttcagtttctatccaggtatttggaattatgtatacttagcctcatatcatttaggccattgtgtaaataatttctagttttaatcatatgtaatataatgacatattctaaggtaagacaggttctatccctcctttcctactacatttaaagttcttgatttctcctgtatctagcacagtaatgacgtacactttatacatgtttataaagttttcttcattgactgaaggaatgaacatgctattttttggtaactacttacagtttttgcagattgtcctcattcactacacgacagtttaactgtgttttctcatgcagattataagttggaaagctctcattagctcattcattaatttttatgattgcctacaagtatcattatttagtgcaatataaatatggtgaaaagatgctattcatgtagggagagctgttataaatcaggaagcttgttagtgattgccagttgaactaagatctgctatgttttactacatttcagaaaataaatccatctggccttgagttttactatttcttttatctatttgctaaaggttgattttgcattaacaagaaattataaaagtaaagacttgaatatgtctaacattttgaatcagcttatttatattagcttccagaagcaaagggtaatactcataaggtcaagactagtgttgcatttagaaactgtataagtcacagtattatctgggtgaagtacaatgaacatttgtttgacaactttgacatctgcttcgccgtactagaaactcttaatactggaatccgcaagcacaaatatacatctgtttgactcaaatgaatattagttgaagaataatgacctgaaaactagatatcccctgagggtagttttataaaattaccaagctgttttgttttctatttaaagtgtgtttgacatcagaaaagactacattttatatagcagaaatatgagaaattagtctaagtagtttttaggagaaaatatgcattcttaatgttactgttctgagcatggttgagtggtagcatgtaacttttctgtacctaaaatttcacagtaaaaaattgaagtgctgtggtaaattattattaatactgtattgttctatgaaacaaactaagagatttaattttcgccattagtcgaggaccacagtaatttcattgtgtgagaacacaataaaaccaccacagcaccagtaatttgggaccaaaaaatctgaaaaaatatatattatggaaataattatttactgtaaagcaaaacttcttaaataagtatgttgaggagaaaactactataaatcagactttaagagacaataagtcccagaggacccaagaaatataaatcaagacaggaaatgtgattgtaaaacaaagagcaaagaactgtaaatcaaggctggatattccctaagagagacacatgaagcactggaaggattttagtcaaaaggtaggagagtttgtaccatgacggaaaagaatagggctaaaatttaaatatcagatagggaagaaactgtttataagacgtgtggtttgaactcagtaatcactacacgtttctcatcttcatattcagcccattgtcctccgtctcaattgcactttcatttctgtgatcctgctctcccaaacactgctatggctcctccccacttaactctgccctattgcctggccatgtacccaaccaacctcctcactgtgtcttccgcaaagcccccagaacctactactttgttattatcaaggtctcatttagccttactgtttccattcagtaggtcttccacatcctcatgttgatttacagcttacttgctacgcatgacacctcttgctttggctactgtcatgtataggcctctgggtcttgcgatccatgtatgatgcagtttcaatcctctaccactgatgtctctttccattgcattgacttatcacttctgttttaacactttttgaaatccatgattttaaaatacaaacatcttgccacgcctcccagtccttatcactttacaaacattcctccatattctaaagttcatggttgtattatggaatcaaaatttttctttctcctcatccattttcttacagggcatcaacgtcgaccacccgtttaactgtcttcagagttacttcacttatcatatttgatgaacttgcttttcatttgacctcaggcactcacacacacatgacagtattgtgaatttataattacccggaaatgctcaccccgaagatcttaaactccatatatttgtatcaaagaaatgttcagaatggtggccggggcggtggctcacgcttgtaatcctagcactttgggaggccgagacgggcggattgcctgagctcaggagttcgagaccagcctgggcaacacagtgaaaccccgtctctactaaaatatgaaaattagcccggcatggtggcgggcgccattagtcccagctacctaggaggctgaggcaggagaactgcttgaacccgggaggcggaagtcgcagtgagccgagatcgagccactgcactccagcctgggcaacagactgagactccgtctcggaaaaaaaaaaaaaaaaatggttactgagcgccatggaagggcactggaggctggaaagactttgtcgtatttttcatagataagacttttagcctcaacctcgtgtattttttaattcatccagaatttacctaatactcatttattgtaggactgggctataatggcacaatcgaaatgcattaaatcaaattgtaagaagagtaatttatgttaagacgtgtagaaccaaaagactagaatgcctatgtctatttgtcagtgcacgtttcttctgtacacataaaataattactgcaagtttgctttagtaaacaccagaggaatcatcaaaaggaaatgaacaataatgaataccataagtgaattaggatagcttggtacacccatctcctgccatgctctatggtcaggatgatgcctgtgttagacggtgctgaaaaatcaccaacaccttgtcattgtttggctctattttctctatgtgtgtatattagtccttcaacagacagttactagagaaagggatcaaactagttgattaggagacagccagagagcatgggactagaagagtgtccactatgccattttcttagccatgtggcttctacaagtcacttagcctctctaagccgctcaacttcttaaatgtgaaaagacaatgctatcttcctcttattagctatgtgaccacttaatgagataatgtatttgaaaatgctctgtaatttgcaaaactttataaaatggatatatgcatatctgttttaacaaacatgccaagccaagcaacatactgagattccttggtaaaaccacactataacttcacaaagaacgtatttacacactgcttaagatggatttcttatatgtaaataaccataatcattccatattaaagcttatgaaattctatttccaaaggtaacatattccacatgtttttcccagctgatgaagtataacctaagatctatatactgaccatgttccacccttctacatcatccgttctttgcctcagctggctgatctttgtcatcttccacacttgaccttcttgatttcttccctttacttagctggcttctctctcaaactgtctgcttccacatcagctgtcagcatttcctcactttgcattcagtttcttccactgccgataatcaactgctcaatttaacacttttaaaacttatctctgcaaaaataagaataacctcctaattatctcactcaatactctctttccagcactcaggctataagacgttgctgcaggatttgatacttcttaaaacctctcctcccttggtgtttacaacaatgaagaaaactgagttgacattcacatagaaaaatgaaagaaactaaaatctttttttgtaattatactttgagttttagggtacatgtgcacaacctgcaggttagttacatatgtattgttttaaagcattagcgaaaactctcaaataattgccaaatttcaggtccacttttcacctcaaatttgaaactagaagtgcaatactctgccataaccactgtcacaattctcaataacttccaacatcctgctcaaatatcagtttgagcttttcctgcccttttaatcactccctcctctataatcccaaattttggcttgtaatacagcatatatcagacccagaattgtagtattttacgcgtattaatctacctttacaggcttctacagagtccatgcaaacatgcaattcgttccacattatagatattcaacaatggatttttgaagaaaaaactgatgtcataatgcattaacccactctatgttattttcctgaaacatgctattatgcaaaaaatactaaaattattgtaaaatcaaagacatgtatcttaagattattcaatggttttacaaatattaggcaattcaaatttggatatttgataaacactgggtttctggaatttagagacaaggattttaatgtgactgttttaatgaagcaacacaagtgctaatatttttatttatttcacaactgaattgaagtaaataattatttccatcagtaatgggaaataattcttttctgaaaagaagtagactagtttgtgggctcttagaatccttcacacactatggttgaagttgattggcttatcattccaattcttgtgaacaagtgacagagagtttgtgggctacacatcaagtttaagaactcaggttataatctagttccaaaaggcagacatagcagatgacggtcactttcacttgagactccaggaatttggtctatttagttcattttgtatatatgtgcttttgttggaagccaaggtggatttgttccatgccaaaaatcaattatcatccatattttaatttactgtccagaagaagatgcagtgccagatgctaccgaatattagtcactttcttatttcaaaatgaaagacaggggagggggaaagatgttggtcaaagaatacaaaatttcaaaatttcaattagataagtggaataagttcaggagacctattttataacaaggtgactatagttaataacaatacattatatctttaaaatttgctaaaagaatagatttgaaatattctcaccacagaaaagatatgtgagataatgcatatgataactggctcaatttagtcattccacaatgtgtgtatatatatatttcaaaacaatacgttgtacacgatacaattttgtccatttttttaaaaaagaaaaattttaacacctttcttctattttctatttttaaaattactggattctgcttatatttgatctatgcttactataaaagtttacgggatatttttggtaactgcactttcaaaactcttaattataactcttgtacatatgctgataagagtaattagtcaaatgttttcaggttcacttttcaactctgtcaaacacttttataagctatcatttggatcattttttctctcctccttcaaaaaattatagaaatcgctgtgaattccaaatgcgtgtctgttttattctgttaaatcagatacttatactgacaacctatcaatacactaaattagtacatgtagctaacaagcatgtacaagtttaactgctgtataacaacatttaacagatcaacaaacacaacagcttgtctctgcagggtttaataaaccatatttatccacagcatctgagaaaaacagaagagactctgatatatgttatgttctttttataagtacatgaaaataaatatgtaaaagtaaatgtggtttctatttctattcgtgagagtagaatgtactaactgaggtcataacttgaactgaggtttcattaagggggaaagcactttgtcttttatgttctaaaatagacttcttgataaagaaaaattatgcttaaagattaattaataactggctggcattataaagtgttgcaatgttaaattataataaatattgattttaggaataagttttgaatattttatttttacattttctctgtaaatttgtgttagtccatttaacttcaaaagtattcttcaccacattatttaaggatcacacttaataattttccactaaaagaatcctgtttaacagaagtaatatgatgtgataggttaaaagcaaatattttgatattaggcaagcctgggtttaagccccagttcttccacttgttaattaagtggccttgagataattcctctgtcttccttaggcttaattccctaacttgcaaattggtgaccatgacagtttctgttttcaatggctgttatgaaaattacatgagaaagtaggtaaagtgctaagtagggtgcccatcctataacgtcctataattagcttcaactcttacacctcctcaacatctgttgctgttataattgttatttattactattgtaacaccaatgaagaaatactgttattgcaaaaagcatttgagaaattgtgaagaaaattaccaattttttaaaaggcaagttgaggtgaaagaagaagaagctaaagcatttggaatgagttcagtaagtttggtgaagtaaagacaattgaacagatacaattagaccatgtcaaaattgttaacattaatgtaaccccaattaacctttttaaaaatataaatagccataaaagttaattaaggtatttactctctttaaggagggagaagtacaggtgaggacgtattaagacactgaaagggtagaaaggatacaggtgctgagcagttgttatgcaagaactatgctggatgtactttcctcagaacacttccataagatattaatatctatattttgcaaataaagaatctgaggttcaaaatagccaagtagtttgtccaaaggtcacatagctagctaattgaagaagctggaattaaaacccaggtttttctaagccaaaagccctttatagttctgtcttcagttgtgtgagattatgaatccaaaggtggaaccctgagtatgaaagggagagtcctgaaataggaaaagttaaagaactgaagaaggcttttatgttttactcagatttttctctttaaaattggttataagttatgacataaagtttaaaatattagatgatattccaactttctctgttttgatgttataaaaccttgtgaactgggactccaaaattattgacataagctgggaatttattctaaactgtgacatatttgctctaaactagacttctaaccaactgaaattcaatgacttctgaaatgtgggttctcattcaactagacaaaatgtgtcagccagaaatgtatgacacagtggaggccagaggtttttacagcagcaagtccctaaaaaaacaacaggatcaaatatgctatttttaaaaaattacccaaagatagtttaaggtctgtgctcttagtataattcccttttgtctcactttacattgggatactttcaaatctcctgctaagtggattgacattacaaatgactctaatacagagcaggtttttcctgaactttcctagacagtcaagtggagagatttctaaatataaaccatcttattcatggtttcattgctgtatataaataaaacctgtcccaaccctgtatgaatttttaaataattttcattaataatctcttgggcagcttcagtctcactgtgaaggattcactcttgaacatttcgattgactcaattaattgtcaatcttatttagaagttctaaataagagagatagctattataatttgtgaatgatgcagctagagttgcaaagagtagctcattccatacttcatcactcatttttcagggtatattaacaatgtctttacaaaggtttgattatatttctaaaatgaggtaactctagaaagaaaatatttttgaagctgttcctctctctttttctcactacaagctctgtcccctaaggcaattttatctgagggttcagcacatcatctaaggatataaagtagtcttgctgcttaagcaaatgaggcattaaggctgttttgtattcctgtgggctatcactgtctgtactgacaatgcagtggtgcctgctgcttgagataggggtaggaagggtggtttggaaggggattgcacgtgtgtgccataatgaatctgttttatctttgaacaattccatatgctcttgtgaagctatcaattctttcttttcctttttttttctccttttaatgccaagataaattgatcctagattgctgctccaaatgctgacaccactgaatatgaaggtgtcattgtaaaatgaaccatagcaaattcttaataagcaagcttcacaaagagttatagtttttgacattcagatatagacttatccccagtgaaggaagctttgttcagcccatgcatgctaagaggaataaaaaataaaaagtaatttgattggtattaaatatgttttattccttcctatattgagcaatcatatcacatgacttgtccacttccatcttacaggaaaattggaaaaggaatgatttcaaatcaagaactttatttctaaaaaagttggaacgagtttagagctaacgcttccagtgctatctggaggagatttaaaatctgacttccttgaaaacttcaaaatcagttgtgtctgagaaaaacaaattagtaaattctatagaacatatgctataaaaacaattactaaagttttctaagctgattatttcaggctaatttctcttctaaaaattagtatatcctagggagcctactttctaaattaatgggagcaaatgcttagaaaacacttttatacttgataactcagtttggaaaaaaagaatatgggaattagctctatgatgattattacaatttacattatcttgaacagagaagaaacagaccattttgataagttcaagaacattaacttttttttctctttacaagtcctgcataaaaactcctcaatggatgttgctttaaaaatatataaaaggcaggtgtggtggcatatatctgtagtcccagatacttgggaggctgaggtgggagaattccttgagctcaggagttcaagtctatcctaagcaaaatagtaaaaccccatctctaaaaatacatatatattttttaacatacagatatgctacaaatttaagacagtttattaatttatatgtacaaaagcaacctacatatttaagataatataatcagtaattataatataatataatcagtctgatatgaagttttgtcttatatttccagctgtgagcaactttaaaaggaattcattaactaactttattacagtatttccagaaaatagttattctgtgccacattggtttggtgatgcttgattagacttttattatgaaatcgactcttgtgtctccaaataataactgaaaatgcaaacatttcaaaaagttttaaccctagatatattctcagtataattcaacctgttatatataaattggctttttgtaaatagattccatacaccaagaatgtctagatttcaatgcattctgcattaagtccttctgtaaaacaaataattgttttgcttattaatcataactttggatatctgtttgcaaattggcatcatatttgctcacagttctgcaattcgtctttttctctaaacattgtgtttttgaaatttatccatgtttatatacaggtagctctagttcattcactttaaatgcttcacagtattccatcgtaggaatgcattaagatgtgcttattattttattcatgggtatttgtattgctttcatctatttgctgttaccataatgctaaaaaaaattattgtacatatctcctttggcatgtatgcaagagtttatctgagagaatatacctgaattggaaacacggaatttatggcacaccttcaacattaatggcaaatagcttctgaaagtgtttgtatcaatagatactacctcagcaatttctggaagtttcccctgctcattcatttgttcatttaataaatatttattgcacattcatgtgacagactgtgttctagaaggggatgtatagcagtaaaccaagtttataaaactctctgtctaaatgcagtttgcattctaatgtggggagacagaaaataaatataaatacataatatctcaattgggagaagtactatggataaaaatgaagcaaggagaggaataaagagtgctagaataggagatgcaattttaaatacagagatcaaggaaaactgtactaggaggtgatatttgagcaaataactgaaaggggtgaaggaaaaaagctatacattttcactcttacttgatattatcacactggttaacttgtgttagataaatgaaggtaaaaatttgtctcattaggatttttaatttttttctgacatcaagcatgtattcatgttaatttaccgtttgtgttgtccctattgtaaattgctagctaatattttaactcatttttctaaagtgttactttcctaattcttattgaataggagagatccattattaaattttgggggtatatagtaggtgagtatatttataaggtacgtgagatgttttgttacaggcatccaaagtgtaataatcacatcagggcaaatgaagtatctatcacctcaagcatctattatttctttgtattataaccattccaattatactctttgagttatttttaatgtataataagttatcattgactgtagtcaccctgttgtggtagcaaatactagatcgtatttatttttttttatatgtactttaagttttagagtgcatgtgcacaacgtgcaggttagttacatacgtaaacatgtgccatgttggtgtgctgcacccagtaactcgtcatttaacattaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgagatagtttgctgagaatgatggtttccaccttcatccatgtccctacaaaggacatgagctcatccttatttatggctgcatagtattccatggtgtatatgtcccacattttcttaatccagtctatcattgttggacatttggcttggttccaagtctttcctattgtgaatagtgccgtgataaacatacgtgtgcatgtgtctttatagcagcatgatttataatcctttgggtatatacccagtaatgggatggctgggtcaaatggtatttccagttctagatccctgaggaatcgccacactgacttccacaatggttgaactagttggcagtcccaccaacagtgtaaaagtgttcctatttctccacatcctctccagcacctgttgtttcctgactttttaatgatggccattctaattggtgtgagatggtatctcattgtggttttgatttgcatttctctgatggccagtgatgatgagcattttttcatgtgtcttttggctgcataaatgtcttcttttaagaagtgtctgttcatatccttcacccactttttgatggggttgtttgtttttttcttgtaaatttgtttgagttcattgtagagtcttgatattagccgtttgtcagatgagtaggttgcaaaaattttctcccattctgtaggttgcctgttcactctgatggtagtttcttttgctgtgcagaagctctttagtttaatgagatcccatttgtcaattttggcttttgttgccattgcttttggtgttttatctttctaactatatttttgaactcattaattatccccacttcccttcttcccaccactaccctccccagcctctggtaaccatcatcttgctctttatgagttcaatcgttttcatttttagctcccactagtaagtgagaacatgtgaagtttctctttctgtgcctggatttttttcacctaacataatgaccttcagttccatccatgttgtttcaaatgacaggatctcaatttttatggtcaaatagtactccattgtgtatatgtaacacattttctttatcaattaatctgtcgacggacacttaggttgcttccaaatcttcactattgtggctagtgctgcaatatacataggagtgcagacacctttttgatatactgttttcctctcctttgagtatatacctaggagtggggtggctggatcacatggtaactctatttttagtttttaaggagcctctatactagtctccataatggctttactaatttacattcccgctaacagtgtacaaagattccttttgctccacatccttaccagcattggttatagcctatcttttggataaaagccattttaactgggggtgcaacggtatctcattggagttttaatttacagttctctgatgatcaatgatgttgagcacctttcacatacctgtttaccattcatttgtatgtcttattttgagaaatgtctattcagatcttttgcctagtttttgttttgttgttgttgttgttttgtttcttttttctttttttttttcttcttcctgaaacagagtctcgctgtgtcgctcaggttggagtgcagtggcttgatgtcagctcactgcaacttccgcctcccaggttcaagcagttctccctgcctcagcctccctagcagctgggattacaggcacccaccaccatgcccagctaatttttgtattgcccagtttttaaatctgattaatcgatattttcctatagagttgtttgagctccctatatattctggttattaatcccttgtcagatggatagtttgcaaatatttttccccattttgtgggttatttcttcactttgttgattgtttactttgccatgcagaaactttttaacttgatgcaatcccttttgttcatttttgcttggttgcctgtgcttttgaggtattattcataaaatctttgtgcagaccaatgttatagagtttttccagtgttttcttttaggagtttcatagtggaggtcttatatttaagtctctaatctattttgattcgaattttgcatatggtcagagataggggtctagtttcatttttctgcatatggatatccagttttcccagcaccatttattgaagagactgtcctttcctcagtgtatgttcttggcacctaagttggaagtgagctcactgtggatgtatacatttattcctgggttctctattctgtaccattagtctatgtgtctgtttttatgccagtaccgtgttgttttgatcactatagctctgtagtataattggaagtcagttaatgagatttctctagttttgttcattttgcaccagatgactttagctattctaggtcttttgtggttccgcataaattttaacattgttttttctatttctgtgaagaatatcattggcattttgatagggattgcattgaatttatagattgctttggatataattgacattttaacaatattgatacttccaattcatgaacatgaaatgtctttccatttttttacatcctcttcaatttccttatttgtgtactattttttatgtcctcttcaatttccttcatcactgttttatagttgttttacagatctttcacttctttgattgagtttattcctagatattgcatcttatgtgtacttattgtaaacaggattatgttcttgattgctttttcagattgttcactgttggcatatagaaatgctactgatttttgtatgttgattttgtatcctgcaactttactaaatttgtgtatcacctctaatagttttttgtggagtctaggtttttccaaatataagaccatatcatctgtaaaaaaaggataatttgatttcttcctttgcaatttggatgccctgtatttctttctgttgcctgattgctctagcaaggacttccagtactctgttgagtaacagtggtgaaagcaggcatccttgccttgatctagatcttagaggaaagactttcagttttcccattcagtataatattagctgtaggtttgtcatatatagcttttattgtattgaggcatgttctttctatactcagttttgtgggagttttattatgaaggaatattggtcaaatgcctttttatcatcaattgaaatatcatatgatttttctccttcgttctgttaatatgatgtatcacattgattggtttatgtgtgttgatctatccttgcatcgccggaatatatcccacttggtcatgatgaatcatctttttaatgtgttgttgaactcagtttgctggtgtattgttaaggattttgcatcagcattcatcagggatattggccagtagttttccctttttgttgtgtctttgtctagcttagtttcagggtaatactggtctcatagaataagttgggatgtattctctcctactctattttttggagtactttgagaaaaattggtattagtatttctttaagtgtttgataaaattcagctgtgaagtcatcaggttctaggcttttctttgctggaagactttattacagctttgaactaagtacttgttattgatctattcaggttttgaatttctccctgcttcaaccttggtaggttatatgtatctagaaatttatctatttcttccagattttccaatttgttggcatatagttgctcatagtagtctctaataatcttttgaatttctacaatatcagttgcaacatctttttcacctctgattttatttatttggctcttctctcttttttcttagtttgtctggctaaaagttttttgattttatcttttcaagaaattatctttttcttttattgatcttttgtattttttgttccaatttcatgtgtttttactctgatctttattatttctttcctcttactaactttgggtttggtttgttctttcttttctagttctttaaggtatatcattaggttatttatttgaagtttatatacttttttatttaggtgcttattgctgtaaatcttcctcttagtattacttttgctgtattccaaaggttttggtatgttttgtttccattttcatttgtttcaagacatttttaaatttccttcttaatgtcttcattgaccccactgatcattcaggagcatattgtttaatttccatatgtttgtataattttcaaaatttcttttgttattgatttctagtttgattctatccttgtcagaaaagatacttgatatgatttcaattattttaattttttaagacttgttttgtagcctaacttatggtctactgaatgaaccatgtactgaagagaagaatgtatattctttagccattggatgaaatgttctttgaatatctcttatgtccatttggtcatagtgcagactagtgtgaaacactagtccagtgtttctttgttgattttctatctgaataatctttccagtgctgtaagtgggctgttgaagtctccagctattattgtatcaggggtttatgtctctctttagctctaataatatttgctttatttacctgtatgctccagtgttaggtactgaattaacccctttatcattgtataatgaccttctttatctcttttcttagggtttgtcttgaaatttattttgtctgataaaaatatagctacttcttatcttttccgattcccatctgcatggagtatatttttcgatctttttatttgcagtctatgtatctctataggcgaagtgtgtttcttgtacatgagagattgttgaatgttgtttttttaatctatttatccacgctatgtctttttattggaaagtttagtccatttacattcaatgttattattgacaagtaaggacttactactgccaatttattatctgttttcagattgttttgtggtcttcccttctttcctttctttcctttctttccttcttccttccttctttcctgtcttctttttgaggaaatgatttttctttgatggcatattttaatttcttgctttttattttttctgtatctgttacagagtttttgatttaaggttatcatgaggtttgcaaataacatcttataacccattattttaaactgatgataacactgattgcaaaaacaaacaagcaaagaagaaactaatgaaaactacactttaacttcatcccttcttttaagctttcagtagtttccatttatatcttactgttttaagtcttgaaaagttgttgtagttgttatgtttgacagattcatctttcatctttctactcaagatacaaatagtttgtacaccacaaatacagtgttataatattctgtgtttgtgtacttgctattactagggagttttgtacattcagatgatttattattgcttgtttacttccttttctttcagattgtaaaacaccctttagcatctcttgtaggacaggtctggtgctgtcaaaattccttggcttttatttctcatggaaagtatttctcctttgtgtctgaaggatatttttatgggatataccattctaggataaaaggcttttttccttagcactttaaatatgtcatgccactctctcttggcttgtaagttttccactgtgaaaccagatgtattggaggtcatttgtatgttatttattccttttctcttgcggcttttagaatcctttctttatccttgacctttgggagtttgattattaaatgccttgaggtagtattctttgggttaaatctgtttgatgttctataatcttcttgcacttgaatattgatatcttcctctaggtttggaaagatctgcgttattgtccctttgaataaactttctaccctagtcttactccgtgtctcctctttaaggccaataacttagatttgcccctttaaggctattttctgtatctcttaggtgtgcttcattcttttttcttttatctcttctgactgtatgtttaaatagtctatcttcaagctcattcattcttttttcttcttgatcaattctactgttaagagactgatgtgtgtcagtatgtcagttgcattttttagcaccagaattcattaatttttgttaattattttaatctctttgttaaatttatctgatagaattctgaatttttttctctgttatcttgaatttcattgaacttccttaaaacagccattttgaattctctgtctgaaaagtcacaaagctctgtcactccaggattggtcactggtgccttttagtctgtttggtgaggtcatgttttcctggatggtcttaatacttgtggatgtttgtcaatgtttaggcattgaacagttaggtacttattgtagtcttcatgatctgggcttgtttgtacccctctttcctggaaaagttttccaagtattcaaaggaattgaatgttgtgatttaaatcttcggtcaatgcagccatatatacattagggggcaccccaagcccagtaatgctgtgaccttgcagcctgttagaggtactgccctggtggccttgggtaagatccaggaaatttccttgtattacaagacagagactcttgttctcttcctttacttttcgctaaacgaatggagtatctctttctacggtgagctgcttgatgttgagggacgagtgacacagcactgctgtagccaccatcactgggactgtgctgagccagacctaaagccagcatagtactgggtcttgcccaaggcctgtaacaactattatctggctacaactaatgtttattcaaggcccaagggctctttggtcaacaggtggtaagtacagccaggcttgtatcttttccttcaggacagcaaattcctttctggcccagggtgggtcttgaagtgctgtctgggagccaggacctggagttgagaactttagaaatctatttggtgctttattttactgtggctgagctggtacccaagttgcaaggcaaagtcctttttactcttccgtctcctttcctcaagcaaaaagaatctctccccatggccaccactgccccaggcccatggtgagtactgcctggctaccactgatgtttattcaaggcctaagggctcttcagtcagctggtgttgaatcttgccaggactgaatctcccccttcagagaagcaggttcccttctcacccagggcagctgtagaaatgctgtccaggagctaaggcctggaatcagggatttagtgctttaatttactgtgtctgagatggtgcccaagttgcaagacaaagtcctttatactccttcttccttttttgtcaagtagaaggagtctattttcatggctttcccacctgggaatgcactgggtcagacctaaagccagcacggtactgggtattgcccaacacctgtgccaagtactgcctggctactgctgatgtttattcaaagtccaagggctttttagtcagcaagtgatgaatccttccaggaggaaatccttctcctaaaggcagagggttcccttctggctcagggtatgtctagaaatgttgtctgggagctagggtctggaatagggacttcaagactccgtttatgctgtattttactgagattgagctggtatccaagttgcaagacaaagtccttgcccaggaattgctgttcttttggcttagactgcctttcaagcttatttagaaccccagagcacttcagcccacggtggtggggcttgataaaactcaagttctgaccagtgggatggatgattcccctctggctagggatggtctaaatgctacctctgtgtgcgccagctgaattctgccccatattgctctccaccatgacagggtagcactgagttccagtgcaaagtcccacaatcagtgctgtttccatcctgcaagcacacattctccatctgcaccacatggctgctgctggggcatgggcgggtggtggtgtagacaattcaagactgtctttcctaccctcctcagtgcctctttcctcgatacaatgttaaaatcaggtactctaagtgctcacctgatgttttaatcttatgaagctgttttcttgtgtggatagttgtaccgtttggtattcctatggtggggacagttgctggaaggttctattcagccatcttgctctgcctgtgctctgagagcttttcagtttttttgttgttgttgttgttttaatacattagggataagattcctttgttgttttcatgtgttacaaatatcttccaccatttttggcttaactttttacatatttacaatattttttcacacagagaagttcaaattttattattacttttattgaatttgccaatcttttcataatggtttatatttctttcttatttaagaaatcaatccctatcttatatatttttctccaaatattcttatttctgttctttttcacattttatctttaatctacttggaatctatcttttagtgtgctgtgaaatagtgatgcaattataagattttcttccatgtagataacaaattacactatcatcatagttgtatttttaatgtacagattgtatctctgcttaaatgtaatttgcagaaagaatgtcttaaccattcccattgagttatatcccacttttatatgtgctataatgttttataattctccttcttaaaaatcaaaataattttaaataattgattattcatgtaattatttattaatttctggtttcaccccttctcctccccaaaattataaatttcatgaggacataaaccatctctcacttaaatctataaccttggtcctgacgtggtacgtaattcagaataaatgcctgtgaaagtattcaactgatacataaataaattattttatttccataatgtgtgagatgaaaatacattgatttatgatgccttgagtttttaacaaggctgaaaataaccttaaattttccacgatttatgtgatactgagtaaacgctactgcttgaactcttattataagttttttatttgtttctaaaaggcttccacttacacagctggcttcttccatccaatttgtaagggtataagagatacaataggtatccagtatgcaagtcagtaagacatgtaaaatctgtgacatcgcatcctacctcccacctggccaatttatctacaattacatagaactgtatatgagccattttcctgaatataagagttttttgttatgttttgtttttaccttttgggttcttgaaatgagttcaacttattaaaatttgggaaattctttccaaataatttagatgttagacaatgaatttctaatgattctcaaggtattacttctttaaagttggaacagaatgtgtaataatcttttctttttcagtaaataatataagttcattttacaaccagttgctcacctctagcctagagtaccttcaatgtttccagaattctgggctgtcagtttttgacattttaaagtcttatcctgacagtttgtttgttgttgttgttcattttctgccttttaaaaaaatagttggggagttcaggtggacttcataactttgacagagatcttaaatgtggaatttatttatttatttatttatttatttatgcattcaaatatttaatgagtgcttactatttcccattgattattctaagtggagaagatacaatggtgaaaaagacatgcaaaattcctgcactgattgcgcttatattgttctagggaggtacattacaaaaaaaaaagattatataatgttaggttgtaagaaaaatagattattgggatagagagtgacaagcagggtgcttttttagatagggttaccaaggaaaagaataaataaaccctaaaacaagagttttactttacaatcctcaagagcaaatctggtgaatgtcctaatttactagtatcaaactttttcactcaaaactccagcttaactaattcacacctgttctttcccaaaactcttcatatgtttccattttctccatccatatatttgtaaaagttaatactgcatcctcaatctatgttggtattcatatgctttttcttatactttgccatcttttcatttttttttattgtaagttcaggggtatatgtgcaggatgtgcaggtttgttacgtaggtaaacatgtgccatggtggtttgctacacagatcatcccatcacctaggtattaagcctagcatccattagctattcttcctgatgctctccttcctcccccacccccaacaggccccagtgtgtgttgttcccctccctgtgtccgtgcgttctcattgttcggttcccacatgtaagtgagaacatgtggtgtttggttttcttttcctgtgttagtttgctgaggataatgtcccccaggtccattcatgttcctgcaaagaccataattctcattcctttttatggctgcatagtattccatggtttatatgggccacattttctttatccagtctatcatcgatggacatttaggttgactccatgtctttgctattgtgaataatgctgcaacaaacatatgtatgcatgtatcttcataacagaatgacttatattcctttgggtatatacccagcagtgagattgctgggtcaaatggtatttctgccgctaggtctttaaggaattgccacactgtcttccacaatggttgaactaatttacactcccaccaacatttccttttgctccacaacctcaccagcatctgttgttttttgactttttaataatagccattctgactggtgtgagttggtatctcattgtggttttgatttgcatttctctaatgaacagtgatgttgagctttttttcatatgattgttggccacatgtatgtcttcttttgaaaagtgtctgtcatgtcctttgcccactttttaatggagttgttggtatttctcttataaatgtgtttaagttccttgtagactctggatattagacctttgtccaatggatagattgcaaaaattttctcccattctctagattgtctgttcactctgaggataatttcttttgctgtgcagaagcccttcagtttaattagatcccatttgtcaatttttgcttttgtttcagttgctttaggtgtcttcctcatgaaatcatttcccatgcctatgtcctgaatggtattgcctagattttcttctagagtttttatagttttgggttttacatttaaatttttaatccatcttgagttgatttttgtatatggtgtaaggaaggggtccagtttcaattttctgcctatggctaaccagttcttccagcagcatttattaaatagggaatcctttccccattgcctgtttttgccaggtttgttgaagatcagatggttgtaggagtgcagtcttacctctgcattctctattttgttccatcggtctatgtgtcttttcttgtaccagtaccatgctattttggttactgtagctttatactataatttgaagtccagtaacatgatgcctccagctttgttctttttgcttaggattgtcttgactgttcaaactcttttgtcgttccatatgaattttcaaataggtttttctaattctgtgaagaatgtcaatggtagtttaatgagaatagcatcaaatctaaaaattgctttgggcagtgtggccattttcacaatattgattcttcctatccataagcatggaatgtttttctatttgtttgtatcatctctgatttctttgagtagtggcttgtagttctccttgtagagatctttcacttcactagttagcaatattcctagatattgtattctttttgtggcagttgtgaatgggagttcattcatgatttggctctcaacttgcctgttgctggcgtataggaatgctagtgatttttgcacattgattttgtatcctgagactgctgaagttgtatatcagctggagaaacttttgagctgagacagtggggttttctagatatagaatcatgtcatcttcaaacaaagctagcttgacttcctctcttcctatttgagtatctttatttctttctcttgcctaattgccctggccagaacttccaataccacattgaataggagaggtgagagagggtatccttgtcttgtgccagttatcaaggggaatgcttccagcttttgcccattcagtatcatattgatactttgccatcttttcaaccttcttatttcctagatatgtgcccacttatatgctgcatataattctgcttacctggaaccatttaagtatgcatgtacttgggtatataagagtaaatatgtgtatataaacctgtaggcagcacagtcagaactgtgtttacatatgcacatacacacatgaattaaggataaaagatatagaaaagatgagggaaacaactatcctgagcattgctagatatttccaaaataattacgtattaaaattgaattatcattgcagagccaaaacacagcagggggcagagttcagaaatgttcctctaggtcagctgtgccagttctgtaatctgtgagcaaattactcaaaatatagcagggacataattaaatatttcaacactattgtcaacagaatatattaagcacttaactccttaaaaagacaataattgtaatagtggaatccactttatactagtcatactcaattcagcttttaaatgttatctatttaaaatggacagttattacttacaatatatatgtaagtataaatatatttaatatgtatgtaaatatatgtgctatatatacatttataatgaaagtatacatatgatataccttttaaaatcaatacatacttaaatattaagttagctctccctccttcactaatactagtcattctagcatgccttatatctactcaatttcttttcaatttcaacatgaatttaaaagttattgcttaaatctaaggaatttaatatacacaacagaactttataaatgtattcaaagaaagggtctctagatcaatgcaaatttttttctttagatcattactaaaaacgcatagtcagggtcaaaatagagctggaattctttttacctatatttaaaaagtatgcagtgaaaagtattcaggctcaactagataaagaagctttacagagtgctttatcagcttcaataattaaaagatttcctgctaactattcaataagagtcttctttatagctctgctttgcagtcagttctttccatcacttcctttgaaaagtctaattaaagtggaaggctttatttctattcattccgtgtttgccatattggacatagatactaaaataactaattaaagactatattggctctttttaaattcttgtcctgttggaactttatggggtatgggagtggaaggagaagtattttctcagttttagtttttaaagttggttttttattgtcactctctcaatattaattatcttttgggttaatggaagtaatatggataactttctccctgatgcctgtattgatgctgtaataggtgttttttttttagagtaactgactagtgaagaattgaaactaaacacttcagagcccttatattccccttgttgtattactggagcattacttaagcactgctaactatcttttaaaaatatatttgctgtagtgttcaaagaaacttgcatggaaaaaaagccattttctacttcccagaaacagatgttttcttttttgtgtgtattttcgtctatatttataaccatacgtttaagatcataataattatatgctgtatatggcttacaaggtttttcttttccttattctaattataaactctagccagtaagtgtctccataaaggtgatacgccttttatagaatcaagtgctaagataaagaatcttaaaagcttattttttactgttagaatataggcagttgaagggttaaaacaagtcaaccataattcaatgagaacattctggcccttactacttactatcttgagagagttataatagagtaagaaacatatttatgcaagtgagtgtaatacaggaaagaatatgatgttgttaagatgtagtacaaagtgggctgggtgcggtgacttacgcctgtaatcccagcactttgggaggccgaggcaggcggatcacgaggtcaggagatcgagaccatcctggctaacacagtgaaacctggtctctactaaaaatacaaaaaaaagtagtacaaagtattttagaggcacagtgctttgtagttgatcaatgaaatacttacagaagatttcaaaataagatacatatggatgtgtacttgtatatatacccctatatgcatttccaggaaaatggaatcataaagatttggatacaaaaaaattattttcatttatgtttggacatgaggaaggaagagacatactctagaattctatcagaagattgacattgcttgagcaactgctcagtcatacctctgagaatagtcattttaaataaaatgacaacttttaagaaatactccatattcaggcaaagttccaatgacgtaatggtcagaaatcttaagttgatgcattttagaaaaagccaaggataccttctttgaagatatagtttgctttaattttattttaagttccatgaaggtaggaattttttcttttttgtttgatgattcatccaaagcacctaaaacaatagcttttacacagtagctactcagtaaatacttattgaacaaatgttgaatgaaactcttggcacatattttggtttcaatccattcctgatggccagacaactgggcagaatcatggactgaattctttaaaaaaaaaatccgtaggaatcaatgcagtacagaggataaaacacaaaactgaaagtcaagacatttgagttccgctgataataactagttgtaagatgatggtcaaatcatttaatcttccatccaagaacattctttctcttctcaaattctatgagtcaattttcagccccacttataactcttaaaatttcatagaaggttatccaagcttttcatgcatcaaattgtccttgtgataaagataaatcatagctgatgatggatgattaaataaggaaatataaaaattctttgaaagcttttggatgataatatttatatattatacgaaatataaatgttatatatattaagtatatctatgtgaagaaaatgtgacaattccattcagttatgtaataacattttaactttgataatatattacaaatatttcagattaacataaacacttaaaagagaaaaaacacttaagatttattttcttccctatagatctagctatctatatatattaagttgaatctaactcaattttacaagtttgacaagataaacagaagaatctgatacaaacttatgtagattaagcaactgcaaatttgtgaaaagttattttttctaatcttgggttagaataaaaccagaagacaatggtagattttatttcaatccaagggacttttttttttaaggagaaaactgctaaatgctccaaaggctcatctttttatagataaagtgattttttttcttgcccacatcatagcttttatggtattttggattttcattttcaattcacagaagggctacttccgctcacaaggcagtgttacacattttcaaacaatgaaaaattacaaggcatcaatcagatccatagggaaattgagtttctatgatgaaatctatagttttactacacacttaataaatacttaatactaatgatgatctcatacccactcatcactggacctaaatgtttgctgcaatatcctccacatgattccaatagtctgagcaagactcacaaaagccaggtcactaagcaaatacacagtgcagtatggcatgggcagttagttccagcagatagaacaagcatcttttcctggacatttcctgtgcagtctgattgactccctgatgtttcccattcactccaagctgctttttccctcctccattcaaaattgcagaattctctccctggtctcaagctgctgtctctattcttaaactatatgctcaacttcctaccaccccaccttattttttgatgaagtctgtttcatcatagaatccttaaataacaaatctcatagaaaagagtctactctgctcctgtgtataacattagattttaatgatatgaaagaacaaagtccaatagttggtttggagagtgagagcccccaaaaaaaatgactacaagaagagaacaaatgagtacatattaagaaatttccattgcaggccattcattcctgatagttgtagctctctatctcattttaaatgataggcagcctcaatcaacttttgatgcaatattaaaaagaataggaaacaatgattatgtagcaaccaaggtcttagatggtccagaaaccttatattaatctcttcccctaccaaaatttgaggccaaacatgctaaagcatgtagagtttgctcatttaattttacctcctttcattttctcttttcattctttgaataaaatgacaatatttcacgaaacagtcaggaagtaaatacagaataatagaaaagaaaatggtcacagacacctgctgggcattttctatacaccaggtactgtactgagaattttgcacatattggaatgatgcatctgtatgcttcacaaactgatatcattaaatggaccctgcttgcaagaagcaaactccaaacaccttctttcaggttattggttagtcatataagaatcagcaaacatgaactttcttttttccatcaagtcaaaagggcaaaaggaggaaagtttaatcactacatagtaatctcataaaatgtagagttctgcgtaaacataagtcacctaaaaaatctctatgatgggactaatagataccttcaatgggtttataaacctccagtgctttgtgttacagagcatagcaagaacaacatattcgttgttgttgttgttgctgctgctgctgttttctcctcccagtgaacagtttggctgtgcaatttataggatgaacacaagatatgtttgcatcctgagatttgccagtaaaacattctcaagtcctttattaatccccatttttaaaaattcagatcattctaattatactccatcactcaacgaagttttacaggaaatcaaagaatttgttttcaatgactgaggacaattaaacttggttgagtctgaaactttgtgatgtgtatttcaaaggtctttctcaataaatttttaggttgtggtgtatttatcagcctaacaaaaggattaatatagctcctaaaaagggataaaatattaaatagtcaaaaagggatcgaatattaaaaaatgtaagttaggtaatggatggatcaaagtgtcaataaaattgaagacattcttagcaacttaaatactttgaattgggtggttagaatttgttcaccaggctaactatgtgtgcaggaagaatttttatatttcaggaatgtctaggttaacaaaagctaaatattcagatgtaataaaggaaatagtttttagtcctggtgtctaaagtgaaaaagcattaattcaaatcccaactccaccactgatgagctgttgatcttatcaaaccttttaggcctcagcttctttttctgtcaaattgttataataatggtatctactctctgtgattggtgtgagtattggaaataatgtatataagatacttagcatagtgtctgtcaagtcataaaaatgcaataaaagttagttgctgttgtaactgtatacttttagcatgtttgtctttaaaagacctataatttatttatttaattgctaaaatttgtctccatttttcttgttcagagattgttttatttaatcttcataataacaggattaagtgagaagagtaaattctctaatttctaattctatagttgaagaaacttgaaatcaagaaaaagaggagaaaataatttcttttttcttttttttttttttttgagacggaatcttgctctgccgcccaggctggagtgcaatggcatgatctcagctcactgcaacctccacttcccaggttcaagctattctcctttctcagtctcccaagcagctgggattacaggcatccaccaccacgccgggctaatattttgtatttttagtagagatggggtttcaccatgttggccaggctggtttcaaactcctgaaagtgatctacctgcctcagcctaccaaagtgctaggattacaggcatgagccaccacgcccggccaataagttgttaatattatactaagtactagttatttatttactatatactttataccttatcacatttaaccccaccccaaggttatatgctagttattactcatgaattacagatgagagaatcaaggaaattattcagaatcatatcactagtgagttacggaccaggaactttaacacaaatttctaaactcagaaacatattctatgttatttctaataaatatggccttatcactaatcaacacatcagtgtcacttcaaacacatatctagaatcaagttcatactcttcacaccttctaatctttgtgtccccccaaaaaagaaactatctcctagattcttcatctatattaatggttttacaatccacccaatcactcaaactgaaaactgccagttggccttggcctcccactttctcaccacccatatttatggatcacttcctgagagttctctctggacggacttgcagctctgtctcctgctctccatctccactgttataacctaaggtactcatcatctctgcctcatattttatcatacactagttccttattctggagaattgaatacctttacaaacaaagcagccatacctatctttctaatgcatagatctatttgtttcccctactaaaaagttttcaatgtctcttcattgccttcagagaaaattctaaacttcttccaaacagatactgaaaaccatgtaaccaccccaggttatcccactccaacttctctgtgttctgggtacagtggtaagtggtgtttcttaaacatatttacatctacttactgtttttatgattttctctttgtctgatatgactttcatcaattggatagggtaagcttcaacacattattcaaagaccaagccatcctccacttagcccctaccagaatgaatcatgtgtttttccatagtgttttatacctgttgctgatagaacttcattcatcctatgctattacggtcagtcattaccatgtgagtaactcttgagcaggggccatcatttaagaatattagtattaccaaaatatcacatgggaaatacttaataatttttgagaaataaatgaataaattacatattaaatacataaatggtgaaaccaagaattatattgcaaatattaaacagctgcattttacagacacaggcaaatcagaatgaaagcacagatcaataaaaatgggcccagaccaggagattagggtatggaccaatcagaattgatgttagctacacacaaccagcttggactgaccatagtgaccatatacttgcaccaggtgcagctcatgtcacttaattctatgcaatataattttttcaatggcttttatgaacttttaattctatttaagataatttttcaatggcttttatgaacttactatttcccccaggggatataaagataccatcaatatgtataatttgagtaaattcagtagtttgactaatggatcgatgtaatagcaaataatttattacctgccctctgtgcatcaatctcactttgaggtaaccaagccttcttagttgagtaagacataaaccctgtcttctgggaatcatatattacagaatcttctcgatttttattctattatttagtaaaataacaaactggtaaccaattaaaggcagactacattcttcacaatatctgatttgatttgtttctttaaagggagagtccattctaacgaacatactatcaccacttccaaggctctctgtcaacatacaaacattctttccattagaatgatcctccttgacgagggtggtttcaggcaataaaatgagttactgttgaaatgtgaatgatgaagacattaaacatatttaaaagacacgaaatgagtcctacagaagtttggctaccatccagattcactttttcctcaaacttctgtaatattcaaaaaggacaaatactcctgattttaaacccaccatgctatttccagggagccatgactgctaggtaaaatgttcaagcgcatgcgggattgtcatcttcctgaggtggagtagagacaatccttgcaatgggaaggaagatagactaggcagccaacctcctttacagagctaaggtcataatttcatggcctataattttatgttgcatcgtatcttcataggtagttacttattatgcttttaacttaaatatgtgtcacacatattcttttgtaggtatgtaatattttattaattttttaaaaaatatgcagctaactcgtggaatatactattaggaagtcataaaaacattaccaaattacatgtaatttctcttctctatgtccttcattgggttacctgttgatcctttaatcaaagccttgtaattacgaaaagagacgctacatgagtgcccatatgaaggtgattaaagggagaaaataagagaccgagagaggaatgagtggggagagaagaggagggacagttgatggtgtcccctactagttgtccagtaggggagagagaggtcctcactgcaccatgttccagagcttatttttgttgttgttgttttgagacaaagtctcactctgtcgcccaagctggagtgcagcggcatgatctcagctcactgcaacctccacctcctgggttcaagggattctcctgcctcagcctcccgagtagctgggattataggtgtgcaccaccatgcccagctaatttttgtattttttttagtagagatgagttttatttttaattttattattattatactttaagttttagggtacatgtgcacaatgtgcaggtttgttacatatgtatacatgtgccatgttggtgtgctgcacccattaactcatcatttacattaggtatatctcctaatgctatcactcacccctccccccaccaaacaacagtccctggtgtgtgatgttccccttcctgtgtccatgtgttctcattgttcaattcccacctgtgagtgagaacatgcggtgtttggttttctgtccttgcgatagtttgctgagaatgatggtttccagtttcatccatgtcccttcaaagaacatgaactcatcattttttatggctgcatagtattccatggtgtatatgtgccacattttcttaatccagtccatccttgttggacatttgggttggttccaagtctttgctattgtgaacagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctttgttccctgactttttaatgatcaccattctaactggtgtgagatggtatctcattgtggttttgatttgcatttctctgatggccagtgatgatgagcattttttcatgtgtcttttgactgcataaatgtcttcttttgagaagtgtctgttcatgtccttcgcccacttgttgatggggttgtttgtttttttcttgtaaatttgtttgagttcattgtagattctggatattagccctttgtcagatgattaggttgcaaaaattttctcccattctgtaggttgcctgttcactctgatggtagtttcttttgctgtgcagaagctctttagtttaattagatcccatttgtcaatctttggctttggttgccattgcttttggtgttttagatatgaagtccttgcccatgcctatgtcctgaatggtattgcctaggttttcttctagggtttttatggttttaggtctaacatgtaagtctttaatccaacctgaattaatttttgtataaggtgtaaggaagggatacagttttaactttctacatatggctagccagttttcccagcaccatttattaaatagggcatccttcccccattggttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccatgtgaaccttaaagtagttttttccaattctgtgtagaaagtcattggtagcttgatggggatagcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacatctcttgtaagttgaattcctaggtattttattctctttgaagcaattgtgaatgggagttcactcatgatttggctctctgtttgtctgttattggtgtataagaatgcttgtgatttttgtacattgattttgtatcctgagactttgctgaaattgcttatcagcttaaggagattttgggctgagacgatggggttctctagatatacaatcatgtcatctgcaaacagggacaatttgacttcctcttttcctaagtgaataccccttatttccttctcctgcctgattgccctggccagaacttccaacactatgttgaataggagtggcgagagagggcatccctgacttgtgccagttttcaaaggtaacgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattaagataatcatgtggtttttgtttttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcgaggatattggtctaaaattctcttttttggttgtgtctctgccaggctttggtatcaggatgatgctggcctcataaaatgagttacggaggattccctctttttctattgattggaatagtttcagaaggagtggtaccagttcctccttgtacttctggtagaattcggctgtgaatccatctggtcctggactttttttggttggaaagctattgattattgcctcgatttcagatcctgttactggtctattcagagattcaacttcttcctggtttagtcttgggagagtgtatgtgttgaggaatttatccatttcttctagattttctagtttattcacatagaggtgtttgtagtattctctgatggtagtttgtatttctggggatcggtgatgatatcccctttatcattttttattgcatctatttgattcttctctcttttcttctttattagtcttgctagcagtctatcaattttgttgatcctttcaaaaaaccagcttctggattcattaattttttgaagggttttttgtgtctctatgtccttcagttctgctctgatcttagttatttcttgccttctgctagcttttgaatgtgttttctcttgcttttctagttcttttaattgtgatgttagggtgtcaattttagatctttcctgctttctcttgtgggcatttagtgctataaatttccctctacacactgctttaaatgtgtcccagagattctggtatgtggtgtctttgttctcgttggtttccaagaacatctttatttctgccttcgtttcattatgtacccagtagtcattcagaagcaggttgttcagtttccatgtacttgagcaattttgagtgagtttcttaatcctgagttctagtttgattgctctgtggtctgagagacagtttgttataatttctgttcttttatatttgctgaggagtgctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgtttttctgtctaatgttgacagtggggtgttaaagtctcccattattattgtgttggagtctaagtctctttgtaggtcactaaggacttgctttatgaatctgggtgctcgtgtattgggtgcatatatatttaggataggtagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttgctgaatacaacacactgatgggtattgactctttttccagtttgccagtctgtgtcttttaattggagcatttagcccatttacattcaaagttaatatcattatgtgtgaatttgatcctaacattatgatgtcagctggttattttgctcgttagttgatgcagtttcttccaggcctgagatgaggtttaactatgttggtcaggctgatcttgaactcctgacctcatgatccgcccaccttggcctcccaaagtgctgggattattcatgtgagccaccatgcccggcccgttccagagtttttaataagaatatctgggagctaaagaagagtgcatttagtcagcaagccacttatggatccgctgaataaaatatcaagttctagtaaatttcaatctacagacaggagatccaggatgagacaagactgaaaaacctctaaattcagattacagtttagaaaagaaataaaatctctggatttccaggtattactggaataacaccacctctatactccaacagtgtcgtatgtcttcttcaatactatttctgctacctgtgacactctttcttcctcccctcccctttcttgctaactctgctaataccacttcctcagataatacagataatcattttctttttttttttgagatggagtctcactttgttgcacaggctggagtgcagtggcacgatcttggctcactgcaatctccacctcctaggttcaagcgattctcctccctcagcctcccgagtagctaggattacaggtgcccaccaccacacccagctaatttttatatttttagtagagatggagtttataggcatgagccaccatgcccggcacagagaatcattttctgaaacaccaaagctaagttaggagcttcttttgtacttactgcgtaacactctgcactttgatttatggcacccaatgcatgtataattaaatggttcagcttcagcatctatctctgaaattgtggacatgcaatttccaggacagcagagagactgtgctttcttttcatccctgtgtctctagggcctaatacagagcctggcacattaggcaatactcaataaatatattaagtatatgaatgatgaatgagtgaatgaatgaatgcatgaatacataaataagttgcctctggaccatccaagcagatatatttagtagaccactggaattatcattctgagtgcgaaagagagattagggatggcaataaagattgaagagtcatcaggttacaagtggtagtgaaattcataggagagaataaatctcttaggaagagtaaaattgcagaagactgaagacaaacaagggatgtagatctcatggaaacaattcagaaaacttcctcagaaaatatgagtgcagcctagatagtagttaagaactcagattgttttagtcacactgacttttaatcccatctccaggtcatatggtgtgaactaggtaagtgtggagctcagctgtgctggagacagctaagctgccaggtctcagagcagctgattaaaacaacaagccaaaaaataaaagcgacaatcaagcctttaatctcttcctgcagtagtgtaatcaacaggctgaactggagagccaagagagcattggctccccccaatcccattgcacttgcccatggaagatcacattggtcaagatgaggtagatcagcacagatattggggtcatcttattgctgagggagccccaaacaaaaggcttaagcagggcagggggttgacaagaaaacaacggaaaagagccaggagtggaaaagtactgagtactgagtcagagtagggacaaatgtcaagtttttccctttcttccctgtaaggtggtttcagcagaggcacctgaaggtggcccctgccaaaggctccaaacaaagagagctctgaatgatggcactgggggtaggaatgcaaatatgcataaactatggtctgccagggaggcctgaggccttgactgcaactccctttagaaactgtgccgcgctggctgcacaccaagcccggcgtggggagggcagtttccccgtgacacctgctgggcaaagctttcgtcactgactatagttggccctgaaaatcactcacaggtttttggccaggaagcagactgctcagtaagttacttgaactctctaaatctcaatgtcctgatctatgcctacctcgtgatttgtaaaaaaactttgctaaattcttggcatatatgcagtgctccataaatgagaacccacaggagcaggttgaggcgcaggggcaccactgagactaagagaacagaggccaagaaggtcatgactgaaaatcatctgttgcagtcgacaactgagttgttagtgaccttgggagagtagattcagtggagcaaagacaatgaaaattagagcgcaataggttatcagcaaatggaaggcaagggagagcggacaggaatcatccactagtctatgaagatgttggtgacaatgagaacgtgtgtgcagctgatgaagatacatgagactgtacagctgtcatctgatttgtaaggaatttgtcccctgaatgcccttaaaccacaataaaatcattagtatggttttaaaagctaactgagtacattgttttagagaagatggagactacagcaaggcagggaagagaaaaagccccaggacctggggtgaagccttctaagcagagtcagtgacagctgagtcacgcagaggactctgatgtcaccacagagcttgtggtatgcagactcattccagatgggcaggctttccttcaggatccctcacttatctcttctcctctctaaaagactagacactttccaccactactagccctctttctgtacatctgtcagcttttatccccagaaagcctgggccttgacagtcctcatccctgttgctctctgtttctgtaagccaagttttgcttctgttcagcagactgagaaacatcacagacccgtcttcgcacagaatccagcaaggataggatctcttctcctgactcaaccagaaataaatttacataatttattacacattaatatttttgaaactaaggacagaccgtggttcctctgtaaagactgaagcatcaagaaaaatcagcagctattctaaagaggcaaaaacataaaacccccatcagaatcccattacagtactgagaccataggagaaagctaacatgcatatcatagattttccatggaggatgtgaatccatagcatagtgaggcctatgtaagaggatttattatactttttatgtgacaataatatttccagggctttcaggtacacctagtacaaaggcttttcctagtactaaaatgccacaagagacacatgaagctcagtaactctttaagttgtagcttaaatcacccagatttttgcatttgaaagaaagcatagaatgcatgcacaatcaatgtaaagtattacataaaataatttaatcatatacaactcagcaggtttatgcctgctgccatttctctcctgtttctttagtagactatcattttctgcctctgctgtttacaggaatatattttatttcaaaagcaagatttttcttggcactcaactcatccatgactttattgttgaattttttttaatgttataactcaactctttgtgtggttaaaatggctgaggctcttttatgttgttcttatgttttcttcccccatcaagcattctgaccgctgctgtcaaaatctgataataaatgaagatttctcccacagtggacctcttataaccatggcaactccatcagcagctaatggtcacattacaaaaatgcttttgaaaaaggcagcttctcacattgctttagtacaaatgtcctttccttaccttctctccataataattctaagaaaacaacacatcccaagcaaacatttgctttgttgtgcatatgtggggtcactttaaaaaataaaaaaaaaaaaagaagagaaactacaaataataaaagagaaagattatttgaaagcatggcactaaagtaggaaatgatactgatggcttagcagcattaacaacatatttgtattgtttttacaactgaagtcaatgcagctattgcttcttaagaatttgataatttttattgctgttacttcaccctaccatcaaattagggaggctttctaaaatgcttattttaggtttcatatgaattgtctctgagcaattggtcacttgtgggaaatgcagctatatgtacacactgatatatcttcttttctgtctgagactttcatgtgcttttatatatccttgaaaaaaccccataggagaattagcatatggacttttcagcctgcctcacacaggttcacaacagaaattcctgtctgagctctgctcttagacactcaaaagtgctctggcttccttatttacaaagtagatcaaaactagtttctaacatagaaattttctccaagtgcctgcttctgaaatggcctgcctgttaaaacaaaggaggatgttttccacattaacttcttgttaaaatgatgtatctgtctgaatggaaataataggcattcagatagagttctctatctccatccatatgtcactctgtctgtctacctacctacctgtctataaatacctacccaaggaaagagacttcctcaaatcccaaacatttcagtgcttgagttttgttttgttttgttttcccccaatttgctttcaaatatcaatcgtgatcaaaaagtaaccacagattagaactcagtgtcagatttccaaatctgcaggatctgttgatgctaatgacactaatattaggtacatttcataaatgtaaataattctctccctctaaggttttcagaactaaatggtctatgtaggacagacctaagagtaggaatgccccaggccacagagcaagcagcaaagctattttattaaccttaattacaatttgatttttaccttgcccaaaacctgcttttttaaaactcttcttaaatgtatcctttctctataaaggtcctttaatcatggtggataggctttatagttaagacctccttagatttgcattgaaactctgcttctttctgctggtaaactgggcaagttactcaaactcacttaatgtcaaagcatttatttgtaaaaccagaatgataaaagttctccctcagaggatagctgagaacaatagttggcttaatacatatgaaaacacccagctctgtaattagaagaaactaaattctccaggaatattttccccccattttttcttccccatcattcctaattctcactctctccttttccttagaataagtagtcatgagattaggctcatctttctgatttgctcatccattttataagtcatttttataagagcgtaaaattatttgcaatctggtaagataaaacaagttgaactgttgactgcaagattgtcagtagtgaatgtttggtttcccttattgaaatcaaaagttacaaaatttcataacatacataaaatcaccaccacaaaaatccatctttcccaacataaaattaaattaaaaataaaatgagtgtctgttagcatatcaaaaaatgatgtttcccttttgaactagttcaccaagttcatgcagaagaatgaacttggagaattctatcaccgacagcccagacaacagactgtggcctgatattacttatcttagtggtgggagtgtatgaggttggtaggaaaacaacagcaacaaataaaaatgccaggatggtctacagaaaaagtttatttaaaattttttaaggcaaattttagagaaagtttcaaaagggaacattgcacgccattaatttttgccctggcacacaaactttcatcctttagaaggaaccagaataaatttgaagcttttaataaaatatttcatggggtaacaaaagcaacattaaacattaataaataagtctttgctgcaaattcattttgaagtgtagtcatccaagtgcaatatgcattgtgtaaatgtaacttttggaaatattaatactaataaagtctgagttcatgaaatgttcttgcctgtcatcttgagaccaagatgcatcgtcaaattgcaagcaaacattgtgaaatcaaaacccagggctgttggctcagtgagatgctgaatgagaaattgttaagtaaaaaagaccaaagggagaaaaaatgttgttctataactaaacaaatggaatcagtaaaaagtcattatttctctaagtacacatttgactacacaaaggagccactgtgttcatccaatgtgtcccagtggtcataggccttggttattcaaaaaggactttttcttttttgtcattacccctaccttctgtactgtatacaacctaaagaaagttttatgtatacaaccaacaattcattttccacatgtaattttatttttttctttcaaaggccaaatcttccattggaataaaaaaaaatcaccaactctttaagttctttcattttctatctaagcctccatattatatagaaaaactgatattgcctctttaagaagtgtaattttacctacattgatcaatgtaactctggttctttacaaaaatgatggaaatgttcccagctcaaattataatttcaggcattaaatgataggttcccttagaaaatgtgagcacgttttctttagggcaatgttgacattggctagtcaataaaataatgttttcttctgtattaactcatttagtggaaacaagttcagggttggccagcctacatgaccaccttagtgaaatcctgaaatgtgttattgttttctcaggtaagtattgagaagcaggaaatttttctttttctgttttgttattgttgatgttgttattgctgttcttcatgatgacatcaactgacatatgcctagcattctgtgtactatgcagggaaactaattcagtgtactatggagagaactaactcagaaaagaatgagaaagaggatactgggaaagaggaaaggaggaaaagtcactttgtaatttagtataatctaagtaccaagactgtatttctgttcaaaacgaacaacaaaaaaggtgaaaggcattgtctgtctactggaaaattctaagtttattaaacacaaaaattcccttcctaagagatttctgagattccctattttggccaaagttatacatgatgatgatgattagcacacaaagataataaataatgaagaaatcagtgaatatgacttaatagaaatgtccttatattttaagacccactatagcacttactctgctgctaggcactcctctaagcatcctacaaattttaattcatatcatacttgtaacaaccccaggagatgcattctattattatccaatcttacaagacaagaaattggaccaaatagaagttgtttgtccaaagctacatagctaacaataatatagtcaaactttaaatcaagcattctggcttctgagactatgccttaatacccattaaccatgctgcctcaatgtgctatttagcagaaggtaagcctgcttacattgtcaggttgatgtacctatattcggctcttttaagttgtattggtagtcactcaatatttcagatagtctattggggcttctaaaataataatggtttgctattcattaataattactaataataagtcaattattattttagaagcgatagtgatccattattattttagaaggaatatttgattttttttagtagtttaggatattggcattaaatctaagagaaaagcctgaagtaaaggcatggctccaatttttttttgtatttatggtaatcctacaggttgttaccttacagacttgctcaaaaaaaaaaaaaaaaaaatccatcaatgagcccaaaacctgaggttgtggatgacctttgatttaagggacttgaaagggtctccagatcaccatcattgaggtaacacgttgagctttggagacagacaaatttgaggtttcattctcaccttaccatgtactatctttgtatccttaggcacattcttaatctctcagcagctaatgatttttagttgtaaaatggaactaataatgtagtttcttggagttgcttggagaatttacatatgatgccatagtaaaagctcaaagagtgttagttcctttcctttttattgacaatatcatgactataattatattttcaagtaaaatgggtatttcacaacacgttatctctgtctgcaaatttctgcaaataactttaagatatcaaagatttcgtgaaattgaacatctttgagagagagaaagaggataaagtagattgtcatgatcctaccttctacacctcaaatctccaccactagatttgacttaaacaaaatacagaggacattatcactagaaggctacattttaaatgtttgggtttcagctaggcatcattactcacacctgtagttccagcatttggggaggatgagacaggagggtcacttgaggcaaggagttccagacaagcatagacaacatagcaagaccctgtctctataaaaaattaaaaaataaaataaaatgagtgtctgttagcatttcaaacattaattaaatatttcagattatttaggtcagtaaatagtacatttccccctgcaaagacacttgtttcccacattgaccctcatatcgaaagattccatctctcaagaaaattgagtttatgtagtaatacttaatttaactcccattttcattgaaatcctatatacagatatagtcaagtttcttatcagcatgaaaccactagtgtgctcacacctaattgataaaattccaacccaaagcaaagaaacttaacatattcactcatctttattgtcttattgcaagctaattgttgtagactgtaaaactattcatcaataattagttcatatccatgatggaagattatatttcccagtcctgttaaattcaggtgtggccatatgacttgctttggccaagatatgaacggattggaatatgttaattccaggtgaaagttttcagagtagtccagagctgagacctgaaggattaataaatattagccaggtaaagagaagagaaaagctattctagacagaggaaatagcatgtgttaaacctggaagagattggcaaacccaagcctttaggttagtgtaattagagagactcctggactgcagtagtaggaaagaggtaagatggtacaaatttgttcgtcatatcaaggactttatattttttagcaagtgcagtaggaatccatataagggttatgagcatggaagtgacatgatccgatttagttttgtaaggagagctcagggttttgtacacagaacaaattggagacagagatagtggaatctgttaaccacataaaagactaacatgattatccaggctggaactgatagtggcttgacccagagcaatggctgtggaggcgcaacaagagggtagattttaaatataactaggggaagacttaataaatgcctaatagacttaatgatagatagaatgtagaaatagaataatagggagtcagaaggatgactttggggctctaaattaagtgactaggtggaaggagactccatttatggtgacaaggaaaacttgcagatgtgcacacttggagaaggagagcaaatatatttaacctgagaacataatatggagatcccactgagcaggtgatgcttagagaagtaatctggacaggtaacagattattagattattagaaagattattataatatgattattatgatggaattatttagaaagagagtagaaaaggagaagagaatataaaagcccctgctatccaggtctgagtaactctaacattcaactggagagaggaagaggaatgtgataggaagactgagaaaaacagagttttaataaatcgactcccactggaaagcacttaattgattcttcagcttgaagatataggatgggtatattttcctaaaagagagcagccatcagtagattctgaatctgggtcagtcaggagctactgactgacctcaggggatgatagaagagggaaggggcacagcttctttgctaagcgttggtgaaacttcagcttcttcacagttttatttaaggccaaaccatttctttattttctacggtgtttcctcaaaaaaagacactattgtcactctgtatgtttgcatttaacacactagtatgtttaaactgtgtttatagtcttctagaagctgtataaacaatttgggtcccgccacaaactaggtacaatttcttcaactatagcctagtggtacaagaagccatttccatgtaaaaatcattgtttttgcaccccctcatcatgccacatagattcaggtgctttcaccttcctcaaactgcagggcccatgttacttatagctgcaaattggcccactggatataaaaattcctaaaggggagaaaaaacatgggattatcccatttttaaagggataactatttagacatattgtccttggtctaatcactcacctgtccctgacttgatattaggtactttaagggactcctaatttgaaggaaaagttgccactatccaaaaaatgatgccgtttctctcaccccacccggctaaggtgagagcacctggtaaccaacttccttcagtacatttatcctccagagaaatttgcctaataaattccaagagcttaacaaatactagttttctcattttctgcctaatgcaagcttagaactcagcttccggttgacctgattactttcctgaattctaggccctttatcaatgctaacaataaaggccagtctcatatctactgttttatttaatagtcacaataaccctataaaattcatcttcataaaaatgccaccctgcctcttgttcaggcaggaattttcttgaaagacaaattttaagttacccttgattgaggctttagaaacaatagtcatgcatgacataatgacatttcagtcaacaaaggaccatatagaagacggtggtcccatgagattataatgctgtatttttactgaaccttttctatgtttggatatatttagatacacaaataattgcctagagtattcaggatagtaacatgctgtacaagtgtgtagcctaggagcaataggctacactgtatagcctatgtgtgtagtagtctataccatctaggtttgtgttaagtttactctctaatgttcacacaatgacaaaattgcctagtgatgcatttctcagaacatatctccgccaagcaacccatgactgtatttcagagctcatggcagcaacctcacgttccaataagctacgcagaaccctgggtagtttttgggaactgacttacccatcttctacaatccggttagacttagctctctaatccatctagaccagctattttctttggtcatttctattgtctcaatcacttacgttaaagaaagtcttttagagatgttaatcaggaagtgctaaccaggctgctggagttgctgtagcgccagcctcagatcttttgagacataaagtgtatagatacatatgtgcgttacttacgttcctgtcagtcaactggttgtctcatcatcttcagaaccataagacataacctaaaatgatgcttgaacttacttcttaaaatctaaaaccacatttctcacatagtcatcacacatatatttctaataggatagtacaatacagtgataattcacctctctgtatagtctacttgggggggcaaggatatttaaatttcaatggcctgaattccagtcttggttctactatttttttttttttagtgatcttaacttttttgagcttcagttcattttttcctcttctgtcctacttacctgcaaggagtattatggagctgaattaagataatacatttgaaagcaataaagagtatttttcatatctggttgataataatttaatgactacatagtttcaacaaaatacttctatatattaaggctggtttcagttcctgtctcaatctcattttgcccacaaagaagagaataatcaagattagtggttcccataactaactgatttcacctgagaaactatatatatatatacatatatatatatatatatatatatatgtatatatatatatattctcagactctacttaccaaggttttgactcaatggaccaagatacagacccaggagcctgtattttttaaatgctcctcatgtaaattgctacagctttttggaggaagatggcaatgagtgttaacatttaaaatatacttaccctttaacctgataattttacttcctgccagcatacttcaacaagggcagaaagatatacatgcaaatatgtttatcatagctttgtttatactaaaaagacaactttttatcaacaggagactaaataaatgatggcacatttatacagtggaaacttaggcagttgttaaataatgaaatgctggcattaacagatgtccatggcacacattattcttaaatttttaacaagcaaattaaacaacagttttatgatctttttgatgaaatgttaaaagtgttggccgagcacagtggctcacgcctgtaatcccaacaacttgggaggccgaggcgggcctcctgaggtcaggagttcgagaccagcctggctaacatggtgaaaccccatcactactaaaaatacaaaaattagctgggcatggtggtgcacgcctgtaatcccagctacttgggaggctgaagcagtagaatcacttgaacccaggaggcagagcttgcagtgagccaagatagtgccattgcactccagcctgggtgacaagagtgagactctgtctcaaaaaaaaaaaaaaaaaagtgtttgtggtgtgtttgttcatgtgtgggtgtataacagacacacattgaaccactaactatggccaaatctaggaaataggtttgggaaatagagcaagggaaatgtgagattttactttttaatcaatacaattaaactttttttcttacagttatgattcacaatcatctacatttttattgtcaatgtcatcacttagcagcttccttaaattgcccccaaatataccctgaacactaatttcttcattcatttagcctatgaataaatatgagtagttatgcccaataagtgccaagtgctgttccaggcactagcaacaagccagactacaagctttgtcctcatggattaagcatcctaacttttctgagccttagtccttccatctgtgagactgatatattactctcatagagtattctgaggatgaaattaaacgatgtgtgtaaagtacctaacatagaatatagcaccatagatgtgctcggttattgtaagctacaatacaagcatatgtggttttactgcactttgctttattgtgtttacaaattgaaggtttatgtcaaccctgcaagtctatcagagccattttccaaaagcatgtgctcactgtgtctctgcatcacattttaataattctcgcaatagttcagactttttcattattattgtatttgttaggctgatatgtgatcagtgatcttgatgttactatcataattgttttggggcacaataaaccgaacccagagaagatggcaacctcagtcaataagtgttatgtgggttctgactgccccactcacggaccattcccctcatatctctccttctcctctggccctcctgtttgctgagacacaacattgaaatttggctaaataataaccctacaatagcttctaagtgttcaaatgaaaaaacaaaaagagtctctttcatttgaacacatgtctctctcttgaatcgaaaactagaaataattaatgaggaaggcatgttgaaagctgagataggccaaaagttagttgtcttgtgccagttagcccagttgtgaatgcaaaggaaaagttcttgaaggaaattaaaagtgctactccagtgaacatatgaatgataagaaagtgaaacagccttattactgaaaatggagaaagtttaattggtctggatagaagatcataccagccataatattcccttaggccaaagcctaacccagagcaagatcctaatgctcttcaactctgtggaggctgagagaaaagaggaagctgcagaagaaaagtggaagctatcagagattggttcataaagttaaagaaaagaagccatctccataacataaaagtgcagggtaaagccacgggtgctaacatggaagctacagcaagttctctagaaattctagccaagataatagatgaaggtggctacactaaacaacagattttcaatgtagacgaaacagctgtcttagtctgttttgctttgctataaagaaatacctgagactgagtaatttataaagaataaaggttttttggttcatgattcttctcgctggaagattgggcatctggtggaagcctcagggtgcttcctctcatggtggaaggtgaagaggagctgctgtgtgcagaaattccatggtgagagaggaagcaagagagagagggaatgtgccagactctttttaataaccagcttttgtggaatcaataaagtaataactcactcatccccaaggaagggcattaatttattcatgaggaatctgtcaagataacacaaatatttcccattaggccccacctaatgggaatcaagtttcagcatgagatttggaagggacaaacatccaaactatagcaattgccctctattggaggaagatgctgtctatcactttcatagctagagagtagaagtcaatgcttgacttcagagcttcaaaggacagcctatcttgttaaggctgaatacatttggtgactttcaatgctcatttaccattccaaaagtccttaataattatgccaaatcttctactctgcttatactctataaatggaacgataaagcctgggtgacagcacatctgtttatagcttggtttataacacattttaagcccaatgtggagacactgctcagaaaacaagattcctttcaaaatattactgctcattggcaatgcacctggtcacccacgaactctaatagtaatgaacaaggagataatgttgttttcgtgcctgctaacacatttattctgtggcccatgaatcaaggagtagttttgacttccaagtcttattatttaagaaatacattttggctgtagctaccatagacagacaatctgggcaaactaaattgaaaaaccttctggaaaggagtcaccattctatacaccataatcttcaggattcatggaaagaggacaaaatatcaacatcaacaagagttgggaggaagttgattccaatcctcatggataactttgagggagtttaagactttattggaggaagtaactgcagatgtggtggaaatagaaagagaaatagaatggaagcggagcctgaagatgtgactgaattgctgaaatctcatgataaaacttgaacggatgagcaaagaaagtggtttcttgagatagaagctactcctggtgaagatgctgtgaacactgttgaaataacaaaggattttgaatatttcataaatttagttgataagacagaggcagggtttgagagggctgactccatttcaaaagacattctactgtggataaaatgctatcaaacagctttgcatgctatagagaaatcttttgtgaaaggaataagaattgatacagcaaccctcattgttatcttacttcaagaatggctacagccactccaactttcagcaaccaccctgctgatcagttaccagctgtcaatgcttgggcaagactctccactagcaaaacaactgtgactcacagaaagctcagattattattagcatttttagcaaaaatatttttaattaaggtatgtacttttttaggaataatgctattatatttttaatagactgtggtatagtgtaaacataaattttgtatgtactgggaaaacaaaaacatgacttgctttattacagtggtcctgaactgaacctgcaatatctctgatgtatggctgtaattgttattgctgtcatcatcaccatttttttcatgaccaactgctcgatccagtgtaggttttctggggaaaaaataaatttcatctcaagaacgttaattgctgaccttgtaaacaatgtgaactacatttcctttactgaatcacagcagacttagaaaaaaagagagaatagaaatcaattcaatgagagaaaaatgttgccttctatttatttaatacatcccttagctacagaattcttatttcctcggtttaacaaagtagattacacagcagaggctgatgcacatttataaaaatatatgacattttgtttatgtcagtggggatgaggaatcttttttttttggagataagagtaccaaagggcagtgagtggccccttaatcctaatagcagatacttccatgagtgaaaaccacagttaatgaagctctgaaagtgaacctctttttacatttgtacttgattttgaaacatgcaaaacatagttgaagccagtgtgagcttctctttcgtaaggactcagaagctaaatatggagccaagtttaactatccaattaaatgtactgtttacaaatgaaaacaattatattttcaattaacaggaagatgaaaaatgcaattactttagctatggcatattttattttatttcttttttgtttgtttgtttgttttattttgactttgtgctgcaggcagagttaattaactctttcagcaaaggaaaagaaaaacattaaacaatgattatgtgtgaatttcctggagtgatcccagttaggtagcaggggcttgattgtctgattctgtgagctctaaaagaaaccccaaggtaaatagaagtactgcagatagtgtaaccatgagcaacaggtatttttgtgtcaaaggaccaaaaattgtccttgtaagtgtataggtctttggtatattctaaaagttaatttttaagttgagaaagataaaaggacaagtggtatcctgaagttcatgtgtcataaaaattattttgtggtagaaaggctaagtcactaaatattcattaagaaataagtgttgtgtaaccatttatctaatcattgtactaggaaatagctacaaaagtaaataccataatacaatacaatacatacaataaaactgctcttaatgagtagttctactgtaatcagagtcacatgaagccatgacataagaatgctttatttcatatatcttatttcatggtaccctagctgggttactctagtaacttggttaagcactagtttcaaagcaggatggtcaattcttccaacacatacaggccaatatagattgttttttcctacaaattcttgaacttcagattttacatttggattacagtctttctcaagaacaatcattttgcaacatgttttcattcctggatttgatcttagtaggactaccaaaatgcaagaaagtacaaaatgttaaaaaagaaaacctcaaagcattttggtagtcgtatttttatgtttgatatgaacattatttaaaccaatgaaatacaatatattgcaatacaatatttcaaagtagcatattcttttaagagatttcctgttacatagtcaggctatttaatttgctcagtataatgattaaaataaacttttctggtgataatgtctattgtgagtattctaattggtccactctgattgtcttgaaaattccctaagaaattaactcttttttatagatataagtgttttggcaaatgtcacagattttttacagaaggattagagaatttttttcactcttgtctttttggtatgtatgtgttttatataagacaagggtgtattccaaagctacatctagcaaaatttatgttttagtgtttcaaaaaaaaatctgtgccatgacagtcattagatctgatcatgacacttttgaaatatttagccaaagtcctcttattccaccgaaacacagttggaagcaattatttaaaaccacacataatttatctggaggttttaaaacatgcctttgtatataaatagcttttttcttccatactgctttgcttagttcaactgtgaaggcaattaatttttaaagagttgaaagaccgttccaaaatacatttatctctgctgatccctaaaatttttctgagtgaaccaaatacctaatagactctacagataactctcttgtgtagctcttatctcagccataatgttacattcgtgtgattatctaacaaatgccagtgttccctctgcactgtatgcttgtggagagaaagaccatctcccattgcttgttattgctctctagcaccatttcagtgcctgtagttgcatgtaaaaattgttcaatacttatttgttaaatgaactttatgtaatgggggacactttgtgaaaagtcagtaatcactccttgacttagtttcactcttttcataaagtctaatcatatatacacaaaaactgttgtacatatctattgttcaagtagggaataatatgtaaaatgtttttagtcattcagtaaaatcacatactaaaaatcaatgtcaatttggttttttttttctgtcattgttgatttgacagaaaaatcaatgttgatttgttttcccccccagtggacagaaatttttcaagtcaaaaatttattaaatactacctgttatttgaaatcatttcttttaaagacattcaaaaaattatgacatcttattcgttctcacatcgtcaccatgagataagtactatttttcaacttgcagaggaaatgtcttctactcaaaaaaagaagactatttggttatattggtttctagattaataaatgcccttggatatataacatctaacaacttaaggaaattcgataaacatttagaaaattaataagtataaaaagtgttatgacccaaagcatagtttatatactatcaagtaaaaatgagctataaaattaaccataatttcacagaaaagagtatttgtttggaagtctaacaaagttgagacattatacagagagacactgtatgggtcgatatctcaagtaagccatcatctaagaaccttgcaaatgatccatctgaattatatatatgatccatctgaattatatatacattataataaattataaatatggccaacagttaatttctttggtttttctaagggtaagttaccccagtagacagtaatatcaatagaatgtttttcattcagaaagattcataagactccacaaactgaaataatagaattttggaacaagaacctctctgcatcactcagacgactccttggagagttttaggaaggccagttgtaattagttgaaacttgtctttgaacaggcgtctagagctatttcttctagtaagaaaaacgcctgaaggcactaagtgattacaggaatcgaaaccaagattttacttaaaggcatgtgtgtaacatatcatgcgtactctcctcaaaatgccctatggatcttttttcttttctttaatttaggctccccaaaaaaataatgtgtgccaaatgatccattctacttcttgccaggtctggcatgatatgaagcctgacagggacaataaggggacaaagcaaggaggagtactgaattacttttcttgctttttttttttatgttaaggaacaagcccaaagaaaaacatagatcattgtgacaaatgcattgtatctttataattcattgtagttggcaagaactcctaccaagtaataaatgttaagcaaaccagagccaccattgcataggtaggggtattcttccactacagtcacatcatttggcctcagctcaaactactgactttgtcttgatgattttcttcattgcattagtaagttagcaaaagtgggtgggggtggggatccctgctttattcctccttcactgtgtgtgagcaaatgcatgcatgggtggctgaggtgcgggaaagaagaagagagaatatgcagaggttaggggatttttaaaaacatgtaagttttgttttattttgttagtttaaatttgcccttaggtattgttcaaaatgtcctcatttcctttatgacacaagggcttttagaggaatgactgaattaaaagacagtttataaaagttgcaagatatagggaaatgattgtttacaaaataaggcattgatgaggaaggagacagaagtgttgctgggatgactcttcaaggggaaagtgaaagttcagtgactgacaggaaaacaatcatagcttctgtgcttcatagagctggcctgccactcattgcccctttttcactctttgattcaaacatatacaggagggagaaagtggcattgagcctcctccagctgacaaaggaccagagaggcaaaccgaggctgttagtctaccaccatgctattcataccatgccctctcctgaaatgctcatacacccactctctacatgttataaacataaagccttagtcaaatagccacctccgctatgacactttctttgaccacttttgccaaagtggcgtcatccccctctacagagctaagtaatgattctttaagaaaccctcacaatgctttttgctctccatctcttagccaaaaacaaaacaaaacaaaaaagtctttggttgtttaagctaacacaaattacttcactcccttatgcctgagtttctaaatatagaaaaatggagataaagtcagtaactacctcacagggtgatttcgagaattatataactgaattgctacagagtgaacaatgcaggtgaagagataggtgctcaataaatgtgagacatgttaactatcatgactactactgccattggtgagcacacattatatagttccctttcttgagctttgctttttattcagcaaattgatcgaacgcatcctctgtgcaaacaactgtagttggtgctacagaacacacaaaatctataagacaccattacctggcctaaggagcttgtaatcctttcaaagagataaaacacattactttagtgttggaacaaagcacaaaattataagaaaacttccaaggaaagttcaaaagatggatcaattagtggtttctccaaacctgctttagtatcagaatccccttgggaaagtgctgtttaaaaatatagattcccagacaccaacccaaaaatagtaaataagaatctctgacttgtagccaaggaaattcaagtgattccaatgatcacccagtaggaaatccctagaatagtcacgtacaattggaaataaaaggctttctgttaaaaggtggtcttggccaggcgcggtggctcacgtctgtaatcccagcactttgggaggccaaggtgagtggatcacaaggtcaggagatcaagaccatgtgaaacccggtctctactaaaaatacaaaaaattagcagggcatggtggcaggcccctgtagtctcagctactcgggaggctgaggcaggagaatggcgtgaacccgggaggcagagcttgcagtgagctgggatcgcgccactacactccagactgggtgacagcacaagactccgtctcaaaaaaaacaaaaaggtggtcttgaccaggcatcgagacacattttataagagttaggatagaaggaagaaagagtggtgtcacttaaaagagatgagttagttcctagccagtgatcttctcaataaggatgaaatattatcttctgctaagaatcaaacaggtgaaaatacagttcaaggtttgggaaatgtggagaaagttggaagagttgtaacatgttttacagggataactagaggtgaattaaactgagggtccattatgctacaatatctctcactgcaatttccaaggccagtttatacctaggctagggtcattcttcttaaattcccagaagcttatataaatgaaaatgcactgacattatcaataaaagtgaatttttaatatcactgacaataggatcattaactattgtgaattcttcatgtctgttaacaaccttgtttcttttgccaagtataaaatttcaaatttgatctcatgaaaagtctaggagtcagattctcataaataacaacagatctatccatttgctctttgttgatctgtagctggcatctgaatatatgaattcccctagggtgagaatgagactctataattaaagttaattggtgttgcttttcacctgtttttcttcttggtgagtgaactcttttattcctctcatttttccacatcaaattctcagtattgcaatgggtctcccacagttccaggcagtttctggttcttggggggaaatgctcctgtggcattattgattgcagccttcatgagaaggacaatgatttactgtgttgcttcctgtgcagctgtgaatttgctgtacagtgacagggccttccgtggcatcctctgtctcaacttgacaggagatctggagagtgagctagctgtattgaaatgaaagtgtcctcaccccaaatcacattctgtccctcaaactaaacccaggtcagtgagaggttagcgaaaacacggttaagaatgtgctaaagggtgatactgaaattgaggctgtccccactgtcttctcaaggcctgtaacccggcttgccctcctaaaagcttcatgctgtcattccttgccgcctccttattttcctaggctttccacaactgcctgctttcttacccatactcccaatactgcatgctatgattttggggaggacacattcaggccattgcacacctgaacattctttttttttttttggctagagtatcagaatgggcacttgaccttaggcagcactgtgtttggacttatacattgttcatgtcaatgtttggttctaaaaggaaaaactgaaaacctattgcaaatggactccactgtattactgtggctgtaccacattagtctttataatgattataacaatagctgcctggtatggagaacttaatatataccacataatgtggtgaacactttgcatatacaatacaatttaagataaatattccattccagggattaggaaaactgaagctcagagggatcatgttatcttgccagtacatagtcaggaagtaatgataacagaatttcacccacgttttcctaactaatactcatactgttcttttatttatttatttatttatttattttgagacacagtcttgctctgtcatccaggctggagtgccctggtgcaatcttggctcactgcaagctccgcctcccgggttcacacccttctcctgcctcagcctcctgagtagctgggactacaggcacctgccaccacgcccggctaatattttgtacgtttagtagagacagggtttcactgtgttagccaggatggtcgcgatctcctgacctcatcatctgcccacctcggcctcccaaagtgctgggattacaggcatgagccaccgcgcctggccaatactcatactcttaactattacattctccttttccaaaaatctcagtcctttaattattttccctgcttaaaatttcctaaaccttatccacacctcattatcattctttgacttctctttggtcataaattatttattatgtgtatccttccatctatctgtgtacttgcacattgttttgcaggtaaaatccatattgtccatttattttgtgctcactcaacacctggtatatcagtgttatgcttttggagtctttggaaccgttagttttctatatggatcataccctgacttatcataagtggaagtgataagaatggcctgggggtaggacaagaagggagagaaaataaatagttatcactgattctcagagggatgccgagactaaactgaccctaccatcagattgttagatatgatcttcttgaatgctgtttgctacacctcctatctacatgcctacaggcagccttcacccagagctaaaagaaagtggaatccaaatgtttaaaaaatatttatttagaagcttaagaactctacccaaagttctcaggctaggattagtaacattaggttgtaatgtccactcttctctttcttccatactctgagatgttctccccagtaccagcttatcttgttatgcatcttagaaaaattctttttattattattattatactttaagttctagggcacatgtgcccaacgtgcaggtttgttacttatttatacatgtgccatgttggtgtgctgcacccattaactcgtcatttgtattaggtatatcttctagtgctatccctccctcctccccctaccccatgacaggccccagtgtgtgatgttccccaccctgtgtccaagtgttttcattgttcagttcccacctatgagtgagaacatgcggtgtttggttttctgtccttgcgatagtttgctcagaatgacggtttccagcttcatccatgtccctacaaaggacatgaacttatcctttttatggctgcatagtattccatggtgtacatgtgccacattttcttaatccagtctatcattgatggacatttgggttggttccaagtctttgctatcgtgaatagtgccaatatatgaaagtccctggggaatcttgagagccctttgggccagcatcaagactcactgagctgtaatttagtgcttaatgccataaggaatttggaatcaatttttatacagtcatggatcacttagtgatggggatacattctgagaaatgcattgttaggtgatttcattgttttatgaacatcgcagagtgtacttacacaaatctagacggtatagcctatgaaacccaggttatatggtataggtgtatttcttctagtctacaaacctgcactgaagactgtgggtaatagtagcacaatggtaagtatttatgtatgtaaacatatttaaacataaaaagataaagtaaaaagatggtgttataatcttatgggaccactcttatatatatggtctgtcagtgaccaaaatgtcattatgaggtacatgactgtaattttctgtaatgtgtgttgcagctcaggcactactgggaatattgggtcacagtacaagtcctcttttttcatcacaactacagaaaaattacttcaaaatgcatcaactattatctcatagagtgtagcctctcatagaaagaccataagagtaataatatctacaaagtggatctgttctcacgttactcttctttctatgacagtatgtccatttgttatatatggaatgccattatttgcagtgatctatatagcttgagttttaaatcagtatacttttatcaaacggtatacctttttgttctcatctagaaacaaatagacagagtgtagtatccagtattgcttaccaccatatacaaggtaaagattcaccacaatttaccaatactctgagcaatttagttgctgacaaatataactggctattcaaacatgggtaaattgcacttctacaattattcattagggctcctataataagtatttcagatgcctacttagctgggttgctttcatttctaattcataaaggtttaaaacagatttgagaagctgattatgcaagggttggggtaaagtggagaaatagagggctttgcaactgcctgcattttgtacatacacatttacagtattaccagacctatttctgaataaagagaccagcctcttggtccctctgacaattgttatcaggactgaatggcattcagtttttatcaagcctcttctctgagttattgaagcatcccataatatcatcaagtaagtaaacgttgtgcatgtagctcttgccattatcatggaaaatagcaagtagttctcatgaacttgcacaggaatggtgcaagtaacatccctttcataacagcaacgtatccacaccatttcatttgtctagccacatagacacatagaaaggtaggctattccttttatatctattggtaaattttctttcgaataactgctgagaacttcactcctataagcagttggtgctgctggttgaagaaaatagatacattatctaaagtaatagataagtctcattaagaagatggaatagactaattcccagcatatctcccatgcgtgggaaaactaaattgtgaagtagagcagtaacacatcaattatcctttctgcacggaattagacgagcctcactgctactttgtatcacattatgtaattttttataaataactatttatgtcagatcacctcagtttgctgccttattaaaaaaagatagctaacacttctagcttactaatcagatttattcctgaaactacttaggaatccaggtagtctatttaaaatttacatgtgtacttaaggaatccttattcctactaaggaaatagtgttaacatatgcccaaagaggtgatgttttatattaacctaaaaataaaatgctatacatttaatgatgttacaattttaacgaagatcggcttctaccaactaaagtgaagctagctatcaccatttagaacaaagtttttgaagatcttgtgttaaataatgacataatcagtttaagtagttgatcaggtttgccacatcaagttatcatatgtgaagtgctagaaaacaattcagtttcttcagtagtttaaatctctcttgctttttgtctacatagttaatctttattaacttattatgttcacaacacaggagttaagttaatgaaagcttgtatatgaagaatttgcttgctaaagtaaataataaaatttggtacttacctgttttaatttattgactgtgtggtaaaaagtgaaacaccataatgacaatagaaatgctttgcaaattatgaagtgatatttttaaaaagaaggatataacatttatatgtatcctagtttttaaaaacatcttacttattaacgaggagaagaagaagcatacattctaaagcttctgggtctaagattagtttcactccagatatgattcagagggagaaggaggaaagtcagaaggaacattccaaaattggaaaagtgctaaaagggaaagtggcccctaagtgacacccatcactctgcaatcatgacattgctgctgtgctgcgtatttcacaatctatgtttcttagtctgcccaggctttccaaacaaaatgccacagactgggtggcttaaacaatggaaatttatttctcacagttcttgaggctagaggaccaagatcaagcaaggtttcagcaaggtagatttcattctgaagcctcttctcttggcttgtagggaagctgccatcttgctgtgtgctcacaggacgtcttcttcatgtaaagagagagcaaacatgatggtgtctcttctgataagagcactggtcccttcaaatcaggtccccattctcctgacttcatctaaccctaattaccccccaaaggccccatctcaaaatatcattacaatggggcttagcgcttcatcatataaactttggaggggcataaacattcagtccataataacatgagattgagtgcttttgttttttacgtccatgacaaatcaagttaacaaatatttattgagtgaatacagaaggaaagtcacaatgcttgtggtgtaatgaataggatgaaatacatattttaagattcctgtcctcaaggagttgatagcctgattgagaatataagaagtgcatcagaagaaaaacatgcatcaaatataaataataattcagagtgaaaacagagacgtctcaaggcagtgtatggttcaatactaaatgggcagttctcaggaacatttttgcagaggagatggaatctgagtcctgagagatgttcttcacagaagcatgagaaaagaatgccctcttgtcattcacttattcactcatatttactaaaggatattatgtgtcagaggttagaaatacaaaattaatagtgcatagtttagtatctgccctcaaggaggctaacatccaaaaaaaagaaagaaaaacaccactaaattcaagatcaagtctcaactccttaaataacttacaggccttgcttctccagcgtggttctggttctccccatattcatgctcagtctcagggaactccgttcgtcttttcagaatgcctgtactttcttcctgctggacttttgcacaaactgcttcctctacctagagtactcttttcccaatctccatgccatcacctgttctactaattcctaatttctcatctaagacaacacttactccaaaatgttgttcctaaactgaccatccttctaaaaccaaggtctggtgacctttgcacggtgccttctcttgtgctgccccattccgggcatgtgaccaccctgcagtggaactatccagtactggaattggaggttaacatccaaggaacagttttgggattttttcctccatttataaaaccttagccagttgcagtggctcacgcctataatcccagcactttgggaggcagaggcgggtgaatcatctgaggtcaggagttcaagacaatcctggccaatgtggtgaaaccccatctctactaaaaaaggcaaaagttatctgggcatagtagtgggtgcctgtaatcccagctacttggaaggctgaggcaggagaattgcttgaatccgggagacagaggttgcagtgagccgagatcgcaccattgtactctagcctgggaaacagggcgagactccgtctcaaaaaaaagaaaaagaaagaaaaagaaaaaggaacctcatagcgtatttggattcatgatggaaagaagtttgcaggtagaattcactttttaaaatgtctaaaatgaagagaaactgttctcctgtgattctaggccacctcaagagaaggttatgttactgtctaaacactctactaaaaaaagaaaattgaagcacttcatttcagagctgtaataatgctaaatacaatacatctaaaaattaaaatataatttaaaaaaatagtttagacttcccatctatgaaaatgtgggtaaaacagtaatgttattttcccacagttgtactattgttgatgatctaactcactcctggctgagagtttttattatgtgcactgaatttatccacaaactgtaatacaaatatgctctgagttttttaaaatatgtatcagtgtacaacctctaacttagatgttgtttgcatcataaaataattctcccgctattaaagcctactagagtagttctcagaataatgaattccttccttatatttaaattattattcaactttttagaagtttagaatttgtgcaaatgctaaggaaaatgtttgtctcttcaaaaagtatccttcttaatcttctctttcctaagagtatgtcaaagctgcatatcacaatctttatccattttacaaatagcatacaactcaggatctcacttattttaaaggttaattgtcagactcaaggatatgaaaatatacataaatgcataacatatatactatacacaaagcaaaataagtttgactttatgacaccttttcataaacatgcatttgaaagttttgcataagaaaaatgaagagtgactctaaacagagatgatcgttgccagtttctcactgcagaatgaaatattttttctcctttaccctataacccaaatatcacactgagcttaaggatgaagctgacattttaaaagatcaccaaaagcgttctctttccaattgcaattatgccctctatctcagtgggagccattgtctgggtcttctcagctctctagcatctttctggcttgctttcattaccctgattatctattcatttgccgcccagtactcattttatgaaagatcatgtctgccatttctgtaatgagtgcttgacttttactgccagcataaacacataaaatatataataattaaagttcactagtcaccaaagtcttgagatccgtcatgttgctaatttgattttttaagcaattgcttctccgcgaacagggctgattttgcccccttaggcagtgcaagacttatggttgaaggagatgactctaacctagagagatcaatttgaatgggcaccatatatttcaaatttaaggttcattttctaccaaataacatgtctataaattatgatgggtcttagagccaacaaaaatttcatcaaaatttgaacataaatgttgttctaaatgttaaagattaaacaatgtgcttttcaaaacagttaaatgttatttaattgtgtagcttttatggagaattgtttaaactctaagaaaaaagttaattggaataactacaggagcctacacaacacagattggaaacttcacaatgtgttgacttacattaagtaaggacaaggttccagaacaccacttccttattttgaacacacttccttgttctgataacattggcaaagcaccctaagtgccccatgataatgaattcatctgacctttaatcacaaagcgattaatgaactcatgagatactcatgtggctctctggggacataaagatgtgtcatacaaagtgtaatgtttgtaaatggatacagtggaacacgtgttagccaagggacttgagtagcagactctcagtttataaagaagcaggaaataaagaggtgcttccatttatacagattttctttagagataataaagatcttgatggtgtattcaaaaaaagcacagaagccagaagacctgagtttgaaagcagaatgtatcactttccagccatgtggccttgggaaacttttcttcacctctgagcctcaatctcctcacctgtaaaaggagaattagtaatatcagacttcctaaaggctgttacaagagtaagaggtacagggtcgaagggaggaggggtttgaagtgatcaatcagtcaatcaatatcattcctccctcacaaggttaagaagtaaatcaaataatatgcactgttttgaaaaggcctttataaactgcagcatcatgcatgtgtttatttttgctattcttttggaaaataggtactctgaataaagttcacagttgtttctttttccccatacacagaatggatgccttaggaagacactagtaactacataaggacatagacattgttttgtgaataaaccagatctgaccgattaagtactttatcaaattacctttttcaaatttgaaagtaacatatcaggtttgaagcaacacaggaaacttctctttttaaacaggtctctgctctgcagcagccttcagcaataactgagtttataattaaatccagcctgtgtattcagccctgcagtggggagctgggcagaccacttcacctcaccggcaggagttaaatgtgatcccatctcccaggtccagtactaacacactgtcattctcattaagcatgtgtagtaattctttaccaattctaaaaaactactaattaatttacagtacttctggtcacacataattaaaaaccattttcatatctttgattaaaagagacacaaccttttctgcctcagttcattgtcttacccgttcttagtaaatcataatcacttccctggaatttctttttttaggagtgtaatatctgctcatatcgccttgacttcaggctcaagctcccattgcctagaaaatgattcaggaaatacaaccctcagaagacaaatactacctcatcttgaataagtgaggcagtcatcttttggaacatgggcacttccaatctcagaataaatgctcagatatattttacaatataatcagaaaaccaaagaaattcaaaattcacttgaaggattatgtggccattgttcatatacagtgcatatgtgaaattctctctcagcgtggtgaaatgtggactcaacacatgatcactctgtactcatttaaagatgcacatgtcataacagatattactacatgttaatacatattaatacactattgaaagagcactggaataggagtcaccatctctggttctaaaacggactcatactttccaatgattggacttgctatatcacttaagccacctcaacttcaatatcttcatcagtgaaatgagaacttattggcttatagagttattttctctgaggtttccaaaataagtcagaaactatagccagaaggtcattctggcagcttgcctgtttttacaaataaagcccacttgtttacttactttctacggctgctttcacactacaaaggcagagttgagtagttgtgatggacaccatatgggccacaaagtctaaaatattggctatctgacccttaacaagaaaagcttgctgacctctagtctaaaagatgatagttatgaatttatttgaaataccatgaagtactattaacctatatgatagaaactcttggtggattgaaattaagcaactgccatttggctcaactagctagaagaaatagttaaaagttcaatttaaacaaaggaaatagctcctaatagtttcccttacactatttgatattactgaggtattagatgctatcaataaatatttgttgcacttaatgttaccaactgatcactaagagattttgcttaagaaaaataatcgattgatgattgattcacaggaagttgatagaattgatttttacaactctgatatgcaaattgtaatattagatatgccaatcaaagtgccactatgcttaattgtttaaatcttaatctttgagaagtgcttctgcttcgatgcaagattacctacgttttccaaagctaggatgaaaaaattgatgaatgaatgaaaaacctattgagctaaagttttttctgaaaatcatctgcatgctattattaatactttctcagtaaccatggagaggaaaattttgtgaaaacccagaaaatgaatttaataatgtggatattatgagccaaaatagatttattcagtgtgtgaaaaaaataactttttttcagaaatttcaaaatttctttctcagtgataactgacattaaacagtattgagtaatgggactctctcctaaatatctttttaattttggttacataaaactcataagtaggtactgataaaatatttttgaaatattaaaatggttattttatcctcacgaatttctacccccaaattgcctcaatacttccaaattgaagaagtaccaaaaggtcttgtatcatagagtttctggcgttacatagctataattatctttcactatgacaggacaagaagcttgaagacctagggtgtaagaaggatattcaggagaggaaaggaagccttacttcttctgaccagaggattctaacagaggtcaggagaagagaaaggcaagaagacattagatagattgaaaggcacaacaagggtagaagacctaatgcttctcttccctttagggtctctgggggagttcccagggcacaccaggctctttaacaacagagaagacctcagatcattaagaatgcagagcagcagggtcaggaaaaagcacaggttcaataatcattcccaggcctccctttctttcctgtgcctcgcatgcggggttagagcatatggacctgccttgggcccctccacagtgaataacaaggtgaggtcatcataccatctggagggctacagaatcatcaggggctggataaagaaaatggcagaggctcagaaggatgtagagcaccccaacaaaccaaaggaggctgagtcagcagggaggagcccataagccctacattagccaacttttagcacctatagcctttgcagactttagcagcagtcacctattaatctctaaaactgaacccaagcccatcccacctcaaaggagagctgccaaagcgaattcaaggacctgcaagagaccagccaccacctttcccctaaatccctaatttcagggatataatgctgtcctccataaatcctgataccattttgaaaaagagtaagggaaaagagaagaaatgggaagaattgagtaattctctcaagtagattgagctaaagctagagacatgttaaattattagatgagattaaattttaaatcatattgggctaaatttagttttttccccactgctcagtaggcacagtcctcctaagatcaattaagttatagagaaaagctacattttctctgcatacccaaattgtagcatgaatacatttgctatcacactataattatattgtttggtttagaggaaacatattgatgagacgtttactcagggtttaagaaatctctgaaactaaagaagatagcttttctctgcatacttacatattagaagctgtgtgagataatggagagaaatgtgctggaaggcagacctgagttctaagcccaattcaactatttattatctgtgtgagcaacttaaaaagtcatttaaactctacagcagtgagattgtgtgttccatgtgaaaaatctagggaatcattatgccggattacttagcgtcttcatccataaaatgggggaggagaaacagacggggaagcaataatgtctgcaacctttcccattctaatttcctagtagaaatgactaaaaaggcaggtgtcatttttcttaggtaaccagtaaccagtaacttttttagtttggttcagtaggaattcacctatgggccatgattccagaaaagtttgagaggaacttattgacagcgatggtatttaaggacaaaatcagagtgacctatgtgggattagaaatttgcgtccaactttcagcaacctgttttgtaacaaataaattaatttgaaaatcatttcctagagtagtgactaaaaatggtaagggatcaaaaattagtgtgagtctcaaacacaaatgaggctaaaaaggctcttcaagatgaatgcctaaacctgttggatttctttaattttaatatgaaagaaggatcttttgattcctctactcccttcccctgaaatttcctcatttataccaataaagaaatcagtgcaattttcaaattgcaattaagttttatggacttctaaaatttttctgttcaatgggatcacaaatgttttaatattttggatgaaaaaaaggaaatgagatgtccgtgtcagtgaatcaatcattcattgatcatatgggcatgtaattctccattaagaagtatgtaccggaacaggtccaaagaaagaacaatagtgatacatgtgacaataataagtctagctttagagttgcaatagccttccgcgtgccaggtaatgagcttttcatgcatcttgctcactgagatcgtcacgtgtggtcttattaattcacaccacaatgaccctcaaaagtaagtgttgttatgcatcaccatggtgtaaaaatagcaggaatttttctgactatactccaaaaagagattttagccgttagttcatcacagtctaatagctaaacttatttctaatagtttaagtatttacagccccacaaagtctatacttcagcacttcaatcccatagattaacaataaccacagtaactctttgctctctatgagcaaatactgccatcttgtggaaattgcacgccaaacagaacattattgttccataaactcaaaagtttttcttgtgtttattaagaattttgcaactcaatttttgcattgtcatacatacgcgcacacacacacactcgcacacatacatacacattattgttgcttataattacaaggtacaattctttagattttcaagttcaatttaaaagggccagtgctttgggaagattgaagggaacatatctctttgcttattataagaattcatcctattcatcttccaggcagtgcattatattttaccacacttgctttacataatctttaaattgggtttttgttaaatcataaaaaggaggccatagtgagaccattctgatggaatttccaggaacactagattttgtagcaaaatgttatgacagaactctggacttagagaacactttcattcccttccaacacttgtagcccatgccagcctgtattcctggaatctgttgtcaggggtgactgaggggtcagatggtccaatttctctgtacatccccaaagatgaaatctccctgcaatgccccagccacttgtgctgccgtgagcataaaataaacaatacaaagagatttttgtggcatattcgtacttgaagcacctagagagggtgcttccttctttcccctcgatgatctcctatcgctcagctggctgaacctaaaaattctgcaattaaatgattttttttgggtttaaggcttttaattcctattagaatttaaataggtgaggtattatatatatatatatatatatatatgaggcatatatatatatttcaataatgatttctaaagtcaaaatattttccaagtttagaaagaataaggagacaaaattaaataaaatgaaatgcaagggccccaaataccactgagaagaaagtgtaggcagtaattaagttcctgaatgaaggaaggaataaatgaacatgaattgagggcattaaaaaaatggcttcacagtgtcactcaagcctctccggtggaatgtgcagtcgtggtttagaataaattttgtacccaaggaaatgtctggaatgaagtcattcttcaactgtttattaaatggatagatgaataaaacaggaatggaataaattagaaaacagcatcaatcgtaagaaaaaagaataggatctgatatcagagtttaggattcatttaccaaaactgtgttgagtatattccatcaataaatatgcacctgctctgtaggaggcaatatggaggatgagtacacactctcgaaaatggaacagactgatcaagtaattataaatgatgataagtgctatgaaggaaaattcttacactttcacagtgtattagttcgttctctcactgctatgaagaaatacccaagactgggtagtttataaagaaagaagtttaattgactcacagttccccatggctggggaggcctcaggaaacttacaatcatggtggaaggcacctcttcacaaggcagcgggagagagaatgagtgctgagcaaaggggaagccccttataaaaccatcagatctcgtgagactcactatcacaagaacggcatgagggaaaccacccccatgattcaattatctccacctgtcctgcacttgacacgtggagattattacaaggtgagatttgtgtggggacacggagccaaaccgtatcacaaggctactgaccaatatggtgtgatgcaaataggagagcaggataacaggatctcattttgtgcccagatgtattctcattaagcaaatgttgctgtagttgccttttatatctacaagtacttataaactcaaatttaaaaagaattatttgttcaaagatgactacatttttcctccaaggtaatcaatggtgctctgactacctagagcctttaggtgggcaaatacataagggatgtgccattattttttattattatggtaagaattcttaacatgggtgctattctatgaaaatttttaatgtacaatacagtattgctaactatagttacaatgttgtacagtagttttcaagaacttttccctcttgcataactgaagctttacacctatcgacgagcaataccaacatcatttaaatgatattcatgaataggccaggaaagtaattttgataccatgattacatctttgtgtgttgcctaacacagtgctggaaatttctacaagtagttgcttctttggatcaagagattatttcccatgtgtatttcttaaacctgttacttggaaagcaaaatgagagaaggggaatgaaggtcataagtttgggaaatgctgagttaaacaaaatcatgccgttttcttttctgctggtcttctgagagtctttaataggctgacatctttgtaaattcccaagagtgtgtttctcagaattaataaccacaaggcccttttcttacagaggtcttgtaggtactggtttgctgtgaaatgcacttttggaaattctggaaatgcaaatggctttttctggaatggaagctggaataagggtgacatataacccattaatattcataatcattttagtaaattcaattaatcaaattaattactcttctagagcaacactctagacagatacatttcacaggaagcaaggagaaaaggtccaggttgtgggggaggtttcagaacagtctcagtcctggactgccagcacggggcaccagagctgaggctgtgggaacgtctgggagagatgacagggacctgagaccaaccctctaccagagccttaagggctggtctcactctagtttaactcagattaaacactgacccaacttccaatgcacaaaatcttcttccctttatcatgttgcttgttcttctagccatgtggatgacatgaaacaggtaaaaaggtcactacaactccattctctgaactcttaaattgtaagcagtctcaccccaaataatccaagaccttgggcaagagtacaaatataggttcacataccccaagtctaattatgtaaaaattatgcattaaactaaaacctgtttgatataatatattctatgttcttatctggacaaatataccttcatgacccctgggaggccaggtttaagtttctatgtgactagccaggaggtctgaactgacccaggagcacagggctctggggccctttctttccacctgcagctccaacttgcacgctgaagtgtctcctacgcaaggctgtatacacccgagctcactcatctgagctctgtccacactctacaaactccaccctatagagctatggtgcacccgtggctgtaagatcttctgccaggaggacaaccctgggaataggcctggcaggccctggaagagcactaagctgtttggccaggaaattccagggaacccagaggacgatgcacactctgtacaggcacacagccttggtctgatcttccttgccctgtgaaaaagggcatagctggaggagggccacatctaggctggcctcaggtagagcctaagaagcactgggaattgagaataattcctctatgaaaaacacactttaaaaagctgcagtgtgcagctaccctcagactctggggaggggaaaaagaagcagcagaagaaaaagaagagggtttttcctatttgaatttaactacttctgaaagcctctggtcaggttttcttcttgttttccaaggtaagattacttcccctttggcattaaaagggaaactagatcagttgtgcgaaaaaccaaaaaagatgtattttatcaacttgaaacttatcccaaggcttcctctcacactgtgttaaataataggtcttcttaattgaatttctttgtgtgtagcatatgctgggtgacattacgccagcatcttgctctaagcagcaaaacgttcttcataaaagcattaagatcctgagtatcattctggatgtaggaaagggacacagaactacaacaacttgaaagcatataaaaacagtgcctctgaattgtgattgtaaaaacacactgaagcaaaccaggaggaaaatatttagaattatagaatgaaaccagaagaagaagaataggaagaaaaggagagaggaagatgggagggtgggatgggtgaagagagagaggaaagcagtgtggtgcaatgctgtctgtagaatcaaagcaatgatgactttctgtttcctagcattccatctaaaacaagcagatctatatattcatttccctttgacagccaccatcctacagaggtgggattataaatggatgtgttgtgaaccagggcgataactatgtctgtaataacacatgcttatgttctttatcccaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggtacttgattgagagatttggctctaaattgaatcaacaagcaggctgtatttccagggaggaccatcccagggaggataatgggttgggggtggtccttgttttttcgtttcttgaagattaaaaataaagttgtgaaatataaaaattggtaagatcaatatcaatttccattttaggatatccccagatcagtgaagaggagactatagtgtttgaaagacttagaaattcatataccataatgggctttgaaattctctcaaatctcagaatagattttaattcagtgatttttaaaggccatgattcctttgaccagttcacagagatacttaccattttgtttcacttagttgtttaacttgtaagtaaattcctcgtatctctaagactagccccccaaaaatacaatactgtaataaaaatgatcagaattttctcttcaccactagtgactgcctccttctctactcatgtagacctatagaagctcttcgatggccccaagcttatcaaatccaaaatccacatcatgaaaacatccaaatttcaatgtttctcctttactgtggagtcagcttcacttcagggccatattaaattttatctcaatatctgaaagaataattacagaattacacatatctcttttatagtggcctgagcattgttttcatcaagaagtatgagacttataaattaaagaaaatctgaagctaaatcttgattaatttatcttatttccattggactaaaggggtgaaaatgttttaactgatgaagtcatattcactaaagcttcacaaattgaaacaaaaaccaatctgaatttgctaaacaattttatgtgatggatagcttcaaagaaacttttaaagtttctataactagaacttggctgactaactgatgcctgaggcaactcctgaaaggatctactttaatgcacaataaatacggcttctcatttgcatatgaattgttgcacattaatgtgtttttttcaaacagggtgatttcaaaagtagtgtaaggattccttcttatcaccttatatgcaaaattgatcagcagcatttataaggaaaagcttggctttagcaaagatgaattttagcttcctacctgtgtgaatgagcatacattctaaatatgtgaagaatgaattataaattaatcaagtcacattgtagtgttttctttgtggaataagcttctggtatctccgttgacattgattcaatgcaaaagaccacattaatgcaacattatagctgagactcatatttttaaaaatctggaaagtaaggactccccaagctccttatattttgaattactctatatgatattaaaattttgcattattatatctgttgatggatgactacattacagttgctgtgggaaccataaaattatatgtctcaatcctctaaagtctcagtgataatattgcattaatggatattttttattgaattttgaaataagaagggagaaggaaaaacagtgatgcacatcaaaatatttttcactgaggaacactataatagcacaatgaaaaaaatacatgctccattctaacttgtgacagctaatccagatcctatgaaaaaatattttctcctcttatgattaatagatatcttaaattctcataaatttaatttattgagtttggctgtaaataagactaataacaaggataattttatttccttccagttttatttctcaaatattgggcgttaatactcacttttagtgaaaaatataaggaacttatcaatgggtttcaattccaaaaatctgagattttacttatatttttgtttattaactgccttcttaccaagacgccattagcatagcttaaaacgtctttggttttgaggtcagttagcataaagctggccctaaactaaagctatcactcacgtgccctgacttgaaggggtccctaaatatctcactgacctcacagtattgactgattcaggtgctagataccttgagtgcataaatccctcaattagaaattattttgtgttgagtattgctctctctaaacaatcgcacatatccttggcttacaaggaataacactttaacagtcactaacacttcagtatgaaatagcttactatatcatttttttcaagaatggaaacttaagtttaggagtaagtggttgaaaggaacaaaaatttaacttggaatgagacgccctgaaaagggaggaagcatgtataaagaagaggtggggggtagagttgccaaaaccatactttctattgttacaattttgcctgggtctgtcttttatagaatggcaatcacccatcaactgcttacatatctttgtagttgcatgtggcatatgatcactttaaaacctttactgcaagaaaaatatttattgtagataatcttatctcagaattggaatcccccagaacttagcacagtgcctggctcatactaggtgctcaataaatatttgttaaatgaataaaccccaaagttcagttaattacatgtttgctgaactacttttttttttttaaccatcaaagctagtactgatgagaaccttattttctttttcttcatctccaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga
